United States Patent 9,487,797 (GENOMIC PLANT SEQUENCES AND USES THEREOF) - sequence listing, part 4

SEQ ID NO: 6321 - DNA, 416 bp, Oryza sativa
gtttccatatgaggattcagtgaatttcgaccttccatcggacttcagattcgaagacatcaactctaagaaattttactagtccaaagaagtcttctcggctgccattagtccatgcatcctttctgttgacatccaccaagggagaaacatacaggtgtcttatgagttctaccatccaataagctcagctaggcagtttggaatgggacagctaccaatcggcttgttctttgccgataagatccagtgcagaggagaaatctcatcaatgttgatgattgatcggctgatcaacatcccaggacctcctttaggcagtatatagaacatagagctggcaaggttcaggagtaagaaccttgacagatggtggggtgaatggaagcaacatatattccatcagccagcctcta

SEQ ID NO: 6322 - DNA, 1501 bp, Oryza sativa
cgaataatttcaaagatattctactgcagcagatgtacgctttacccgcagtccacgacttgctgataatcatcagctttagtcatggcctagtattaagtcattaacaattatggcacctgttccatgaacttatatcctcttatgctctgaacgtattgttaacagcagcaagaggagttctggcgttcccgagatatttaaggggaactgatcgtatgacaccacgtcatctcgatcagggtttagaaatataccatatagtttatactcgagtatcacaaaccatttacctatacatggtaatggctaaagttgcccttcgcggctatagttgcctcctgcgcgaggacttaaaaataagaaccactatatagaggtgccatattgctaattaacataataactaggtctgtccccattctagaatctgcggtcgtacccgtttgttcgacataagtacctggtaaaacttatatcgatcgagacagtactagccacccggaaatcaaccaaatcttacgtactgtcccaatctaagtataaggtattttaaccagattgtaagcaaagtaagcaatactaaattatgtgggtttctatggttgaattgtgcatataaaatagagtattgaatagaaggctataaataaataatttgtaaaatataggcttaaatgatcaataggtatatggtaacttgccttgctcgatgtcctgagattgattgatattatctatggagtcagaagaatcctcaagacctagggttagacatatataaaattcaaatttaaaaggaatttaaataaaatccaaaaatatgaaaaatagagaaaataaaataaaatgcaaaaagagcaaaaaggggctcaaaagatagagaatgattttagaagaatattggtccaagtttcactggatttggatctatattttaaaagatatgggcttctaaagtttgaaaataaaataaaagtgaaatgttactgtgtgcgggtcccacctgtcagtctctctctcttctcttcttctaccttcggccattccccaaatcgggccggcggcactagggtttgggattacggcggtgctagagggagaaattggttgcggccgagaaggggagggagctagggatctccggcgacggcgagcggcggcggagggattaatttgatatgtggatgggttggcggctagggcagcggtggcacggttaggccgtgttggtgatcgaagtaatatgagttagacatggctaggggaggggttctagagcatttacgaggtgtctagagggattccggcagcttgccgacctttggcaaggtgctgagaatagttgccgacgagcgtctccataggcggcggccgtgctcacgtcggcagctcagagggtggcatgatagtgcaaagggattgctaaaatggaatctaggtagtatgtagattgttgaaacggaagaactcaccaagttatgtcgagatgaaggattgt

SEQ ID NO: 6323 - DNA, 1501 bp, Oryza sativa
gtatgtcaaggaaatacccggggtcctagtcggttacgattgtattttatctataatcccatattccgttaggatatggactgtattttgtaaagcggattccttcccctatataaggagggtccgtgtgcctcttggggtgcgtttttcttttttccagtatatacaatcaataacacactcggcggaatcatccccggacaggagtagggtattacttcttgaataagaaggcctaaacctgtataaaattccttgtctccaaacccatccactttcctagcttgatagccacccccttttattattgccgaaatcttgtttcgacacaatccttcatctcgacataacttggtgagttcttccgtttcaacaatctacatactacctagattccattttagcaatccctttgcactatcatgccaccctctgagctgccgacgtgagcacggccgccgcctatggagacgctcgtcggcaactattctcagcaccttgccaaaggtcggcaagctgccggaatccctctagacacctcgtaaatgctctagaacccctcccctagccatgtctaactcatattacttcgatcaccaacacggcctaaccgtgccaccgctgccctagccgccaacccatccacatatcaaattaatccctccgccgccgctcgccgtcgccggagatccctagctccctccccttctcggccgcaaccaatttctccctctagcaccgccgtaatcccaaaccctagtgccgccggcccgatttggggaatggccgaaggtagaagaagagaagagagagagactgacaggtgggacccgcacacagtaacatttcacttttattttattttcaaactttagaagcccatatcttttaaaatatagatccaaatccagtgaaacttggaccaatattcttctaaaatcattctctatcttttgagcccctttttgctctttttgcattttattttattttctctatttttcatatttttggattttatttaaattccttttaaatttgaattttatatatgtctaaccctaggtcttgaggattcttctgactccatagataatatcaatcaatctcaggacatcgagcaaggcaagttaccatatacctattgatcatttaagcctatattttacaaattatttatttatagccttctattcaatactctattttatatgcacaattcaaccatagaaacccacataatttagtattgcttactttgcttacaatctggttaaaataccttatacttagattgggacagtacgtaagatttggttgatttccgggtggctagtactgtctcgatcgatataagttttaccaggtacttatgtcgaacaaacgggtacgaccgcagattctagaatggggacagacctagttattatgttaattagcaatatggcacctctatatagtggttcttatttttaagtcctcgcgcaggaggcaactatag

SEQ ID NO: 6324 - DNA, 1501 bp, Oryza sativa
gcccagcccagctagagcagcccaatcaccacccaatcttgtgcaaagtctagaattgatcctaggggaccacatcccactcaaaaaccgtggtttagttggccttctcctcccccttgcgcgcgccgtcctggcggccgactttgccgcacgccgagccgccacgcgtcggtctccggatcgattgcgcgtgcccgaccgccttggcgtgccgctagccgttcgacgcccttagaccaccaccgccgcaccaatcacgacgacgacgaagtcaagatgaccaccgccgcaagaaatcaccgctcgacgccgtgcgcgcccgtccaaagccgccgccgagtacgatttcgcttctaccctaggtgaatcgcgccaattcttgccgcatggttggattaaagttagacgttggtttcccctctcacaattcaaaccattcacccccaaatcggttgttttcaccctcgccgccgccgtgcgtcgcgcccggattggcgccaacacgtcgcaatccgaattcgcacgcggtcaagtcaatccttcgccggtaagtattcaaacgtggcctcccgccactcaaattgatcttgcccgccctctcatagcctctaccgccctagccatatccaaagctcgagctcatccatggtgatgacggtgctcgagctcatccattcctcccagccctataaataggaccccaatcccttccctgtccatcatcgatcatcaacaaccataaccccacaaccctgaagctctgcttcaccaatccatcccatcaaccaccatcacccatcggtcgaacaccttgtgcgcgatcgactccacacctctctctccatcctccgccctaaatatcccttagaacactttatatcaaccatgttctagtataatagaccctaaccaaagtcctgcgtcgagttctacctcgccgtgccaagccgagcactgccgctcccgcgctgctctgttcttcgccgccgcgaagtttttccggccgcaatctgtggagattatggttaccccatatctgcatgacagttatactttagtcggatatacggtaccaaatatagatagaatatctttatgaggactcgggttagtttttaacttgtatgtcaaggaaatacccggggtcctagtcggttacgattgtattttatctataatcccatattccgttaggatatggactgtattttgtaaagcggattccttcccctatataaggagggtccgtgtgcctcttggggcacgtttttcttttttccagtatatacaatcaataacacactcggcagaaacatccccgaacaggagtagggtattactttttgaataagaaggcctgaacctgtataaaattccttgtctccaaacccatccactttcctagcttgatagccaccccgttttattattgccgaaatcttgtttcgacagttggcgcgccaggtaggggcagcgtcaagttctcgctgactaagtgcga

SEQ ID NO: 6325 - DNA, 1501 bp, Oryza sativa
atgtaagtgaggtgattggctcgggttccatgtgaacacgggagtcagcgccaacggacccggtgttgacgcgtacaacctccacaacaaggtggtggggctgaggtcgtggatcatttttggttgatttttttttgcatggtgtaatttcaaaataagtttttagaaaggatcaatttgtcaaaaaaaagatatattcattctccgattttgctaaacatcacacgggtgatttttcgttgatatttgacagatttttgcccctacaattatgcgccgagatcagtacacgattctgcgtcaatgttgtcgtgaggtggagaggagacctcgtgggtcccacgtttgccgctgatcacgattcacaagaaatttacatcctagctacgtgtaaatatcctatataactaaaataaaatataaaattacagtcctatttaactaaaattacatatgtaaattcagttgatattaattataatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgatgacatgtaagtgcactgtaattttgatgaaaatattgtgtaagtaaatttgcattagttattttatttcaaatataaaattacagtcctatataactaaaattacattgtaaatttagttgatatgacatgtaagtgcactgtaattttgataaaaatgttgtgtaagtaaatttgtattagttattttattttgtagtccgttggatgcaaatccaagggaggaaaaaatctgggtgattaatcacccgagtgatgcataagctgtcccttcattctctcaatccaaatttcatcggagttatagttgataatagctcgctgcggttaacggctttgggtggggaacaggggaaggcaaaacctctgcttgcaaactccaaaaccttctggaacgtttcgtcgttcgaatcgcccgcaccaaaatcccacccctcctcttcctccttcctctgcaagcaaagcaacccggtggaacaccacgcgccgcacccctcctccacctcgctcctccgctcccgctccccgccgccggccatggtgctcgagctccaggtccaccccaccccctcctctcccccatttcctccctcctctcgcttcccccattcggcgctcgctccgcggctacccgcgagttcgctacggtgattaatttctgaaggtttttattgttggctggaacccaatgcattcgcaga

SEQ ID NO: 6326 - DNA, 1501 bp, Oryza sativa
tttagttgtatgtcaaattgtacaagaaagcaccagtgtggtggtggagttgtgggtgtgtaactctatccaagttgtccacaaatattacacatatgtaatagtgggctagggaattgtcatcgtgagatcggtaaacgtgtatcacaaccaaacaaaaattatcacaaccaaacaaaaatttcgatatggtaagtattcttgtagggcctaagggcatgtacaatgattgtcaatagtggtctcttagcattgctaattagaaatacttgttgacatggaggaaagagaaagaggagagacaaaacatcgttgttatgtatgacaacggcttaacaacgactcttagtcactataatatggaaatatggttgcatgaggataaaaatatgaaaagaatattaacaaaaggaatattttttgagttaatgattagagcctttgtcgtctcaattatcgtaaagacatggtctctaaataatcttgtattgtttaagagaccatacccgtctctatcattgatcatgccctaagggcatgtataacggtaattaatagtgggctcttagagttgttaagaagataagttttctaacacaaataaaatagataaagatatgcatgacccataatgtctgtttataaaaggaaactttactacgtgaggatggagaaaaggaaggaaaaataataataaaatatttcagtatattgattgttagtcttttatcgtcttgaatgaatgttgtaagatagtctctgaaagcctctaccagattccacctgtgaacatgctttcaacatgtcctaaggtgatgaatgcttttaagtcctgacaagaaggcccaacctgcaagaaaggctgggttttgaatgcttgatgttggagcaggatgggccagcccatggtcggcccagtttcagtgggcctcaaaaacacaaactcacgctgacccgtgggcccaccaccaccaccgtagcagtcagtctccaacacgcggtattcgtagccgccaatacacgccaaaccgaaacccacctccagcgggccccacctgtcatcgacaccaagaacgcggaatcccctcacggtacggatccagatcgccgcacgcctcctctccagaacactcgcccgccacaccaccgcccccaacgacaccgacacgtgggcccacccttccccggccccacctgtcattcacgtggggtgattctacgacccgcctcgtccgcttacttattattattattattattacagacaggccgtaattccaaattggagagtgtttcttttttttttcccttctttttctctgtccttccctctctcttcgcctcatcgtcttcctcctcttgtttcgcgagaaaaaaagaaaataaaaataaaggcgaggaggtctcgcgagctaccaaaccctagggctcgattcggtggcggtggggagggggctggatcggcgggatcgcgcgggcggcggcggcggcggggagggga

SEQ ID NO: 6327 - DNA, 1501 bp, Oryza sativa
gcctaatttaatcatgtgtaaattactgacaaaagagcacctgttttgcaaaggcagtagtactactgaatgaatgaatcttttctttttgggatgagatgtcctctcacgtgtgctgtctgttggacaccttttttaactccttgtgggactgagtggcagaatgggtgtacatgtagaactgtactacctgcacctacactggcacaaatctactccttccatcagaagaaaaaaaacctcagacttctaggatgatgaatctggacaactattcgttcagattctttacactagaagatgtcacatcttcttttaggttgagttattttttattataggagtacatgtgcacttacatcatcttataatgtactccctccgtttcattctaacatttctcatatacatctatctatatatatatatatagatatctagattcattaatattaatataaatgtggaaaataataaaatgagttacattgtaggaagtagttatttttaaagtttaagtttattttaaaatataactattttttcacctatctcttcatcccatcaatcatagacatctccatttatattttaattactttatattcttaatcaattataatattctgctatttaatctcgaatgttaaataattcctataaaaacctctataaggctgcgttctttgtttggagttcctagctccccaccctcgttttccctgtgcacgtttttcaaactactaaacgctgcgttttttttttcaaaaagtttctatacaaaagttgcttaaaaaatcatattgatctatttttttaaaaaatattaatatacttaattaatcacgcgttaatgcgaacatcgttttgcgtgcccctcctcccgaacacaacctaaataggcctggtttagtttccaactttttcttcaaacttcaacttttccatcacatcaaaacttttctacgtaaataaacttttaactttcacgtcacatcgttccaatttcaatcatgcttccaattttggcgtaaactatttattgtctttctcttatagtagtattttagaatggagagagtactatttattgtctttctctgaatccggaactgcaactgcagaactgcaaagtttgggaagctgaagaaaaaaaattggttggatccaagtgataggttacattttggcagtaataggtctcgtgctggagtatttaagtacagttctctgatggaaaccggtaaaaaaaagagttgatctggtcgtggacagacagcatcggatcagaagacagaagcagcgcagggggttgatttgtttggatagattgatgaatggtagggatgttttacttgttaaaaaaagtaagtaaattatgccgacatgaacttaagctacatattttaaaaaagagaaggtattgacaacatcactaatgataaaaatccaaacaaagatgaacaaacagatcaatgctgggctaatgataaaagcataa

SEQ ID NO: 6328 - DNA, 1501 bp, Oryza sativa
acttgttgagcacggtgattatactcaatcttgctcaatttttcccccaacctagaaaaggagttcttggaagaggatggcttcagtgtctagctcgtgcctgccgtcaagtgtctatggtctttgtcctagtcatttgtgctttttcgtttatctatgtgtgtttggcctttggtcgcccatgtaataaaagtattatttacgcttccgcttgttaaactctgatattgtatcaactgttgtgtacctcgcctcgtgagaagaggaataatacatgcacgaatggaaaacctgttgggttattttcggtcgtgacagaccctattcttgagtccatctcaaagaaacactacgacacataaacctgcatatagtaattaaaaataaaaaaaatatagtgcttactactccctccattccaaattgatctacatatagttttttttaggttatttataaatgatcatcatatttgtgttcattcattaagtctattcgttatttgtgcattggagtaaatggacattgatgcatgcatccatgcacacaagtatttataaccaacgtgcaatatcttgatttgctattggctaggaaatagtggggatggtgcatgtatcgagtttgttgctagagtaaatatagtattagagagttatagtattagcttttcttggtattggtgtgcctatgaaatttgtagatcaatttggaatggagagagtaatatatacactaatcagacccaaccaaatacttcctccatctatttttgatagtcatatttccaaatttgaaaaatttatttttgataggcatatttcaatccaacaacatatcctcttaatgactttcttggatttaatgcgtgactctccattcttccacacaagattggctacataggtatcgagaaatgtaaatattaatgaattgcttgtttacgaggaatgactagtagcatgtttaattggatgataagtagaatctgtgtgccaagataaaatatgattataaaaatagatggagggggtatattttacccattttttatcaatagattgattgattccctcaacatcctcatttttttctcaactttcctgctccgtccaaaaaaaagacgaaccctgggtttccgtgttcaatgtctgacggtccgtcttatatgaaattttgttataattagtatttttattattgttagatgataaaacattattaatactttatgcgtgatttgtcttttttaattttttccaggttttttttttttgacggaaggagtatatccgacggccactcacactccactaacggtacggtttgcaacttgcaactgtgaaaactggtgaagtgcagcatccaccaccaccaaccccccaccccccacgcccccacaacgctccagcccaaattcccctcactcccacactccactgtccactccaagctcacccgagctccagctactcagctcctcgtcgccgtctcgccgccg

SEQ ID NO: 6329 - DNA, 1501 bp, Oryza sativa
ttaatttatttaaatgttatttgcttttcaaatatctccttttactccaaaataccctttgccactaaaaagccgccagttggaactttacgccttccatggggatgctcgtggtctattggccccgacatcgaaccgttgcctgtaaagtctggctcccagatatgactctacaacgtaccggacagggatgactttagtgtttcgagggctgtcaccacctctacaccccctcaaacctactgtgagatacaaagcaaacaccggaaattaactacccagacactacgtctacgcagtttaataactactttaatgttagctaaacactaaagcaaccactataaattactggattatagtgatcagtgatcccgtacgttcattaggaactaactaagaggtaactctcatagaataaattttaaatactcgtaatgatatttaattaaagcagaatacttatcagagtaaaagaaacaagaagaggattaccgataactccggaattcctccgacttcctgtactctactctctccttcattttagtatacaatatagtacaatagagcctcttataattcagctcaagcttccaagtgcgtgttgaaatgagtgaagtgaattctatttatagggtaggtatgatgatgcgaaatgtctaatctgccctccaaccgccatcaggagcaaatcaggaacgtacataccaaaacatgaatcaaacggttgtcaccacctaggctgggctagatggcctgttgcctcagcctgggccttccccttgctctgtcttatccaattcgaggagcgatgggcctattttctaataattctacaaagtttaaggcccactcttagatggataaaagaaatccttcattgaagtctggttttcatcccaactttgacggtttattacctgcatccaaatatacaccaacactcatggaatatgttagaattaaaccctaccactatgttgaatgtgttattcatgatgttttatgcaggcattggcagcatagaattggcatttaacagccgccaacacttgatgattgcagtatcaaatcagttggcacgcgcttgacacactcgaggctagcattggacctgcactggagttaagcagatctcccaggccaccgtgttttcacatcaacattagcttcgtttgttgtgtgctccagggaaagtgaggtagacggcaagtggtgatagcttgtccgtcccttgtattcctccatgttcgggtacatcatagagctcaaggtcggactcagcttggcagaccaggggaggcccggtgcccgaagcattcgatagagttttacctttaacttaagttagttaattaagtccataggaatcctctctagcttaagcctagcatttattgttgcccttggatagaatcccgttcgtatatagtacacacatgtccttatgttcgatacccttgggtcactctaaggggaagtgctataacggtatccg

SEQ ID NO: 6330 - DNA, 1501 bp, Oryza sativa
ctgatccgatgctgtctgtccacgaccagatcaactcttttttttaccggtttccatcagagaactgtacttaaatactccagcacgagacctattactgccaaaatgtaacctatcacttggatccaaccaattttttttcttcagcttcccaaactttgcagttctgcagttgcagttccggattcagagaaagacaataaatagtactctctccattctaaaatactactataagagaaagacaataaatagtttacgccaaaattggaagcatgattgaaattggaacgatgtgacgtgaaagttaaaagtttatttacgtagaaaagttttgatgtgatggaaaagttgaagtttgaagaaaaagttggaaactaaaccaggcctatttaggttgtgttcgggaggaggggcacgcaaaacgatgttcgcattaacgcgtgattaattaagtatattaatattttttaaaaaaatagatcaatatgattttttaagcaacttttgtatagaaactttttgaaaaaaaaaacgcagcgtttagtagtttgaaaaacgtgcacagggaaaacgagggtggggagctaggaactccaaacaaagaacgcagccttatagaggtttttataggaattatttaacattcgagattaaatagcagaatattataattgattaagaatataaagtaattaaaatataaatggagatgtctatgattgatgggatgaagagataggtgaaaaaatagttatattttaaaataaacttaaactttaaaaataactacttcctacaatgtaactcattttattattttccacatttatattaatattaatgaatctagatatctatatatatatatatagatagatgtatatgagaaatgttagaatgaaacggagggagtacattataagatgatgtaagtgcacatgtactcctataataaaaaataactcaacctaaaagaagatgtgacatcttctagtgtaaagaatctgaacgaatagttgtccagattcatcatcctagaagtctgaggttttttttcttctgatggaaggagtagatttgtgccagtgtaggtgcaggtagtacagttctacatgtacacccattctgccactcagtcccacaaggagttaaaaaaggtgtccaacagacagcacacgtgagaggacatctcatcccaaaaagaaaagattcattcattcagtagtactactgcctttgcaaaacaggtgctcttttgtcagtaatttacacatgattaaattaggctatgatgcaccaagatgaccgtttgtttggacctaaacaagagggtttcccagttattataatcaacacagccattgcatgactgcatctgcaaagctaaaagctagtggtacaaagtgaagctcactagctagctcacaagtcagagaaatgtgttacttttggttgtagtaactgataagatgaaaagcaacagtatctgatcctccag

SEQ ID NO: 6331 - DNA, 1501 bp, Oryza sativa
gggtagttaatttccggtgtttgctttgtatctcacagtaggtttgagggggtgtagaggtggtgacagccctcgaaacactaaagtcatccctgtccggtacgttgtagagtcatatctgggagccagactttacaggcaacggttcgatgtcggggccaatagaccacgagcatccccatggaaggcgtaaagttccaactggcggctttttagtggcaaagggtattttggagtaaaaggagatatttgaaaagcaaataacatttaaataaattaagaaaattcaaataaaatagcaaattgggtatcaaaatgtagattttgaatttatatgaatttaggtccaagtttcactagaatcggatctacggtttaggagatatgtgcttctaaagaattggatttgaattaaatagggaaaataggaagagttactgtgctggggtccacctgtcagggaatattcttaatttcttctccttcccgtctccgtcttttttttctcctccttccagccgggtaacagaggagagagagggagtagggcgtcggtgctccggtgagtgaacggcctcgacggcggcggccaagcgtgttcctgcttgctgcgtatccggggaggtcggtggaaggaagagggagagaggaggatggctggaacggcagtggcaagagtttggttgcggttaccacaaggaggggcgatggtggccaagctaggggtggagggagaggggaaggtgggaaaatggactctcctcagtgaggcaaggtcggtggtgaaaggtagtaggaaggggatcaatggaggaggagatcgtccagtggtgggtggcggccgaacatggcaggagagagaaaggaagagctcgaggctctgttgatgtgtggagaaaaggggagggctcgccttctatttataggcggcgagaggcggtggctaatggcggttcggaggagaaggacgacgaggatacggctgcagcgacgtggagaaaagaacggcggcgccggctctgtcctctgattggctgacgatggcggttcgtccctgctgctgacgtcggcgtgatgaagtgtagctgacgtcgggcggcgattccttcgcgtcgacggcaagatagcagcggcggcgggaaagccgcgggcgacggcgcaagactacaaagcggcggcgccatggctgtgggcggcggcagcggcggcgtgcgcgcccacagagagaggaagagcggctcagctgggttgggccggcttgggctgaagaggaagatgagccgaaaaggagggagaaaggaatttcggcccaaaatatatttcgtggattctagagaattacttgtggctaaaagaaaattaatttggaagaggaggattaaataaaaatatcattctaatatttataatattgctattcttgtgccgagaagacttagttgaggaaattggaatgggaggctagatcaaaataggagcatgaccaaagagttaatgatac

SEQ ID NO: 6332 - DNA, 803 bp, Oryza sativa
tcataccactgacacatgatatcgaccaccgactaaccctcaagcaacaaacctaaacacgaaaactagcaagcaaacagactaagaagacgataaagctaagggcggcgactctgaagctcggggcggcgcttgcaatcgagggataggactgacatctaaagtagacaagggataggaaccaattcatgctcaaatccaaattaaacaaagcaacaaatgactcaaataaataacctagcatggtgatttttatgcatggaacaaccttttccacgaaccgagacaaaagacactaatgcaactgactaaacaataaattaatgcatagactagttgcatggaaaatgatgcgcataacattgccccatcgaacatagacacgacctaatgcataacccccaatagattcccgactgactgtcgaataaactccaaataaaattttactaaaaccctagactgagctaattttaaagatccgatccgaatgaacgaccaagattttttttcccaccaaccaaagaggcaaaccccaaattttcccgaaacaaaatccaagtgaaaaaggcatatgcatatgaaaaagggttcagagggctcctaggttttctagttggcttgccctacggtcaaggtcggctctgatgctaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgga

SEQ ID NO: 6333 - DNA, 251 bp, Oryza sativa
tgtggcctccgcctccgcctccgcgcggcacctcgatccgggcggcgccgcggcccccttccgcgcggggtggccgaggagcctcgccgtggcgggggcgacgcggaggggagggcgggagttaccaccaccaccgggaggaacggagctcctccccgccccgtggccgggatcgggggcccgggcgtaggggctccacctcgtggggccgccggggccgaggcgggaggcgagggactaggagatcgtca

SEQ ID NO: 6334 - DNA, 1501 bp, Oryza sativa; identical to SEQ ID NO: 1923

SEQ ID NO: 6335 - DNA, 824 bp, Oryza sativa
ctttaaccatgttgtcatcaatcaccaaaaagggggagattgaacatgcacttaaaccccctagtgggttttggtgattaatgacaaggtggttaaaggggactaacgtgtttatcaagtttattcacaggagtttagtcccaaagcgagttgggatggctaagaatgcaaggagaccccccccccaattcaaatgttcctaagtgcaaaaatcatcgaaggtggttagactaggtttttcactttcgaaattgagtttaagaaaaaccgtactattaaaaggggtttcaagtgtggttctagggtataccaagtgctcttagtcatatttatgagtcaaaagattttttggaatcatttttgaaaaatgattttctccccgggacagagagggctacccggaggttctggccggaacttttgggcaccgtttatttgcaaaaaatttcctaagtgctgcccggaagttcctggcacttttgtccggaacctcctggcaggtttctagttcaaacttgtgagtaacggctagatgatatcacctagccgttatatatatgaatttcgtccccaggtcaccttttggccattccacttctgttcattcatgttctagggttttctagccactcccaagcttcctttgcttcctccactcaaatctagagcctatcttgtgagattgagagattagacgagagtgtaggagtgttttggagatggcttgaagattaggtttgattgagcactttggataccttgtgggctgtcacttgggcttattactcttggagatcttctcctagacggttaggcgtcgccca

SEQ ID NO: 6336 - DNA, 411 bp, Oryza sativa
ctactcctaccttcaaatcagtacggcactgttaccagaacaagacgctgaaaactgaaatgggagggaaaagggatataactaactagaacacaaacagcaagtttcatacacacaagtacacaacaacaatgtaaaaatgttcttgcaattgagaaagcgaaaaaagtgtaaacacacaacttgggggaacatattcatcagagagaagcattgtcaacaacggcattggcattcaaaaccaaaaaataaaaataaaaataaaaaataaaaaaaaattccagctcgtaaactcatcagcaacctaaggatagcaaacagccaggcaatatcaacactataaatacataacaacctctgaggcaagatcaacatcaaatagaactacttggcttgtttcacctctcctat

SEQ ID NO: 6337 - DNA, 1501 bp, Oryza sativa
tagattctttctggaaataactatgagcaacactaacactacagtgtataagaatcacccttgtaatttccatcatttaaagccttgaactagatataagagaggcaaaaaggaagctacattaagtcttaagctcttgattctcttagattattcaactttgaagaagtatttagtagcaaatagaaggaaatacaatggatgtaacaaagatttagtggattttgaatagagcatcgcaaattgaagtcaagatgattagagatcaataaaatcagtctcttcatctctgcatgcaacaaaagggaggcatatacgatgttgtcaaagctcgtcttaagagaagagagaatgagtaaggaatagaaggcaaattagcaatagcgaaggaagccaattcgtcactatgagaagtactacgagtgtgatggaaaggatgaaacaacactccactccttaatcccgactccttcatgattgcaccagacgatgacatcatgttcgatgggctaacatggccacttgtctttttctttagttactaccaatttctatcaaattaaactaggtgaatattattgttatgcatataggctaaaggtccatcccttacaaggcttaaaaaattgcctacccagaccggccatggtacaatccataagcctttaccattgaacatctacgactacctccgtcccataataattgtatttttaggattcaaatgtgtcccaaaataattatcgtaatagagtacgccctctgtcatagaatataagaatttttagggtttgacacaggtattaagaaagtaggtagaactaaatgggagaatgttgtgattggttgagaaatgtgggtatgtgagaaaataaaatgccggagagttgttattggttgagaaaaagagaatgttggtgaagaagaagttatattttgggacgagagtactaattaccccattaatcactttttgttgaaatttctctctattctaccctctaccactctctcacttttacctatacactatttaataaaggatatcatagtctttgttatcaaatcttaataactaaacaatttagaatacctcagaatttttagatatttaaccatttgccacatttagatgtggcaattaactttttgccacacatgttatagacacgtgtggacccacatgttattgagataggggtggcaaatagttatttgccaaatttaaaagtagcaaatagttaaaagccccaagaattttaccctcaactatccattcccctctccccaatttaccatacacacatggatgtagataggctacaaccaaagcaacacccatccatcacatcaccacatcaccaacaatggcatcactgctcaactcatcaccatcctccccttgcgaacccacacacgcgcgcccacagccgcggcgcccgcacccgatccccatccccgcaaaccctccccccacttctcccttcctccaaaccctagc

SEQ ID NO: 6338 - DNA, 1501 bp, Oryza sativa
tctatcggcagctgcatgcaatgaaaaagcattagaatcaaaaggaaaataattacataacttaagcagtcaacaatcgagcgaagtggtgaaagatgcattaaggtgcaacacaagaaaaagaaaaaaggaacacgtgccacacaacgacaatgaccaaaactagtaggaagcaggaatcctaccaagaccaatatctatctattctaccattcaacttggaaacctatacatattcctaattattatcattatattatgtgaaacccatataattaagttgtgtgtattatctcatactatttacttcacatgctcatggcaacagttacagaaaaagtatacattgcactataaaacattgtagtttggataatggcggtgtgatgtttatgcttctaagtgtgccattaaaaaaccaaaatataccaacatgccattgtcttctcagcattctcccttctttcctggggatcctctgttgatttttatgatagccatcgtcttcctaacatcccttcaacaacgctccatctctcacttccaacaacgctccatctctcacttgcctcaaatgcaactaaagaaagacgtgcagtgacaatgatgtcatcatataggatgtttgattggagcaatgtctcaatgggtgagaagatgaggcatactcgatgctgtcaatgcaactctaatacccataagtggtataccaagttgccttcactgttacaaatccaaatcagttttgattgaagacacacctattgtcgcgaatactgctaaccctcactcccgagatatgctttttctacctctagttgtatctaaaagagtgcctagagagctgcattgctagctttggtggtaggaagtgctaagtccgaaaaaatgatttatgatgaaatgtttaactacatcttcgtaggaagcgatccaatatagttactgtggctacgactgttatggctggcataacaaacacaaccgtggctgcgagcctatgactttatttataaaggttatgtaagatgaaatatatttttattttttctgaaaatgaaagcgaaacagctggaacattttgcgctccctccagcccacccacgtccaaactccaaacgccaaacgaagcaggcttcgctccgattaaaaaaaaaaggggcctccttctctgcttggcggggcgggcggtggtaataaccggcaggcagtcaggcaccaatctcggagccaaacaacgcccatacgacgagacgagaagaggagaagcggagcgcatcgctcggtcttccttccttccgtccgtccgcggggcacaaacgcacccaccacccccccataacgcgcgagatcccctctccgccccccctctcccgatccgccccgccggatcccgccccgccccgatccgatccgacctagcccgcctcgccgccgccgccgtcgccggccggagaagggaggaaggagaaggagaaggagaagaagaggaggcacgaga

SEQ ID NO: 6339 - DNA, 1088 bp, Oryza sativa
attcctgcagccccgccttccgccaccctccatatccatctcccaatggagctcatcgacggagaaatggcgttgaccaatggaagagagaagaggggtgagatgagagagagaaatgagaagaggaagaacgcgaggataatttggtccgaaaaaattagaaagcatggtgaaggggtaagcagtagtatatctcgaagacctattaaattgtaatggcatgtttctaatttcgtaaatagtaatgctatttttctaaaacagcaaatttataatgacatggatctaattaggctgagttcgactccacctccacacacgaaaatcggtgttgcctattaacacgtgattaattaagtattaattaaaaaaattaaaacatagattgatatgatttttaaagtaacttttaaaaattatttgtacccacctgacaagttgttgcaccgtgggtgcaatttatggggaagaacactgccttaacccttatcctgacgacccctcctctttagtttgctcttgcccaccgctgccgcctccggctccggctccggcgatccccatccatcccgcgagcgagcagggcgccgtcattcatcctgctgcatcctggtgagcacatcctccgccaccgccgatccccatccaatcgcgcgtgcgagcgagcgagcgagctgggtcgccgtcgctcgtcctgctgcttccgccgcatccgttacgcacatcctctttcccatctctctctctctacccacgcactttttttctcgaatttgcgttaaccctagcttctgctctagaaatttgccttaaccttaatactagtaactgtttgatggttcctaagaaggtttggggggttcaactgaacccccaatgtcccatgttagatccgccactgtcagtagagttggaaatttgcactgggtgttgcaaagcctaggaagctttgttttataaactgtttccgcttatcagtttatttaccttcgtatgtgatgatgacgcgcagagtgttctgttagtggccaccattcttttgtcaaggatatgtatgtacacagggcatgatttatttcctctatttt

SEQ ID NO: 6340 - DNA, 445 bp, Oryza sativa
aaaaagaaaaatagaatttcaactaggaatacaatgtataaataactaaaatttgtaataacaaagactattgaaagaagggaccatctagaacccatgatgagattaattaaaattatgaaaatttaaaaataataataagagtttaagtaggaatataatttataaataaaatacatcggaatgaaaaatatgaaattttcaaactcaacgatgataaatgacaataaagatgggagaagccataagcctgtaaagaagtaaagtgatgacggttgaaggggcatctaaaaactattaacaaaaccctaaagagaattcaatgatgattaaaaagatggatgacggacaggcagttaagaagcacgatctcggcggttggcgagacatctaaaaagtaaaaagtaaaccccaatgataatcatattcaattttaaaatcacaa

SEQ ID NO: 6341 - DNA, 304 bp, Oryza sativa
tttctttaagaatttacaatttattgatggctttcttgtatcttctttctgtttccttcttctgaaaactaatactacgggggtatatttataggcaaaattggttctgtagcatcgaaagttcccatttttacttttatagcatcgaaagttcacagcttactagaatagcatcgaaagttagctctgtttctcatatttagcattccgtcaacaactctgttagaatctcatcggtttcctttttttttaaaaaaaaacatgtgaaataccagccgtgccctctccttcttccacctccagc

SEQ ID NO: 6342 - DNA, 1501 bp, Oryza sativa
tgtgtgctgggatgactcagccagctgccagtacaaatcattgtcttcaatttccatggttaacttttcttgccaaagcttggccggcttgtggatcagtactgatcgatttatgagaagtgtttgtctccgatcgaacctttcttaattatgaaacaaaatcacccatatttcaaacaaaaccactaaaaaaggtaccaatgagttttttcttcaggttcaaaagtgagggtggttttgtatgttatggtaaaaaataaactaaaattcgaaggctaaaaaggtagtaaatgcatagtaagaagaggttatacatcgcactagagatttaaccactaaaaacgactgaaatatactaatataaaatgtaaatattttactgtcgcaagattatcaaggtattttttttaacctgaaaacagtgcggcatcccacggtatattaaaaatatatacatataattatgtacagaaagaaaagttacataatatcaatccatatcaatccatgatatcgattgaggaaaagtatcaaggagttatatcaaatgtgtatgctagaaattgtcctctttttatgtgtgataaacatcatcgtgggcctattattttacgcatgcacgcacacttttgtgacaagttcaaagcaacaaaagctagcttattactagctagcccaagtatatatacctaaaccactgtatctatatgtcaatgaagtgatagaaatgtcgtacgaatgaaattggcatccatcgattccaaattattaaagccactgggcgatatatgtatgaattatctagggctatatattgatcatgagagtttggtcgcaatatgtctcagtctagaagcagaatgttgtgcgcgtgcagatcaataacattatacttttatgctccgtatatatttcaaaaatgatgaggttaggcttgtatatataggctcaattactagctagcttttcagtaaattggttaatatgtcaaaatcatgtgcatcaaacatatagtagtaaccttggattaaacattttacacaaagcgagaataaatgcgtaagccagatgttatacctacatggatgagccttacattattggaacggattaatgtcgttttggaggcataaacacttaaaaaaccattttcccatacaccccctctattttcatagggcgataaaaagaagagtcacctgtgaaaggtcgaggctcgcacttgaacattggtttttatagaatgccattttttataggagatcctattttgagttcgtctgtgaaaatccttattttttaatttttaagtgggtagtaagaggctcacccgtaaaaatatggctattttacaagcggagctctcaacactactgcttgaaaagtagagaacgatacaaaaacgaggataatgtgcgagctgtctcataattctcactgctggactcctcatctctctcacttcctactcttgtctctccctcgatctcccactcccagc

SEQ ID NO: 6343 - DNA, 1501 bp, Oryza sativa
tacaaataaaaaagctgtttaaaaatattttaagcaatatgtatatagattttctttttttttaaaaaaaacaatcacacactttatgagctctgtaattatgcccgcaataatttctaatctataatctacaagtaaaaaaaagagcagaggtaatactagactccatgcattctgtatatttactttactctctaagatagagttccactaaattatggatttcaggatagggatatcagtactacatattttcaggcataaataaagaataaaccatgctcacattatacaaacttgcgtgatagatgtaaatagatacaacttaccaatcattcgtcccgatgcatcaactttcctagtccattcaaacccaggctaaaacattccatgcaaacagaaataatctatgcagtacacatgtaagtttaggtattgaaccacatgcttgtgttatgcactactatagcaaattaactgaactagagcaaataggaatacaaaatccctcagatgcaactgagttttggcattgaatcagtacagaagctactgcttgattttaattctttagtgcttgaaccatcataaaatagccgcaaagattaaaaaaaaaacaacaacacaatatatagagaccatcatagtaatttgatccttccactttcacttttgtacgaagctgctgcatttctgctgtctaatcaacattctataaacaacatcataatgttctctcattacacaactgtaacctagagtatcagccagcttgggctaggatatagacctaaatttcatcaatgagtgccacatcgaatcattttcacttacgtgcattgttttggcccgagtttgcacgagataagcaagtcgttctatctacttcacgtaacatgtgagtttgtgcactgtgagtgcaatttactcaaaataaattgcatcatcatctttttgtgatactccgtggtttcgaaactattaagattcagatagttgtattgcatagtttcaaatataaacaaatcacattttttttttgtgtgtgtgtgtggggggggggggttaaattatggtgttccatagtttcacttgacaatttcactttaaattcaaatttaaaatttggagcctttaagtttgtgaacaaaagtacgagattggtcctccacaaattgaatcatgtgcatgaagttgtcacaggctcacagcgactgcacaacagcagctggagtaacacaaaaaaggccatttttatcactatgccattcatatgtattaaattatctctactctttctgttcgagtgatttgaacattttcacatccaggtataatccatgctaacaccaggacgtgttctcatttcagctataaatagcaaaaaaaattcaaatatgtataaacccgtcaccgttctcatccaaaattatctactttcccgataatttcattttcattaactccattcccgatcagtgagattttgctacgcattgtt

SEQ ID NO: 6344 - DNA, 1501 bp, Oryza sativa
gggcaaccgtcttttcctttgtcgttgacaacaatttgacaggtaactgagttttgagcaataccttagaagccttaacctctagtcagcggagggctcatttgggtaagctccttggtgccattttctgcagtatgtcatgcaatctttgtcctcattgtcaatcaatgttttggctatcatcctcgatgctcctgctccaatgtcggccaacttcttcggctttagtgatgtttatccaaggtgtgtggctgattgcttctatggaatgccaaggtcttaacctccatcgatgtgaggcctcaactgggtttgtgctaaggcaacatcttcagcaattcattgtgcaatcaccatcgtcaatcgtgtcgtccaactccaaatcttgctgtgggcagagaagatagaagcacctaattatttttccaattcttttaagtcctttgcttaaatttggttgtaatttttccatctttaaactactcttctaaaaaaaaggttgtactatattctaaggcctaaacccaactcaatctctctaattcattttgcgagaacactttaacctgtttcacttattttttggatgaaattgaaattatttggccgtgctctagtttcctaaaaaggtcgagcggagttgaagctatgctaaacaagctcttaaaaagggtcctccaaagaaggtccataaaaacggctctaaggcttttaatgggatgggcctggccctaatttgggcccaaagtggcccagtcttgtgtgcttgctgtactagtttacccgggagcaactcgtagatacaacttgcggtaggggccttccggtaatttgacgggattcactaattggaacttggtgttgggagtccccgtcgactcgcactcgacagtcgatcgccaacaagcccaaacccggagagagccggaggagatccgtcgtctcccgcatcctcaccggccgccggcgatggagaagggcaagggcctcgcccgccgctgggcggtggagctccacgacgcctcctcctctcctcctcccactcctccatccccgacccgcccggcttcaccagatccgcccccgacgcggtactacctcttcttcccccccccgtctttcgtccaactgctctattctcttccccctcccgcctggatcgcgggattgactcgtgtgctctcttggcctcccgcaggacgacgccgccggcgcgcggcagcggaaggattccgagaccgcgtggaaggcgcaggtgagctcgatctccccctctttccctgcgtgattgtacggtagatccggagttttagatttcttccatggctgtacgagaaattcggtgtggatcgacgaattctgtcgaatctaggacgcgtcagatcttgctgcctcgttatctccgcggagtgctcgaaatttcgcttgcaattgcatatgctggtatctaggttttaggtctgtgtgtgttgactatactgtctgtgctcgtggtgtgggc

SEQ ID NO: 6345 - DNA, 1501 bp, Oryza sativa
caaagtcaaaacgtcttataaccttaaactaaatggagggagtatgattttataaaacaacttttctatagaaaacttttatggtttaaaaggcatggaaaaagaggaagatgaggtgaaaaagaaggcgaagagcacatccctgatggtgagttggaaaaaaggccaagaacacagatttaaaaccggaggctaagttttgttttgtttttcgcaattgcgcgtatgcggtattgctaagctacagtagttgcggacgagtcaagaaccaccatgccgaccgatcgtgctggccttggcatcatatcatcatatgcctacaaatgctatgctacaatttcttcttattcttccattacaattttcttatactagaaaaaaaaatcaagtagcatatgtgctttggagtgtgcatagctagctgcagatagcacacatgtgtatgggtaggtatacactatcagctgtagtaacaaccgctgacatgtggaatcgggtccacctactagccactgctactgcaaatacagtaccgcagaggattcatgtccatgcactatacaccgctgcttgaatgctgccatggttccagctcaatagctcatcaccattgcataattaatccaaatcaatcaagctaagctacgtctccttcctgtcgctctcgcattgcagagatcagtcagatgcaaaaatcgatcgatcgatcacgctatcgtctcgtctcgtcgtctatcgatctcccagagttttctttagcgttatcgcgacaatgagatcacattaactaattgattaactaattacttcatccatttcatatccatttcataatataagtcattataatatttttcatatttattttaatatttttgatatttatattaaggttaatgaattagaaatgcgagggtagtaattaattaccgcgtgcttgcgatcggcctcgatcatcggagatattttgattcttttttctcgttttcttcgaaacaatgggagatatttctcttcccccctaactccactacgctcaacgcgccgcctctgcggtgtcagctgctgggccccacgcgtcagtgaggcccgccctggcgcgctcgcccgtataaatagcggcgctgcctcaaagaggagccgagagggagagagagagatcccgagctcccgacccgagcgacacgctcgcgctccttgccaatcttgggcctcccgagttttgctgccattgccgctcgctgctgctctcgagtgcgcgcgtgcgtgcgtgcgtgttgcgccggggggaatggggatagtgagagccgcggaggatgtggagggcgcggtggtggccggagccgcgggcggcggcggcggaggcggaggcggcgaggtgacggcgccgctgctcctccggcagcacaagcaggggcggggcgatgaggagaagatccagaatgatgccgggcggcgattgcgggggtcggcgcggaggaagagaagaagggtccatgtc

SEQ ID NO: 6346 - DNA, 1501 bp, Oryza sativa
gacgagagaagctacgtggagcggctggcgagcatcctgcgggagcaccggtacccggacatcacggtgccccggatgcggcggttcgtggtgcagcaggccatctggctcatgacctcgtcctccgccgccgccgcctccgccgccgctggcgcagactacgtatcgcttctccgggaggccgggatggagcggctgctggagtccatcgccgacaccacgtcggagctggagtgctaccacgcgttctccggcagcgtgggcatcagcaagcaccgggagagcttctccgccgccgtggacgccgcactcgagctgctcggcggcgatggagctcgagctgaggcctgagctgcatgcaacggtcggaactctaaaatggcaaaggatttgtggtgccacgctggcacgctcctcccgcacgttctgtgcgtcttgatgattgcacaacacaaaagtcctattctttttttttcttaaaaacaaaaagaaatacactacacttatacgagtagaaatttttactatagctaaaaaatttgccactattacacaaggatgtatatatgcactatctgttcatgagattcactgaaataacatagtacatatttatagttttgtcgttgctttgctttgggggcatatttaggtcctatttgtttcagtttaagattattataatctagattattaaatcagattactctaaactggattataataagctggcataaaataagctacgagttgtttgtttctctggattattagaggcatctaagagtagtgggtcattagccactcaataatctgaaaaaaagctcctctagagaagattattggattatagtaatctggcttatagattataataatctagcataataatctacttgtttattttaacttgctcctaataatctagattataataattataagctgaatcaaacagggtcttagttttggaatttctaacacaaaaatctacaggacataagtcatagcatgataccccatggtaggtacgtaacccaggggttcatcagttgttgtgcgcaactccgtttgtaccggagcagcatgatttttgagttgtgtagagtatcattttgatcgagcaatcgatgcgttactagtgctacttaggaatgaaaagtgcattttctttcacatttacatcccctctgctatggatgtattcgagtattcaaatccagtcgcccaaatctcacacgaatttgacgaaaccctataaacatttcagtatttttttatgatcgccgtatgggccatgaggcccaacaacgggtgatgctgtaccagacggcccagcaactgcaatcatcacaagtcttcgacggctgcatccggcggcgacgacgcggcggcggcggctaaatcggagacccgcctcatcgcggcgcgagctgcagagtcgcaccaatggaagccgccggtggcgcaggcggagcaagcggcggcggcggagagtcgc

SEQ ID NO: 6347 - DNA, 1501 bp, Oryza sativa
agccgagttagcacaagcctccaatggcgatgacaagacagtccaacaggtggaggatgaactggcaaaatgcaaactagtcgacattggagatgatgttgaagcagcggtcattcggactttccacagtgttgttagagagtatttccggggacccctgaagcctcccttcaatacggaggcgaggaaagccgctggcttcgagcctgcctggtatgaacccttggcagtgaaggaggtagagggacaagcagttgagtgagatgtttgatttctgccatgtactgtagcaggctagaacctacatggtgggcattacacttctgttgaacctcttcttccctgttcccttcttttagcagggaaaactgtactgaacttgtgatcatgttttgtttgccatacggaaaccgactggtctgtccgtggaccagccaaaccaaattaaagacagaaactttacatttcatcgcattagcttcgttgtaaatttcttcccccaacgcaatggaggattccttttcgtttagttgcagtaaagcacaatagaagtggtttccgcaattctgttgataggattatctagggctgtattgggaccaattgggcccgcaagaaacgagaagggaacataactgagacaccacatgtcagcgtcctctcttctcttctcttatttttctcttttctctcctctttcctttcgtctcctcccttcacttcttcagtaggctgggaggcctgcgggtggggcggcggcgggcaaagcaggcaggggacaacgcggtggtgggtggcaggcgaaaggcgaagcagacagggggcggggcgcatcacctgcggccgcgcgacaaccgaggcccgctccagcacggccgctccctctccacggaggccatccttgccgtgcaatccctcaagcgcatcacctcttttgaccgctccccagccgccgccgtgccctcgacttccctcggcgcctcctcaagagcgacctcctcgccgccatggctgagctccagcgtcaaggctgttggtccctcgccctctccccactccacgtcgcccgcatcgagccttggtactaccccaacccagctctctacgccacgttcgtgtcctcctcgccagtcactgaggatggcaccgccgccgccatggacgtgctcgtggaggcgttcctagaggaggagcgaggcggcgggttcgtggagggggaggaggacgtgtacaagctgatgcggcttgtgcgcacgctggtggcgaaggagagggcgcgcgcggcgtggagggtgtactagctggcgcgtgtggggactacagacagacttagatgtaaagctgagggacttcagatgaacttattccgaccgggaatgcctgggcccaatcggaccatatactccggcactgggcccaattgggcctgcaagaaacagcccgtcgtcacctgtggtggcttgcttttcttgccattggaagggtggaggaggaggggata

SEQ ID NO: 6348 - DNA, 1501 bp, Oryza sativa
tattgtcttgttgggtttcatttttttataattttagaagtctcaccaaacgatgccactattctcctctacggtccgtctgccgtctactctttattgtcattgtgattctaaaaattgaacataactatcgttggaatttattttttattttctagaagtcccgtcaaccgtcggcggctctgcaactatacttctatacatcccgcccgctacttctcctttttattatcattgagattttaaaaatcgaatatgattatcaatagggtttttttttactttctagaagtctcgacaactgccttgctcgtttgcttcatggcatgcctgtcgtccctcctttatttggtgttttattaacgtttttatatgtcgtatcaatcgccaccactctactcctttataggccggatacttaatttatctcgtcatgtattttagatggtcttttctttcaatagtctttatttttatcacaaattttagttatttataaattgtattcctaattgaattcttatttttctttttctaatttagaatttgtcgatgggtgatacccgtagaccggatatagagagtattggggtacgctggtacaagggtctacgtagtacgacatcaagcaaacagaagacgaagattatactggttcaggccccttgataggtaatagccctaatccagttggtatgagattatatgatggaaatcacaggttacaaagggaaagatggaactcgatgaaaccgacgagatcgtatcgggttaatccgactagacctctcggcaatctggcttccgcaggctccgacttcgtaggctatggtgatgatgttggctatcagattcctcctcttaggtcctcccagggggtcccttttatatcgcaggtcaagcggtttccaagtaaaacttggagacatcggaccctgcatgatgcactgacgacccagtcttgcccgagtaggactctttccatctgttgaactccatgatggattcccttaatgtatgcagagagcgtccgtatacgcgcaggtataccataccgatacgcgacatgtattgaagggtaaagggtataccttacccataaccctgacagtagcccccgacttctgcttaaatggactcgtgtaaccaatcgcgacttctggtgttgaggctgttgtcgttctcggtgtgcgaaccgtagagataggacgcaatcgacaacactatgtgaagcccaacggtcatgagtgaatttaaactgaagtctgaaaaactgccgcgcgtaacggacctagaaattttcggcggtaatctctctctcctttccttgaaattcgcaccgtcggaaatgcgtctgtttaagaggattttgaggatccattttgaagtccgcccgttgtgaaaaaagctctccagcctccaggcgttccttgtctcctccgctcctgcaaagccctagattgttcatctcagccccttctccggcgatctccggcggcga

SEQ ID NO: 6349 - DNA, 1501 bp, Oryza sativa
cctggaggctggagagcttttttcacaacgggcggacttcaaaatggatcctcaaaatcctcttaaacagacgcatttccgacggtgcgaatttcaaggaaaggagagagagattaccgccgaaaatttctaggtccgttacgcgcggcagtttttcagacttcagtttaaattcactcatgaccgttgggcttcacatagtgttgtcgattgcgtcctatctctacggttcgcacaccgagaacgacaacagcctcaacaccagaagtcgcgattggttacacgagtccatttaagcagaagtcgggggctactgtcagggttatgggtaaggtataccctttacccttcaatacatgtcgcgtatcggtatggtatacctgcgcgtatacggacgctctctgcatacattaagggaatccatcatggagttcaacagatggaaagagtcctactcgggcaagactgggtcgtcagtgcatcatgcagggtccgatgtctccaagttttacttggaaaccgcttgacctgcgatataaaagggaccccctgggaggacctaagaggaggaatctgatagccaacatcatcaccatagcctacgaagtcggagcctgcggaagccagattgccgagaggtctagtcggattaacccgatacgatctcgtcggtttcatcgagttccatctttccctttgtaacctgtgatttccatcatataatctcataccaactggattagggctattacctatcaaggggcctgaaccagtataatcttcgtcttctgtttgcttgatgtcgtactacgtagacccttgtaccagcgtaccccaatactctctatatccggtctacgggtatcacccatcgacaaattctaaattagaaaaagaaaaataagaattcaattaggaatacaatttataaataactaaaatttgtgataaaaataaagactattgaaagaaaagaccatctaaaatacatgacgagataaattaagtatccggcctataaaggagtagagtggtggcgattgatacgacatataaaaacgttaataaaacaccaaataaaggagggacgacaggcatgccatgaagcaaacgagcaaggcagttgtcgagacttctagaaagtaaaaaaaaaccctattgataatcatattcgatttttaaaatctcaatgataataaaaaggagaagtagcgggcgggatgtatagaagtatagttgcagagccgccgacggttgacgggacttctagaaaataaaaaataaattccaacgatagttatgttcaatttttagaatcacaatgacaataaagagtagacggcagacggaccgtagaggagaatagtggcatcgtttggtgagacttctaaaattataaaaaaatgaaacccaacaagacaataaactctaaaaactacaaggtccaaatttttaaaggtttggaacttctaaaaaataatgttcgattttaaaatctcaa

SEQ ID NO: 6350 - DNA, 1501 bp, Oryza sativa
ctctctctctctctctcgcacgcgcacgagctcaggaggccgattgcggaggtggtggcggactgagcagctggtggcggcggaggcatcgattccccttcacgcggttgccttcttgcccattccccttcctcctcgccgcgactgctgtgccccctagtggcagagagctcgggtgaaggtgacagcaatggtcgggccctccccactctccccgccacggttttatccgtctaaaccaccgctgtcgctaccgccttctctgtctgaaccaccattgtcgccacctccttctccatccgaaccaccaccaccgccgccttcttcttctccgcctggactgcctccgctgccgccgcactgcaggaaaggggagggagttggaagagaaggagaggggaaagggaggaatggtgtgtcaccgtggtgtccctcatcgctgcaaaagtctgcctccgcacccgccgtagacgtggcgaccaccgtgcgacgcctccgcaatgccctccagccaccgcacgtcctcctcgccgtgcccgccgcgcccccagcggcagagaaaagaaaaaaagagagagaggggtgaggtaggagtatatgacaagtgggcccattgttactttattattttttctaattagattgccacgttggcgtcacgtgtatgccatgtaggatcaaaacaactatggattgtgccaagggggaaatttgtccggttttaatagtttagggtgtcaaatgtgcggttttatagttaggggggtaattcatattgtcgtgatagttcaatggggtaattcgtacttaatgaaattaaaaaaaaacgactctagccatttgtaattttgccttagttatccatatagctaaagacagcttcctccatcggattgtagaatggctgtatatagcttataaactctttatacacttaaaatttaaatttgttcaagaatttagaaattaatttgagatttaatttattttattgaagattgtaaagatatatttcaatctgtcgtcggatggccagtgaaaccgacacagatcagccgaaagaaccgtcgatattgctttagcaattccgttcgattagccatataactttcgatagtgttttgttaaaaaacattcaaatctaactatactataatttactataattttactgtaactactatgtaaaaggagcatgtacctaaatacatacttgatcacgggaacatattttatgcacacaagcttcccgtgtacactccgtgcacaccaactaaaaaatgtcacataaaattctacgaaaaatttgaacatttactcctaattagtggtattacacatatatgcaaagtatcgtattcaaattcattatattttagccgtaataaaaagaagtgaaaaatccgatagttttaagtgtaaaaatctgtcagaattttttcttctagttacggctaaattataatgaatttgaagataagatttcacacgtagatgtaat

SEQ ID NO: 6351 - DNA, 1501 bp, Oryza sativa
cccgtagcaacgagccgtcgtcgtgaccgtcgcagcaccaagccatcgtgggagggggagggggaggagaaggagctcgccacgccccccgtcgcagtcgacccccccgacggctcctctcattgctgtcgccgcaccccccgacgaccgcctcccgtcgccgtcgccaccacgcacagctgccggagccgccgccgccacccgagaaccccgccgtcgccgcctgggaggaggggaggaggagaggagggtgctggaatttggtggaaatatttttattctatggtggtaggtggataagggtatgggcgggcggttatttttggtggtaggtggataagggtatgggcgggcggttattttttttatgtgcggattttttttaagaacgccagcgaaaatcgattttggctggcggttgcttaagtgagcagccaacaaaaataattgtatcttcgctaccgaactatttaacccaaccgccagcgaaaattatccatttttgctggcggcgcatctaagtgaccaccagacaaaatgaacatatcttcgctggcggacggtataacgtggccgccagcgaagatccattttcactggcggtcggtgcccctcaccccctcgttacgatcttgctggcggttttggcatttttccactagcgaaaatcatagaccaacaccataaaaaatcgtttttctagtagaccaacaccagagataatccgtatatttaaggtgaagtgagggagcccaagctatcgcagcattcttcaaaaatgtagtgcaacaaaaaaaaaaggttgtacttatatcccttgctataaaattagtaattataatctttttaacatagaactgcaaacccaacatgcatagatacgctagggttcgctagctaggtgattcaatagctgtacaaggagagggttgtttgtctataaatagagaccgtgagagatgtagttagaccatccaagtacctagcaagcaaaagtcgacaagttttgtaactgacaaaacgctcatcggcaacatgtctgtgagcgaggttaccactgctaccaccggccaagcttttgcaccatccgtgtggggcgacttcttcatcacctacaccccttccgattcacaggcatgaagattaaacacaacatgagtacacatatatacaattatattattactctacttatttccttatatacataatacataggcttataattagtaatttgacaacatattactccctccatctcaaattaaatatcattttaactttttacttgcaatgtttaaccatttgttttatttaaaaaattagtgtaaatataaaaaaatgataaattataagtatttttataataaaacaaatcacaaacaaaataaataataattttataatcttttgaataagctaacatggtcggtggaacgttacaaaccaaaacttaaaacgacgtactacttattaagcaagcagctgagatcatcagagg

SEQ ID NO: 6352 - DNA, 1501 bp, Oryza sativa
cgagacaatcttcagatccgagcctatctcctacacccatatctaaacaatttaccagaacgttccgtgattatcaaagcacgattaatccttaaatgtttcgtgatttctatgttaacaacatgtaatttctgatcccttttcaaactatgatttttatgtcatcaaattgtaatttccaaaccctttcactactagaaaaaaacattgttgcaaacggccgaaaacgatcttttcagatggaagccggtccgcctataggcaaaggcatgtgaaaatcaccgaacaaaataaatgatagttatgaaaaaattcaaataagatgagtggttaaatagggaaaatatgtcgtgatgacgtggacgaatctcatacgactattttttgatttaatggtagtttctaaatttccactaaatatgtagtgtccaaaagttaagggtgttatttattaaaaataaaagtatcttatatcaaaagaaccctgttaaaatcgatgagtctggctcggctcgaaagaacgtgctgtcgatggatatggctcggcgagattggctcggcgacgaagatggtcttagactgcagttggtgattggaccaccaatcgcttgcttgcttgcacgccaacgccaatgcgctggcacctggcatgggtatgcatcttgcgcgcccacgtacgctccatcatctctggattcatttccttctctctttttcttttcctgcttgcttctgtggttggaggaccatatactagtcgattcctcgcaacagataagaccccgtttcgtcgttactgtatttttggatttcctcttccatgcaattccatcgttcttccacgatcccatcgacatggatacataaatccgcgagatgccgagatattcttctgcgccaagcgcgcaggttattccaaccatgtcgctatcttccattcgtctccacgtccagaaacgcaccaatctcatgagccattttctcctccctgagttgaccgttccagttagtttaacaccttaacttccattagctgatagtaatatactagtagtactcactccgtcgcaaaaaaaaaaaaaagacaaaccctaatttccgtgtccaacgtttgactgtccgtcttattaaaaaaattataaaaaaaattaaaaagataagtcacgcataaaatattaatcatgttttatcatctaacaacaatgaaagtactaattataaaaaaattatataagatagacagtgaaacgttggcatgaaaatttagggcttgtctttttttttttttttggacggagggagtacgtagtagtagcttctatcatcaacgacaaatctcccgttgtcttgtcttctcttcgcaccctaagatttccacgtcgtcgatgccttttcgttgttcgcgtcgggttcaccagctaggtggttcgccatgaagtacaggaagggggtcgccggcgagtccaacgatgacgacggctcgacgaaacgaggtcgtgac

SEQ ID NO: 6353 - DNA, 1501 bp, Oryza sativa
gtgagggccttgagctccctgaggtggagagacctgacgagctcaaagtccagtttggctagctccagcgccacgccgtcgaaagctggttcgtgctcgtactcggcgatgtagcgtatcgtctctagctgcttgggcgcccgtggcagagggatgtcgaaggcgcgggagacctgctcggccatcgacgacttcagcttgccttccacggactgaattaggtggtgcctcgcgaacgcgatcgcgtcatccagcgcctcctcgccaggcatggccatgtgagccgcgttgtacaggcttagcaggcccctcgtgtcactgcttaggctcgctctgaaactgcctctattgtctctgaacttgtcgaatacatcttttttatttttttttcatgcgcggatagttcgtatcagtacaagaacccatatgtcctagttaacatatatatattgtgttctggagatacgtatgttggttaaaacatatgttaacccatatgtgaagaagtaaactctttaatattgtacctgcagttaccccaaagccgtgctggcgaagtagacggaatcggagggaagtaatgtggaggccgtcgtcggcggcggcggaagggcagtcctgttcctggcggtgtacgcggcgtaacatcgccgcgatctcgcgacggaagtggctgtctatgccgaggcgttcgagcgtgtcgactagcatcaccatgttggcgacactgctgccgctgctgctcgtggcctccaacagcttgcggcgaacttgctcctttagctgttccgctcgttctctcgtgcagtactgatcatcctctgatgatctcagctgcttgcttaataagtagtacgtcgttttaagttttggtttgtaacgttccaccgaccatgttagcttattcaaaagattataaaattattatttattttgtttgtgatttgttttattataaaaatacttataatttatcatttttttatatttacactaattttttaaataaaacaaatggttaaacattgcaagtaaaaagttaaaatgatatttaatttgagatggagggagtaatatgttgtcaaattactaattataagcctatgtattatgtatataaggaaataagtagagtaataatataattgtatatatgtgtactcatgttgtgtttaatcttcatgcctgtgaatcggaaggggtgtaggtgatgaagaagtcgccccacacggatggtgcaaaagcttggccggtggtagcagtggtaacctcgctcacagacatgttgccgatgagcgttttgtcagttacaaaacttgtcgacttttgcttgctaggtacttggatggtctaactacatctctcacggtctctatttatagacaaacaaccctctccttgtacagctattgaatcacctagctagcgaaccctagcgtatctatgcatgttgggtttgcagttctatgttaaaaagattataattactaattttatagca

SEQ ID NO: 6354 - DNA, 442 bp, Oryza sativa
cgcgtcgagggctacaaatttgatataaagtttgtcttcattagaattcacatgaaaaagttatgaattatttttaaatataaagtctttataccatcctatttgactcaaatgatattcaaatccaagtttagggacggattaacacagtcgaacaaatttgaagatctgaacggtcgatttgcgagttttagaatcgggatgacacagcggtacaccggtgatggactttactctatacttttttccttgatatataattggttgggtatgtgtgcggtggtggtgggtagtgggtacctataaatagagaccaggaggtagttcaattatccatacatcaggtcgatccgcaactcctgtaactaacacagaacgtgcagcggtgcagcatgtctgggagcaaggtaataagtgttctcgatacggagatgctcgctgt

SEQ ID NO: 6355 - DNA, 1501 bp, Oryza sativa
ttcctggagaactgtaacacgtacgccataaagggcgtcagtccagacaccgtcaggctaaggctgttcccggtttccctcctcaggagagcgaagcagtggttctacgctaaccgtgctgctgtcaacacctgggacaagtgttctacggtattcctctcgaagttcttcccgatgggcaaaaccaagagttcttccagcagacaagggacgaggccattcctgaagcatgggaacgacttcaagagtatgtggccgcctgtcctcatcatgggattgacaactggctaatcatgcagaacttctacaatggactcccatgtcccgcgatcacctggacgtggcagctggaggagctatcttctctaaattggttcgaggagccgctgatttaatagagaagatggtctccaatatgggttggagcgaggaacgactccagacccgtcagcgaggcatgcacaccgtcaaggagacggaattacttgctgccaagctggaccttctcatgaagcgattggacgaccacgacaaacggcctcaaggcaccatcaaggccttggactcacacgttacgtgtgaggtctgcggcaacatgggtcattctgggaatgattgcccagaaacctatgaggaggcgatgtacatgggcaacaacaacaacggttaccatccacaaggcggtcaagggtggaactagccacgcccgtattatctaggaggtaataacaacggtaacttttctaaccaatcctccttgaaggatctagtttttgcgcaagctaaaactaccgatgctctaagtaaaaagctcactgccaatgacaagatctgtcacaccctaaaaatcccaaatttataaattcttgtttaagtggaatttttagaaatgatttaaaagcctagaagaaaagatctaattttaagtaataaattccaatataaaagtgggctagataaaattttattaaatacttctcttgattctatagttcctagatttttctgggatttatttgagccaagaaagtatttttaataaatggaattgcatttcatgaataatttaaaaggaaaaaggttttaaaatccttcttttgaatttgggtcgaaagtcagcccaagtctctcattcttcccggcctgtgcgcgctggcctagtccgccctctctccctcctctctcccgctgacaggtggggggggggggtcgtctgcctcctcccgccgccaggcgcgccctagccgcgcgcaagccgccaccgccccttccaaattcggttgcatctttcccgatccgatcaaattgataggggggaaatgatcccttcgatctcctctatcttttctcctatagaaactttatctaattttgcttggaaatcatcggattcgagctcgattcggatttgatttctctcctctaaccctaaaccttccatcgccgacgccgaacgtcttgggcctagccgctgccccctagcccctataaaatgaccccc

SEQ ID NO: 6356 - DNA, 649 bp, Oryza sativa
caggggagtggggctgtgggggcaggtagtggggctccagttctccaccagcacaagggtccaaggcacgctgagtcagacccacttgggcggggcggggcgcggcgcggcggttttggttgctgcccgacacgcgaatccacgaatgcatcccatccatccccaccagcacacggaaaagcagggttgaggtaggggtaggacagaagcggcaaccacgcgacgtgcggacgcggcgcggcgcggcacgcccacccaaaaattccccgagccgtgccgtccaacaccactcatccgatccgacagcccgcgggagcccgaccggccgcggagacacagaaccggccccgcgcacacccccaggccccaggaccttggaacttcctcctcattcactccccgtcgcaccatgctctccgttaaccatagtccctctaaccacggttagttgctctccgagtcactctccaccgatcccagggttcttctacctctgcctgtctatatagctccctccccggcttctcatccgccgttccctccccctcgctctccctgctccggtatagctagttgagctctgatcgatcaggttgcatgagacggagaagctgagtgaggctagggtggttggttgtgatcatcacca

SEQ ID NO: 6357 - DNA, 348 bp, Oryza sativa
ctcgtctaatggattagacttttctggctcatgcttttccattgctgtgtctttgcatcactttgagcttgatggaaaggcgatacaaaggataaatcatggcaaagaatacacacaagggtattcagtgttatgaaacatatcttattatggacgaattaaattataagtgggaagcttactgtagaagaaagcttacaccagaagtcagcttacagaggaaggcagcttatggcgcaagccagcttacagaggaagcaagcttataagagaagccagcttacgacgcaagccagaaggtccaaggcatacgacgtaagcctccaccctcctccgcctataaatagg

SEQ ID NO: 6358 - DNA, 482 bp, Oryza sativa
gctatggttccgtcgacgaggcgaacgcaggtatgagatagaggtatatcaaacaatcagagaatgtgtgtagatgcaattttgtgtttaaaaagtactttctccccatacaacagtgccataggacatgtcgcagcaacgcgaaccgatgtcgacgaccactactgagactacatcgagccggactcctaggacccagaataaggttcctaaggaagtttacaccataacagaggtggacgatgttggatatccgacggctccgacgaaagctgtcaaaaagttccctacgatatgcagagccctagggaggcgaatcttcactattctataggaccacatcgatctggtccctcaagaagaaaaagaagaggcttggaggcagttcaaggaaagcttccgataccctacagaggccgaggcaggactcaagcggcaggctatccgcaagatggggaattgttgaaaaaatttcaagacaa

SEQ ID NO: 6359 - DNA, 1501 bp, Oryza sativa
cgaatattcgcagtggtagaagatgactactactaccagtagttgatctcgaatggcaacttttgtgcagaacttattccacggctatgtcagcttccactgtgactaaaaaaactacggccatcttttggacttgttctatcttggaactgaacaaaaaggacgatcctgatgtacacacggcatagtttccagcactggatgccaagttgccaactgttaccacgataatggaagcacgagatgagatattatacaagtccaatggatcaagatcctgtgcagttgttattgtaactgtaacttaagccgttaacatgtacatcacatttcctactctatcaatgtcttgtgcgggttgtttcaaaaaaacatgtacatcacatgatctagaacggaaggccaggatatgaagtggtactgcagcaaaacctgtagcagagatgtactattatgcatgtactgtagcagtcatctagagccgttggatctgaaaacgaatggacatgattgtgtgcagttgctattgtgcagttacaatagcaactgcatttgatcttaatccaagtccaatacatgcagaacagtagctacgagctggaaaggatgcaaatctgggtgacactgacagcaaccgtggaagaacaacagcagcaaagtcccagagggatggcaatttgaaggaatttaaatactctaatattactccacccgttaaaaaaaacaacttgctacgcataatatatgttcggatttatagcgagaagttaatttttcatgagaagaagaatatatatgtaatatgtactaggagagtactcgcttcataaatataaatattcataagttgtccagtgaagatagctttagaaaaaactagttattttatttgtcaaattttaaattttgaagtagttagattatctttctagtagttctgattggttgaaaatgtttagattttcatgtgttaagagttccgtatcctaaaaatagtaatataattttaaatcatatatatatatatatatatatatatatatatatatatatatatatatatatatatatatatatatatatatattgttgaacggtttgtgctctggttgctatcctgttctgtggaatgaaaccaacccgtttggaaggacctgtttgttgtttgcaacttgcattgctctcattctcctctccgatgaagacctgccaccggtctgaaccatctgatgtcatggccaattaaacacacaaaaacaaatgctgagctaacagattaggattctgataccaccttaatcagacgaaaaggacgtagctttgcaattctgcaccgtttaatttaacccacaaccaaactgttctcaagttcatcgctcaaaataaaatgaaagaaaaaagataaagaaaagaaaagcagaagaaaacaagaggaagatagtaggtggtctccatcagtttgacttgggagcaaccgcttccactgcacgtcgctcgcata

SEQ ID NO: 6360 - DNA, 310 bp, Oryza sativa
ttgattgacattactcggagagatacagctcgcaggcacacgagattcttctgcctttccaattgccacgaacccacatgtcacacgaccaaccaaaaagagagaatttttctttgcacaaacaaaaagtgagatttttttttcgccacaaaggtgcgaactttcttctctctcccactttccaatcaagaaacgaagcactcaaaccaagaacaaaccaaggaaggagagatcgctccctctcccagagcaaacgaaaggagagaactcagatggatgcgaactactaccttgcctctttccccggaga

SEQ ID NO: 6361 - DNA, 373 bp, Oryza sativa
atgctctttgtccaagatatattccaagttgtgtacgtttgaatatatagcagcttggtatatatataatcgctctcactatctcagatgtcatcagttttgatcctgtgtcatgactcatgagcatgcatctcttgtatgtaaaagtaaaagactcgttgacatacacccctattaattactacaagctaaacatgttgacataaaacgaatcatcacgtttcacgcttggcatcaaaacttgcaccaaagaatcaattggctatcgatccataaagcatacatcacgtgaaagaaaatatgatatgatatagccctttctagagtatctatgtgcacaactgttctatatttaattttgttcttttgcagg

SEQ ID NO: 6362 - DNA, 1501 bp, Oryza sativa
taaaattatattactatttttaggatacggaactcttaacacatgaaaatctaaacattttcaaccaatcagaactactagaaagataatctaactacttcaaaatttaaaatttgacaaataaaataactagttttttctaaagctatcttcactggacaacttatgaatatttatatttatgaagcgagtactctcctagtacatattacatatatattcttcttctcatgaaaaattaacttctcgctataaatccgaacatatattatgcgtagcaagttgttttttttaacgggtggagtaatattagagtatttaaattccttcaaattgccatccctctgggactttgctgctgttgttcttccacggttgctgtcagtgtcacccagatttgcatcctttccagctcgtagctactgttctgcatgtattggacttggattaagatcaaatgcagttgctattgtaactgcacaatagcaactgcacacaatcatgtccattcgttttcagatccaacggctctagatgactgctacagtacatgcataatagtacatctctgctacaggttttgctgcagtaccacttcatatcctggccttccgttctagatcatgtgatgtacatgtttttttgaaacaacccgcacaagacattgatagagtaggaaatgtgatgtacatgttaacggcttaagttacagttacaataacaactgcacaggatcttgatccattggacttgtataatatctcatctcgtgcttccattatcgtggtaacagttggcaacttggcatccagtgctggaaactatgccgtgtgtacatcaggatcgtcctttttgttcagttccaagatagaacaagtccaaaagatggccgtagtttttttagtcacagtggaagctgacatagccgtggaataagttctgcacaaaagttgccattcgagatcaactactggtagtagtagtcatcttctaccactgcgaatattcgaagggacacaaaaagatcaacgagtaaattagttcaccggaagacgacacattatcaccacaaaaagactaaaaacaaaaagaaattgccaggccaaaaaaggcaaaaaagaaaaaaaaagatggcacgaggcccagggctacggcccatcttgtcgccggcccaaccgcgcgcgcgaaacgctctcgtcggctctcggctcgccgcgacgcgatggagagttcgcgccgcggcgcgcgcgcgcgttcggtggctcacacgcttgcgccctcgtcctcccggccggcgcgggcgccgaccgcgcgtccgccgcatgcgcgcggcgtaggtgagcaacgcgggcctcgccgcgcgcgctcccctccttcgatcccctcctataaatcgagctcgcgtcgcgtatcgccaccaccaccacgacacacacgcacgcaccgtgcaggcatcgacgacgagcgagagcccctcggcggcagaagacactcacggcga

SEQ ID NO: 6363 - DNA, 1501 bp, Oryza sativa
tggagcatccacaccgtctctctagttcttttttaggatcactctaacccatttttattttagactttagccttagaaaaaaaagtgaagttggagtccaatcaaacacaaccttatccttatcaaacttaattcgtgtcttcggaaaaagtgaagcccaaggttaagcccaatcaaatagatccttgttcttatcaaacattattcgttgatccatttgtatcttacattacattactcttcttaaacttgattggattataaggcctatataactttgatacgctgcctcctccacacacgaggcatctattaagcccacctccattattgtggccaccgccatctccgaactccacatgcgacactcggtgagattaggcttcatgtcgtggaaggacctgccacgtgaccagtggtggaagcacttgagaaagacggtgtgaccgtggaagcaaagcttgacggcttttgggtaccacacaatggagttgtttaggaggaccatatgaattcatcgtgtagatcatcaacctcgcccgtggagagagggtggagaggagagaagggagtggtagagaaggaagaataaaattagtcaccaacatgtagacccaatgtatatatttttttttattttttttcaatgactaggctaccacgtcaaaaaaaccaccctcaaaaacgatacccggttttacggttgagggatgcgatttgaccgagggcaagagcacaagggaggtgaaatagacatactccaagtgtaagattgcgcaagtatgtgaaggccatagcgggcctggatatggcacaaaaggtcaagcccaattactagcaaaagtgagtttgtactctcctgtttccttcacttatattccagttttcagttttaacgcatgccacatttatcctcatggctgtcatcagtgaaccatgggtgcatgtacacgcatgggttagcttgagtgctccacttctgatgaagtgtgaatttggtcagaatcgtcaaaaatgcatgtgtgactgcaaaccttcaccttacgcagtattgttagcgaattccacaggcactgtacgtacttttcctgctactgctgagtgctgatcagctaacagttgtatccaatgtaacttccatttttacgcttgcatagttactgtgaaatactagcatgaatgtatgtcaggttgccagatcagcggataacagagtacgggaaggcatggcaggagagactgcagtgtacagtaagcagtactccgtactggtctccggcgagtgaggcaggagtaggcaaggtttactaccaaaatgaataccttcacccaactcctctgaattctgctcatcatttcccccatttaatattgctaccaactaacatacagacagacagcagaaacaagaaagccgaattccatcctccaatcatccccgtctgcaaataggattaagcttgatcaggcaatgtacccttccagcattcaggccagcagt

SEQ ID NO: 6364 - DNA, 1501 bp, Oryza sativa
gagagctggtgttgagagcctgcacgacgttggtcgatctccttcagctccggggaatcatcgcggatcaccggaagaggaaccggcgccctcggcaccatcgacagcaggtggtgcacccgttccatcggcatcctcttcttcttcacagcctcctccttcttcatcttcttggcggccttctcctccgatggcgtcgcctccttggagcacctcttcagctcatttgtcatcgccacacatcgatcttcttctcttccctttaattcctcctcctccgacggcgtcgccttgttgggtattggaatcgattttgtgaattggtggacacgagctgagctagcgatgctggtctgcatttatatatgcatcactatacctgggggaggcaaaacaagtaggattcgagtccaattggccggatcgatcggcgttcggtctcttaatcggatcggacgagttggctagacgacgccgatgcacggatcggaggagggcgtcgtgcgggagtcaatcggatgacgtaaatataatccgcaaattaaacctagtacgtatttttggtcgtcgtcgtcgtaataaaatctgtttacagatatatacagatgctactaatcagtaataaaatatgcttccacaccaccgaagaagcaaatcatcgtaatgtcatgctcatctacattatattactaatacagttaggagagatcgatggtgatacttgaattgaggtagctaggtatggagggcctagctagctaggctgttgaggccggcatgtcggcgacggatttggtgacccagcgctcgacgtagcccttggtccggagctcctcgcgggccctggcctgcgcccggaggatgacttggttgttggagttgaggagcagcacggtgtgggcgaggagatcctccatctcgttgacgtcgggatcgtcgcaccgtggtctgtcgcgaggaggaaacggcctcggcacgaacgacagcagccgctccacctcttccctcgtcagcctctccttcaccttcaccttcatcttcttggccgccgccctccgcgttggagcacctcttcagccctagcctcgccccctcctgtatcatcagatcactaaattcgccagccatatcgctcgctcgacgcctcgatctcaatctcaatttgatttggggatcgatgcagaggggtggttctagctagggatcaccggcggctaaggcttctctctctattttatctcgtgagtacgcgttccgacttccgaatcagaaacatattagaacacacgttcataattatgttgggccgcacaagggccgggcaagataacattggtagcacatatcaattacggagtagtattagaccatgtttctttcagcttggattattataatctagattattgagtcagattactataagctagattgttataatctgcagtagaataaacggttagttgtttctttcctagattattagagcctagattattgg

SEQ ID NO: 6365 - DNA, 1150 bp, Oryza sativa
ggcgaattcgagctcggtaccccgctagctagctaggaaattaatcaatccttttgcttaattacctgcatggttggatacgtgacatagcactttacactacacacagagatcttcatctgcaagcatgcatgctaatatacatgtatatggaagtggatttttttcctctcgaggggatatccccttaaatttaagttacatgtaaaaataaggggatatctttttcaagggagataatttgagttttctaatatatagtagtccatgcagtacatattaattaacttaccgagattatttatatggtaggaaataaataatcgtccccactggcatgtggccctgatattaggcacaaagtaggaggtgtatcacgagagaaataggggcgatgattaattcagtgttcaagtgggggccgtacgtggcgattaatttgatccgaccaaaataaaaaaaaagttaatagagattaaggccctgtttctttcagcttgggattattataatccagattattgggagtaagctggaagaaacagacaacttattgaattaagttattataatctggagcccagcttattataatctgataagctcatttaggtgaggtttttccagattattgagtgaaaaattatccaccatgccaccccactctctttttagacttgcaaacccaataatctaggctctaataatctaggaaagaaacaactaaccgtttattctactgcagattataacaatctagcttatagtaatctgactcaataatctagattataataatccaagctgaaagaaacatggtctaatactactccgtaattgatatgtgctaccaatgttatcttgcccggcccttgtgcggcccaacataattatgaacgtgtgttctaatatgtttctgattcggaagtcggaacgcgtactcacgagataaaatagagagagaagccttagccgccggtgatccctagctagaaccacccctctgcatcgatccccaaatcaaattgagattgagatcgaggcgtcgagcgagcgatatggctggcgaatttagtgatctgatgatacaggagggggcgaggctagggctgaagaggtgctccaacgcggagggcggcggccaagaaga

SEQ ID NO: 6366 - DNA, 1501 bp, Oryza sativa
cgacgaggccctcgccgtccgcaagctcgaggtgcgtacatcccacatgccccccctccccgccttccccacctcccatctctccccttgtaatcccgtgcggtaaatcgcgtgcgcgctcgtggagggggtgcggatttgggcgagtcgggatgggggcgtggtcgcgtggagctagctaggtttgtgattcctcctcctcctccgggcgggggttcatgcggcgcggcgcgatgtggggggttgaggtggaggtgtggtgtgcgcccgatttgttttacttgccgtgaactcgtgatgaatctgtgaaggcgcttttacggaattgaattcgcttggaacaaatctcgtggcgttagctctgtctgattgcgagcttatcgcgctctgattttggtgggagcgcgggttttggtcacggaatctcggattgatttggcattgataccatatccctgttagatttgtagttccagtttcatatgacttcctcacgcgcattcaagttggggcttgtagagtttgtatgaaattcttgtgattgctcatctagagtgttcaataactcaacttaggtagttaggttttcgcaagctgtcaattcatggtttgtccatagtccctaccatccggtgtgctggattactggatctgatatttggttgtttgattttaacttgaacacaaaaaacacagctgggtatagtgctatctagagtaccttcgaatggccatacgcccctcacctcaatctagccatccctgtccctgtctcttctgctttgcttatcttctatctagtgtgatctgtcctgggcttagtcgcgtgtgggaggaaaggaaaaaaaaaaggtaagtgagcttagtgcaaattcctcagacatgctctgttgtattattccctccgttcccaattgatcatcatattacatgagagcaccaagaccaaggaaagccaataactctcctggagtaaatactggactatatttactccggtaacaaactcaatgcatgcaccatccccgctacttcctagataataacaaaacaagacattgcatgttggttgtagagggttgtgtgcatggatgtatgcggatatttactcccatgcacaaataacaaatagactttggtaatgaatactaatatgatgatcatttgggaatataccatgattaattagtaagtgagggagtacctctgaaatgattgttaactgcaatgatatttttcctttgggtttatctatattcatctatttataatggcttacctcatcactgtaactcaggaacatggtggcgaccttaacacggcaatcaatgcacatttcaatgaaggagacagtacagtgtacacctttactattttccatccaactttatttacatataagattgctttccatatgcccacactgtactgctagaactgatgaatgagatgctggtgttctacaggaacagagccagtcaaaacaatatacctgagagtc

SEQ ID NO: 6367 - DNA, 923 bp, Oryza sativa
tctttggaaatttgttgacgaatcaatgcttctagttagtagaagcgggttacatacttctctcacgtatgacgaccgggtggaatttattagaaaaaaaattgacagtttcaacttaggttagcaacttttggtgcaacttccttgtcgatcgtacttttgtgatgacgtatactgccgattcttggatgtctcaaacaacttcaacacgagccatttatttttatgcaggaggcacgagccattcttttagttagattcagtactttgagcagagtcggcgagagctctcccagagaaaaagaaagtgctctttctgccgctccaatggcttcggttaccggtaactggaggtggagtatatatcgtctcgtagtagggtttatccaattcttctttagagtgtgtttattttacgctaaaattgaagtttaattgaaattgaaacgatgtgacgaaaatgttggaagtttatgtgtgtcaaaaagtttttatgtgatgaaaaagttaaaagttctaaaaaaaagttagaaactaatccatgccttagttatttgccggttcctgcgtggtgcaagagattgtcggcatcgtgttgtcatgtcccatcatcaagccatggattcctgctatttactttcgtggcttttgggctacagattgctcagattataggtatcccatacccacataacatggttatccgactagttacaggggataacttatatctatggaatatgtaatagatcatgacttgggtaatacgtttccttatatattatggaatggcctttagtcctggtttgataatattgtaaagtagatttaggaaactgataccgtattggttaaggtttctatcttgtaatcctgcccccatcctatataaggtgggcaggatgctctctagggggcagatg

SEQ ID NO: 6368 - DNA, 359 bp, Oryza sativa
taaggcgcgccttttggagcagctggcgaaggctgaggcggcggagcttcgcgaagaagagtacgtggaggccgaagggggtggaggtgatgcccaggatcacccagaggtgtgaggccctccgccctttctttagattttcatagtttttttttggggttcgccaggggtggcgaaccgttgtatattcggcaggctgccgctaacctttttattgtaaccgagactaagttgtcgttgggcatttaaaatatgtataacagacctacctttcgccctttactgttggtccttgttatgctttcgcctacttctcactattcgattggttttttgccatttctgcattatctgccagg

SEQ ID NO: 6369 - DNA, 1501 bp, Oryza sativa; identical to SEQ ID NO: 5778

SEQ ID NO: 6370 - DNA, 1501 bp, Oryza sativa
ttttcgaccgcggtctccgtctcttcttcctccccctctcccttttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctggaagaggcgaaggatctccggcaatagcacgttgcacggaaaccgtagccctgcctcaaaaaagacggcgaaaaccaccgtccgattgtccacaggcttcggcaccacagctttccccggggcgaaagcctgccccgcaatcaacgccccagagctgactagtttcgccagctcgtcgtcatccacaagggaggcccccaaaaaggtggtgttatcgtcgtcgacccggccagggtccggtccgaccgcctgaacggggtttggtttgcgaggggccatggcgaaaggcgtgtgggccgtggcgaaccaatagggtaggcgaaacacctacggattcaagaaacgctgtggaaggagataacgaaggaggagagcgcacgcagtaaaagtggcaaagtgtgacggtgaaagggaaaggggtgagaatatatagcccaccgagtcgacgtttcgcataccctccaatcacaaagagccacgtggcgcgagggtaggcgtaacggtaaaatcccatcatccgaccagca

SEQ ID NO: 6371 - DNA, 1501 bp, Oryza sativa
  unsure (1)..(1501): unsure at all n locations
tcttaatctttcacgaacacgcagaataattacaagtcaatatattagaaaaaatagaggttttgttatacaacgtaatcagtaagacagacctatgcctagagggaaaaagaaaacacaaaatagaaaagaaaggaaaactactgttgaaaacactgatatatgaccgataaattatagaaaaataaagtaggatataaaataattgataggtaaaatttttatatatacttatttttgtctgtttaaaattttagataacaacgtaaatgatgaaagacatacttcagtattaaaaccagtaaagatttgattgatgaattacaatctcaccagtgtgatgaaatctgagcattgtagaaagcaggaagggggaagcagaaacaaccggaagcccacagccacagttcactacaagttcagttaccagtcgcagttggcaatttcagataagcacagaaactctcgacatgtctcatgcgaaaagtctatacgtactaactttttcttattaaatttttactaacactgacatgtcatgctatgagtgcatctagattttttataacttctatctacttgaattaaacggttgagatgattgttaatataaatttagtaagaaaaatttagtatgtgtagcggtgctctttctcgtgagatggacctgaccgttcgcccgtctcggttcatgtcaaaatttaacaagatcagcatatgaccatggcggctgcagccagcgaacgagagctcagctcagagctcaagagaggggaaaaaaatgcttcgcgataaatacgatatttttttttgagatttttttctttttgagaattcgataaatacgatacgaccaataaaaggcaagcgagcgacagcgacgactcgcgccaccccgccttgaaaaaagctcgagtctttggcctttccccatgggcgaaaaatccagcctttttttgagtctttttttcaccatcggtgatcacacacacggcacccttcttcccggcttttctgctgctgcccatcgtcttctcccccctcccctcgaaaccaaccaaccttcaacctaaccccgcaagcaaacgccctgaccgactaaccctcgccaccgagcaaactcgagacccaaagccacgcaactttctttgtgttctttgatttgttcttggcaatcgcatcagagatctattgattgattttgaagcagaggaggagcagagaggtagacgaagagctgcaagattctttgcctgttcaatcgaccgtgctttgtgagagcatacgacggcggcggcggcgagggcgcggcgtctcacctgccccgacggcacggcgaccgaggaggggaggccggcgacnagatgggctccttgccgctgaggagtggtagcagcctgcctccaccgtccttctccaagtcgccggcctcgctgctgctgctgtccaagtcgctcaccctctactgctgagagagctcgagctcgagctcgagagctca

SEQ ID NO: 6372 - DNA, 886 bp, Oryza sativa
ttgcggaagtttttcgctcgaaaatcatattttcctggcggccaggcatcggatttgtgattttttattttgtgatcaaaatcattttccctaacaatcagcgtaacctaactgtggtgaagttccgcctgtaaagatggttcattttcattggcctttagttgctagcggtagcgccggccgtcatagagaacgcaaagtagccgtcaggaaaaacactttgtttttaagtagtgtcggttttcttcgatgttgcatgcagtggttactttagtgttgcaattagtatttttaatgttgcatctgtttgaaatatttttagtaagtaataaattattttttactaaatgataaaactccgttcgacgtttttcttcaaatcaagcgtacaactaaataacctgcatacttttaaattacggcattataatctgatatggttgattttaacatcaaattaatcaaacgtacgcactacaatgacaaatccgacaaactcatgcagtattttatatgcgtagtatatatagacagatacatacatttcactaatcaacatcctgcctacctttactgaaagcaacgcacactgctccagagcaccaaaggttagctagctgaatcatagatggtccatgatctaaacaaagatctaaatactagccgtgttgactaattacatgtactgattacacatttatacccgtaataatgcatcatgcatgttaagccatgcaaaagctgatggttacgtgtacgcgatcgataattattgatttaagccttaacgagcaccacctgcagtgaccctgaaaacatccaactcacctacatactatacacactgtcagcacagctacctgcatccaccgaccgtctgcactga

SEQ ID NO: 6373 - DNA, 207 bp, Oryza sativa
ttaaggcccgatagagatttctttgtatgctcgtcacggttgattgtttaaggcccgttacagatttttgttgcgcagtataaataccccccaccacctagtgtaactgtatcccactgttcactattttggtgggaggctgtaggggccgattttttgtcctttttccaaggaaaacagaaattaaattcccaaaagtgatcaaaa

SEQ ID NO: 6374 - DNA, 1152 bp, Oryza sativa
attcataatatattcttttcttcttgatacgtaggtcaaattaattaggactccaaagtttacgtgatggtatatatatacacacacctatcagagttgtcaaatagtattgtcacaatttccggctagctctgctaatccaatgggtcaaaaatgaactttgcaacacaacagtagaaagaagcatcgctttttctgaacgctttccctttccttgcccctgctactgttgtttttttaaaaaaggtaaaaaattttaaaaagcggcaacagaccgcgtcgctaagctggaaattacctctgaaaatcaccggcgtttccacacactgtgcaaggttccttgccccaaatcaaagcgtccataaagttgagaagaaagaaaagaaaaaaaaacaaggcttagctagctagctacttaaacaaagcccacaccacaactcaaagaatcgattcccccattgatcaatcaatcaatcgatgagctagctctctttatttaccacccacaaacatcttttaatcccctttgatcaacacatgatcgatcaccatctgtccctttttttctctgaatttgaatcgatcccttctctgttaatttctccttgccatacatggcttctgcctcttcttgctcagcttaaagttcagaaccctagaaagttgttattggcttagctatagctgcttgctctcccaccaagtctacactactgtcacacactgacattgtccgtcctccatgtacatggatgcacagcaaaaagccctagcttaattagctacgtataccttccttgtcgccgggttcaccgcggcgaggcgacgtcgacgccgacaccggcgtcgccgctttgcttgccggcgaggccacctcccggatgcccctccatggccgtgcagtgaccacgcatatgcctgctcatcactttctccttgtagagttctaggtataaatgtctcgcgccattgttaccgtctagtgaaatctcgatcttggaacatttaggtgagattattgatgccgagttatctgcgaattttcatggagttttccggtgttttaattcgatggtgtggtttggttgcaggtacaaggttgaagacgacggccggcaacgacggcgacgatgacgatgaccggagggcacc

SEQ ID NO: 6375 - DNA, 1501 bp, Oryza sativa
agctagacaataaactagtaggtttgtaggaagacgaggcactggaaatgcatacctgccaccacaagattcctagagcaagtttaatagtatagccaactactagctccaatttatctatagttaatctaatagattgtaaacactctatgtgtgcttttttgggaattgctaaaaaatgttccctttttttttttataagtgaccgtcggattgcctcatgattcatgcgagagggaaaatagtttttacacagctcgcaagcgaggcagggtcaaactcctgacctatgttgtgctagccggggtcgcatgcagattacacttcaattatactataattatttttaaaagcttttcacccaaaactgttgtatgttgaataggtattattttgttttttctatacagaaagagaacattgcttctcttgagaagtactccatctgtttcaggttataagacgttttgacttaggtcaaagtcaaaccactttaagtttgactaagtttataaacaaatataagaatatttataataccaaattagtttcattaaatcaataataattgaatatattttcataataaatttatcttgggttgaaaatatatttttttataaacttagtcaaacttgaccaaagtcaaagcgtcttataagctgaaacggaggtagtacacattatgctacgggacaccaactacgtagttcccaaaccttgtgcagaaatagtacccaaaacacaactcacgcaacacaccatacatccatgcataattcttagtgagtaatctaccaactagggatgtacatacaaccagtaatccctacataattcttaagggttcttcgcaaaccaacgtgcggcagggaaggacggcatggtgggtttacctgtacaaatgaacgtctagatttcccatatactactgtaccttatggccataagaccctgcatggtgggtctttacaaactagtatggtgtatcgtaaaagaactctatccctataaatagagatgcgatgcagtatcttaaaaaggtcttggccatatatataacggtagtagaaagacatggagggtattttagtactaatcggtgtaggaaatggaggcaccaggaactcaagtctaagaaacaaacaggacaagcactcgagagcctgatgccttcgagtataaaaccaaaaaattggagcatgatcatagcaaatccggtgaggattctgaatatagcaattcaaatcttgcccccgaaaatactcatcaagccggatttctcaaaatccttactagaaccgcggctattagagaagccggatctagaaaagaagagagaaaaagaagagagaaggaattcccgaaactagaggaggaagagaaaatgaattcccgaaactagaagagaggtgaggaagagagagcaaaactcatcatcgcaaagttcaaattgcaagcggaatttaaattgcggaatttaaatggacaaggcaaaaat

SEQ ID NO: 6376 - DNA, 1501 bp, Oryza sativa
ttttccaacatcaatttgttcatttctaattctatggaccacattcagataatcagcttaattgttcctttctaattccatccccccccctcttttttgtaaagcaatgagtatgtttaactttttgcacccttttccaacatcaatttgttcctttctaattccatggaccacattcggacaatataccattaagaaaaatcaagctctaaatcagtcgcagtagagctacgtactaaatgcaaaatagagactaatggtatattgtcataatgtgtaaatgcagaagaaggaaccctgaaggatatgacatgccatctgatttggatcaagctctcctcctctactttgatggccaggaacaagataagccatctactcaagaagaaccccacaaaccacttaattttgtaaaaggtcgatctactgttaagagtattttgtcatagtatattacaaacatggcttgaagaaaatcacaaagaatgtcatgcatacattgatttctgtgatttgacttgctttagcttatagctagatgtgtaagattaggaatggctaccaatcttctcattccctttcttttccttttggtcattatagtcatacatgattttattagctaattggagaagagtgacacgtaacaaacatagctgatatggtcgcaggatcttgctagaagattgcaaccaaaaagaacatattttttgccccacttttttgaagatcttggccacacgcatttgaaaaattagcacagatatatatctgggagacacatcagttgcatgtgtgcatgaaagcatgcaagcacctgcctacaaactatgtaaattactaagtcataatgcataattactgaacttgttcatgtgtgcatgcagagactctcaacatcttcccctcccagccaatggatggagagccaactccaacaccaaaggtatatatgttaatatgtgcacatatgtatctctagctagctatcacaatttaagcgtgttgttcacaaggtgccagttctcctcttaaggcttcgatgtcagcgccgcccatcgccggcttttccaggagatcgccggcgccagcggcggcagatggcaggccactcaccctaggcaagacctccaaggcagcattcaaggttttaacttttttacacacgtacgcctctgtagttgtccggaatttttctcggttagacagttgtatcatttttttaccccatcatatgggtggcgttctagtctttggatagatggcttttgatcaatcttgtgttcccttttagttgtgtatgttgggtgttttggctgtgtgcactttcgtggtacagaggctatgagtatactcagacttttgagttcaataaaccttccattatctaattaaaaaaggatagttgtatcacattggtataactgggtgagttaaataaagtttccattatcttagatgttactataattttgtatccatatggcaactagaaagaagg

SEQ ID NO: 6377 - DNA, 1313 bp, Oryza sativa
cccattgaacacaccaaattttgaaaatttagaacaaagaagacaagcctatgaaaactacatcaattgagccatacttttgagaaatttttggcttttggctccaccactgtgcactgccacgaatgcactttgcccatggagagatgatatacagccggtggattatcttgtaggccatgagctacttcattcgttcgtattagaatataagaagttttagagttggacacggttatttagaaagtaggtagaagtaaatggtggagggttgtgattggatgagtagtggagataggtggaaaaagtgaatggtggagggttgtgattggttggaaagagaatgttagtaaatactatattttgaaacgaagggagtagcacatttacctatctacatccggcgataagtaacacacacatgtctatctacgttatgaatgacccccaaaaaaaatatctttattcccttcatataaagtatgcaagaaaagaggaaaaacaacatagacaataagacaaaggaagatgtaaacgatcgagagggcaaactgattacaagcatgtaatctcgggttgggtatgaataggagacatcaggaatactgacgaggtgttcttccttcatcgtgtatggaacaactgcaacaggagtaccgagataagttgacatggaggcatgccagagcaaagctgttttggtgtgaacctgacgtaatgttctccatggaagttcatgatcgtgcttgtctctcagcaacacagatcatgctgctaataacagaagaaccattgtaaaaggtaggcccatcggtagctatctcatccaggattatacgaaatactagaaaatcgttgcgccggttggcgcacccattttttatagcccgtaatattatttaatgggatttaaattttaggtttaaatgctgataaaaaaaagcatcattagatctattggtttgtagcagaaatatactatgtttatttaaggtccctagtaatatataggacttttacatgaataatttagttctactgaatattttttataaaaatcacacatttcacaaatctcttcattgaggtttaacttctatatttgtaaaaaggtgcggaaagcatagtaacaaggaatgtgacaaactagttgtacctactatggacggcttacctttcattcatgataaatagaacatgcatcacatccctttcagtagtctctctctctctctctatatatatatatatatatatatatatatatatatatatatatatatatatatatatatatatatatatatatagga

SEQ ID NO: 6378 - DNA, 1501 bp, Oryza sativa
aatgaccattggtttgttgagttatgtgtcaatctgcatgagttgtgcaataatgggtgttcttcatgtggatttactcagcagatagtccccaaactaggaattatctatccttagaacccgacaattgtctatctattttgagcagacgatttgatgtgttcaccgcaatgctagtaggatgtgtgcattatctgaccgatgacaatgcacactacttttgcttatcttgcttcgtacaggcttggtcagcacttcctaaaggtatgtcaaaccacctagttatatctatacctatataaattaggcactcactcttgcttatcttgcttcgtacaggcttggtcaccacttcctaaaggtatgtcaaaccacctaattatatctatacctatataaattaggcactcatttcgagctcctacgttaagcaactagaaaattctagacattgatatgatcgatcgtattgttgtgaccatagatcatattaagagtccttgttaaataaatcatgcaattagaaatatccaaccgttgatttgttgattgtattatcatgtattcatgtatattatgtttagagttgttaaataattattgtaatttgaaatatccagctgttgatttgttgattgtattgtcatgtatatcgcttgtttctatttgttacattcttagtatcctttatccagttttatttatatattcatatgattgattcatcagcccattatatggtatgaagctgaaccacataaatttttaggatagccaggtatgaagctgaaccacataaattttcaggatgtcattggctatgtaaagtattcatcattcggatagtttcaacaattacttcatcggtttatgatttatgctaaaggttttgttgtcaaaagacaactgcgtcacgtcgaaagacgtggttcactcggtgagttgttggaatagtaaagcaatatattaattggtaaaaaattttgggattcccccattacatggccctagggggctatttatagtcttagtacatgctaatacccactagggtttagttaatacaggggaatttacatggttacccttatgatagggacattagcgtgggtattgttgacggtcgttacagacaaatttcgaccgtcaatataactaaaataatggagaattacctattcttacaatgcatatttgttttcaaataatacagttccacttgtacttggaaaataacatgttgcaggaatttatcaaataaaataaagagaaagtggagaaaacctcactcctaagcaagcaaatggataaggagggcccacatgacaggtgtaaccaccgaaaaccaccttaactgccacaaccgtcattgggacccacctgtcagccaccctgccaaacttaggggcctgctaggctggcccaggttcgatcgaacctagggttcagccgaaccctggcagctgcggctccggctagccttacacgtggataggacagt

SEQ ID NO: 6379 - DNA, 1440 bp, Oryza sativa
atacaatagagaaatagctgcaattcggaattaaaagaagggaatattacaagaggagactagggtccgtatagaaatacaatttagaaatagttaaattaggaattaaaaaaaaaggaatattaaaagagaagacaagagtccatatagaaatacaataggaaataactgaaattcgaaattaaaaataaggaatattagaagtaaagtatagagtccatataggaatacaatttagaagtaactgaaatttgaaattaaaaaataaagaatattgaaagatgagtttatatagaaatacaatttagaaatagctgaaattcggaatcaaaaaataaggaatattagaagaggagactagagtccatatagaaatacaatttagaaatagttgaaattcggaattaaaaaataaggaatattagaagaggatactagagtccatatagaaatacaattaggaaataactgaaatttggaataaaaataaggaatattagaattagagtatagagtccatatagaaatacaattaggaaataacaaaaattcagaattaaaaataagaaatattagaagtagagtatagagtccatatagaaatacaattcagaaaaaaatagaaattcggaattaaaaaataaggaatattagaagtagagtatagattccatataggaatttaaaactaactaaaattcggaataaacataataaaataaaaagtagtgtttagagtccgtataaaaatacaatttataaataactaaaattcgaaattaagaaaaacatgagaagaagagtttaaagtcaatataggaatacaatttagaagtaactgaaatttgaaattaaaatttaaaaattaaagaatattgaaagatgagtttagagtctacatagaaatacaattataaataataaaaattcagaattaaaaaaaagaaatattaaaagacaagtctagagttcatatagaaatatatataatttacaaataactaaaatttgatattaaaaataattaataactaacacttatataaaatacaatatgaatattacacattagtagtttcgtaaagttattgcaaaatttaaaattatgttgtcattgtaatatattttaataatataataagaaaacatatatgctattatatgagagaaaatataatgatgctagccgcgcaatctgcgcgggccaccatactagttatatatattataatagagaaataaggtcaaaggtatattttgtagaccgtgttattgtctaaaacgttaattaaaataaaattgaagggggtatatcgttaataaaaaaaaggtcctatatatagacttcctctttgcttaagcacagcacagcagtgagatcagccatgcgcaacaccaccattctgcttcttgccctcctcctcaccttgctctcctcgt

SEQ ID NO: 6380 - DNA, 538 bp, Oryza sativa
tatatttatagttcccttatagctaactattaaacctactctaaatggattccaaatcctgaattgtacaccccaaaagactgaactaacttgaatactccctctgaattatattataagttgctttgccttttttttttaccctaatttctttaggtttgactaagtctttagagaaatttagcagcatctataacaccaaattaattttattaaatataacattgaacatattttgataatatgtttgttttgtataggaaatattgctatcctttttataaaccctgtaaaacaaaaaagaatataaaaaaaatcaaagcaacttaaaatataaaacgaagggagcacatccgggcctcctcctttgctagcttgtctctaatggggtcttctctgatcacaacacgtccttgcaccactttcctcccgatgccttccacctaaatccgacccacactttaaagaaatgtcatttaaccctcttcagtgtttcttggctggccatcaccacctttcatctgcttcttgtaccagc

SEQ ID NO: 6381 - DNA, 542 bp, Oryza sativa
tgtgtgtgtctgcgttcgtgtgagcgagcgagcggagctaatgaatgttgtttgtttcttgttatatcaagaggtggggctcttttgcaggtccggccgtcgtggaaagcggaattccaactctcttcttcctttcagccttatttcatcgggaaatttaaatatttgtcactgttaggtttgccaattatccaaatatccctcttacatttgcccttattttttcccctctaaagtggtggctttttaactatttgccacgtttgcccatgtagcatgccaacgtggcaacccggtataaagatcaacgtgggacccacttgttagtctcataactcccctttcctctcttcatccggtgtggccaaccctaccaacagccaaagcgccgccccacctaggtcgcacccccacgattaactccaccccttctcgtctcttcctttggtggtaactgccatcactgccgacgacgacgacgacgccgacaccaaattcccaaaccctagcttcaccctcggccttgccgccgcaagccgcca

SEQ ID NO: 6382 - DNA, 1323 bp, Oryza sativa
  unsure (1)..(1323): unsure at all n locations
atggctaggtttaaactaacatatttatagagatttgtaaacacccttgttgatccaatgtcaacatttacgtgccatgctttttaaactccccaaaatctttataaacatgggattaattaggtgtaaatacctgtgataggtaaagacctcctaagcaggtcctgttgcattgattanatttgtctttagtagttctaaaatattatgactttgctatattttttatagattttatactagtaattaacaattaaaacaatgtcttggtgactaaattactctctaaaatatcatttatttgtggctagaggtagttgttgttgttgtttttaagaaatggagcaacctcgaaaggatcacaccaccattatctatatctatattattctaaaaagaatgtaatggtggtggtggttaatctaccatcttcacaaactctatttaatttgttttactaactactccttttatattacaaatagtcatatatattggttcaacattatttcatctttaaaatacagttcatcatgcaaagacatctatagggatgaattgttctaaaaaccttacaatcaattgttccaaataatgctaggtcatgtataattcatatctatccataacaaagcccatgtatttatctagtaaaagataataatatgatctagaaaagttttgatgtagctaaggcacaggcagaaaggtaccaaccagccgtagtgatcgtcatactgcaagcatgtatatgtacgtatttaacacttaccagttattcttacttcggcgcccaaatactttattaacttctgcttatcaggtggatagctattagggattacagcaataaatttgtaacctttctgaatagcaacagcggccaaaccaatcccaaggttaccacttgttgcctcgattagtgtatctccgggtgaaatcgagcccctcttttcagcatcttctatcatactgcagagcaaatatagaaaaaaagggtctgaatgtacaacaaacatccgaagtccacgcatacaaatttcttatatggtacttaaagatgcactgtactagcccgagcagctagtgaaaatgtaccgtgcaaatcacatacagaggagacttagaaagtaccgttagataaaaaaatggatatatgagatttgtcgacgacatcaaaagtaaaacttttattccaaatctcatacatctattttacgatctaacggctgttttcagctgtttctactatatatgtagtttacactacatatatattttctagagaaattgtatattatttcaacaaggtgtcgtataaca

SEQ ID NO: 6383 - DNA, 1063 bp, Oryza sativa
tatagctagtagtttggccgtactatcactagataaaactataatattctcaaggagaaaatttctaacgaagcaacattaattcctctcgtcaactatacgttaccgtttctctcaccatctttgtcgctgcatcatgcatcgatcaactattctgtgctgaattaattaaccaaggtgacagaagcactgctcttctagctactactactactatatatactgcattgggctagctagggttcttgccatcagagtacagcctataattagctaatactagctacaagatgcattccactacgataacatccactagaacgtactactacaggttccaaccaaatgatcaaagtccgggtcgatttgcactgcagtgctatgctacgacgacgcccacgatacgatcatgtactaacatgccctacgctattatggggagatctcaagcattcccgttttcgtcattcacattaggtagagctcctgcccttgttttgagcaagcgatcaaaaggtaaagatgggcgagttatggcaacagatcaggaagaagatggggcaacagaggaagaagatgcaaggaaaggcatcccgtttctgctttcgtcccaagaagagaacatcgcctcagacatcctgcaggttgatctatatatagccccttctaggccctccccgctcgtattccatttaattaggcctttttctctaagaaatactcctagattttaggtgtgtttagttcacgctaaaattagaagtttgattgaaattaaaacgatgtgatggaaaagttggaagtttgtgtgtatatataggaaagttttgatgtgatggaaaaaataaaagtttgaagaaaaagttgggaactaaaccaggcctttaaaagaatttcacgtgaattgaactgattcctaaatatatcctacaaaattcttgcgcttcaaacaagcctttttttggggtgccttaggccctgtatagatgggactaaaacttttaaatccctatcacatcggatgtctggacactaattataaatattaaacgtagattattaa

SEQ ID NO: 6384 - DNA, 1501 bp, Oryza sativa
tatgacgttatttttttatcaacgtttgattattcatcttatttaaaaaaatatgtaattaacatttattttattgtgacttaatttatcatcaaatattttttaagcatgacataaatatttgtatatttgcataaaatcttttaataagacgaatggtcaaacattaattaaaaagtcaacggcgtcatacattaaaatacgaagtgagtataaaatatgatatattttaatactacaaatttaatagtaaatttagtataagatatacttcatttgtcccaaaatataagagattttggaggaccgtgaaacgtcctaacattaaagattagtaatattagaatgtatcacatctctttaatttctttatattttgggatggggggattaacatatctgtagtagatttgtttaggcttgtagcattaccggtcaagccaggaattaaggcacggttgttactagcccaagatgtaggcaacagagtagcggacttgaaacagccgtgcagggactgaccagattgggtttgtttagttcatttccatttttaaccttgccaaaaaaaatgggcaatgaagagaactggctattgtcaaaagttataaacaaaaaatagctatgccttcatttggggctattcgggccggggcaattaattggccattccaacattttactataaatacttatattttggcctttttcttttacttggtcaagtttggttataaaccaaacaagccatgtatgggttggtaatgagatggcttttcctacttgttgtatacattaatacttctattctagtcttggacatataatctcaaaatattactttgttcaataatttatttttttgtaaaatttttaaaggtagaaaaactacccattttagtacttttacgacaaatctgtgaatattatctccatgaatccaaaataaaaattttaaaaaataatactccaagtttgaaaaattaaccgaaaatgtatgtccaaatcaacaagcatctgtgatgggaggaagaaacaaccgcatgcccttctggagaggtggggtgcattttccctaaatttttgaacagtttatcataaatttcccactcaacaaacatgccaatatcttataaatgctgtagtacaaaattaggacaagctatatcttgtatgttcaaaagtcagtacccaatggccaaagcaaaaccacatttcctctaagagaaattttacggttcttgaaaaagtatcgaggtatctaaatttgacactaattttttttttacctcaagatccttagtatctaaaggtaccaaaatttacgctagaaaatgtggtattttctgataccatctaaaggacggtaaaattaccttattctaaacctccactgtttcccattaattcacaaaaatgaaaaagaaaaaaaaaagcagtctccctctacaaatttaagagcaaagccctccattcagttcatccatgcattcttggccag

SEQ ID NO: 6385 - DNA, 1369 bp, Oryza sativa
tattacccgttcaaaatttcgtaaggttgaaaaatgacaataaaataaccatacacttggttgtttctaaatcccctgctcacattacatacatgcattgatgtgatccaacagggatgtgattatgggtctttgcgcgtaatagtggttgtgtcttacttctccgttccacaatacttgtctttatagcattaaaaaattgttttaaaatagttgtcactttgaagtactacttgtcacatcaatcactttcaattcaaatctctccattctatccccagccaccattccacatccaattatactttattaattaagaggtattatggtctttttttttcaaatctcagtatatgctaaacaatttagaatgacatgtattttatgacagaggtagtatatattaagatagagagagagtatatatcccaaatgaaattttctttttaaacctttctttcttaagaaaagctttatcctaggactcgcttcatcccaaaacatattaacctactacatcagttcaaaagtataacatcttttaacattcaggatttgtcccaaaatataataacttctctaccaatattttattaccaaccaatcaaaactcttcacccatttacttttgctatctacatccacttctcaaccaatgacaacctctcactatttaattctacatactttcttaataaccgtgtctaactctaaaactacttatattctgggacggagacaatagtattgaatgatacatattaggttgtgtttagttccacatcaaaattagaagtttgaagaaattggaacgatgtgacggaaaaattagaagtttaaagaaaaaaagttggaatctaaacagggccttactatgaatctagatatgaggccaatccaaaattgtacaaatatgtctcattcgattctgggttgctatattctgagatggagctagtggtatatactacctccattctaacatacagcaacttagaatggatcttatactcagggtatcaaatctcattatgtttaacatatagtcgtggcatatgtttaattctatcttaagttactgctctctcaattttaaaatataaggattttggttgaatgagacacttatattttggaacgaagggagtatatggccctgttcgagaacccaacagattgttgataaagttttggatttttatggcacgcttttcaaactgctaaatgatacgtttcgtgcgacaaattttctatatgaaagctgctctaaaataccagattaatcaattttaaagtttgtaataattaaaactcaatcaatcataagttattatcacatcgttcatctccatcttttatcttccgtaga

SEQ ID NO: 6386 - DNA, 1501 bp, Oryza sativa
acttcaaaaccatgtattacttattcaataagaaaaatataaacaagtgcttattaattgatttgataagctagaaactatagtgatgaataattaatatgaatatgaattatacacattgtatttgatttatatagtggacacggacatcataagcccacatggtaatgttgttggtggtggtgggtttacgtatatttaaaatggtataaagatattacaatttgttactactactaagtcagtgaattaaattaattttctgcacactagagagggggctgaacctgtcgactcatcgatcggccggtagccagcaaccgattctgttgaacaactagcgtaactatacgagcgtgcgtgcacatggccgtcacgtcggtcgagtcgagcagtacacattgctgctgctggggcccgcgtgtcatccaaagcatggacaaacgaatggggctgaaatcaaagccaacgatggctgacgctgcgtacgcatggacggattaaaaaaaaactttataaaaagtggtggtcgtcatgtcatatttgcagctcttgcaaaagacccaaattttgttagggccattacgtgtcgcatcaaaaagcccatgatgattcaaatcgatttcatatctcttgtgttcttggaaattggtagggtttggagaagaaaaggacttgagagttgagactcgtgacttcttgatgagcacccttgctcccctagggtcgtctagttagttgcaaagttcacatcgaggaactgttcaacatagtactctagttatattgatttgcacagactcatcttaggaattgcttaattcagctcagatttttctaaacgggtacttcctccgctttagtggtggcttagaattttttttaaaaaaaagcgtgggcaaattctactgtggctaaccctcactcagatgcagatccaccgtccgatgactctgaagagttgtctatgctcattagatggatgtgctatagaatttaattattttctcaatgaaccataaaaaaaacttttataacaaaaacttggtaggttaggattcatctaggctttaaaatctttctagttcggtcactagcatcattcgatgccaatgacataacatgcttgtgttctcgtcgtgcgccagccaggccaggccgccaaggcgactgccacggtggtcacccgagccttcgcttcaccaagtactgttggtatttcttacgaccacagatacattctgtggagattatgggtaccccatacctacatggcatagttatccgactggctataggggataacttatatctatggaatatgtaacagatcatgacttgggtattacgtttccttgtatattatggaacggcctaaagtcctggtttgataagattgtaaagtagatttaggaaaccgataccgtattggttaagatttctatcttgtaaccctgccccccaacctatataaggagggcagggagcccctctaggggca

SEQ ID NO: 6387 - DNA, 1501 bp, Oryza sativa
cgtctgtggttcaaaactgccattctctgcagaatcgtcgtcagcgtgtttaaatttacaaatcagcaaaagatcccctctaatttggacgtggaacaacagattttatacatctgacgcgggggcattgagccctggagtttagcgtagttgtggatttcaccggaaaatttcattgaatctcaagatcgtcttctccatccatggagctaccagccatgccatatttatatacaaaaccggaagggtatcggtcttgattctatctggaaacgaaccctctagggcagtagcagtgcaagcacctcatttgagtaaccttatacgccacgtaggacaaatacacatcgaatccactactcccacagtacaaatactttcacgggaacccaatccaaccacccccaactttcaccggccttctctctcccactttcccctttaccctttcccactttcacgccccactttcccctttcacatccaatcgatgacaaggacgattcgatgatggcggcgacatggctgcgaccccggatctcctcggggccacatagcggcggtgtcttcgaggcctaatgaagaagcggcggtgagaggacggcagcggcagcttggatctggagccgacggcgggaggactacgagctctcccctcctccctccgctggcgccggctccctatgcggaagaagcagccagcgagggcggtgcccgctctggtcggccccgccgccgtcgtcgtcgacgtcgccaaccgttcccccgacccctatggcgccgacctctccccgcccccgcgcctgcgcccaagtcaatggagttactgctgctgctgcacggctcggggatctccgcgccggcagcgtcagcggagggagctcccctcctccctccgtcgttgccgccctcctctcctccctccgtcggctctcccctcctcccttcgccggcgagaggacggagacgatgacgatgccgccgggtagcgactctcctctcctccttgtccgtctcgatctggtcggattcggagcagcggtgctgcggtggttgaggaggccgaggcggtggcgtggatccggagcggcgagggtcaaggaggccgaggtggattggtctctcttctcctcccttggcggtgaatgtggagaaagaggaggaggcaaggtcgcgccgaatcgaagcaatgactttcatagtgcgagtttccttcgccacgcaccctccttgcaccgagaaaacgcgtctcccagttagggcgcgagcggccgggcgaaggtgtgggtctcggcgccatgtacgcgtgaatccgagctggcgcagtaggtaactcctccatgtaggagcactgtgaaggaccttaacttggggtgtaaagacaaaggcatgcaatacaatgattttgtagttatttcttatatctgagaatcagatggctggaaagtggaaactccccaaagtcagtgtactattcacccttaactttaaccctctaagg

SEQ ID NO: 6388 - DNA, 1501 bp, Oryza sativa
tgtctttccatatttcaggtcctgaagatttcacaaaataaacatgatgtatgatccctaggtacatctttccaaggcagaatgactggcagtagataatgaaagatagctgtaatttgtaaaacatggaaaattggaaatgtggatttttcctgaatacttaccagtccacataaagtgtgcctctggatttgctgggtttgttacttgattgagacaatgagaatttggtatgctcttcatgagctcttccaccttgtccatcataccattaaacccaattgcaggatctgcagcaaaataagaacaaacggtacttaacacttgtcgagtgtcgacggcacttgttcataagataaagaacactcattagttcagcataatattctttcaaaaaaaaatacttcagcataataattatgtaaatatgaaatgaacaaaatcatcccattcaactgaaaatattagttagggaaaatatttacttgaggcatttaagtgcttattggttttttaaccatttgtagaaactgggatccaggttctcacctgtcaatatcaattcagcacccaaaaacctcagtagcatctgcttgtcaagcgaatatttagcaggcatgacagcaataaacctgtagcctttctgaacagcaaccagcaccaaaccgataccgagattaccactcgttggctcaatcagcgtggtaacaccaggtgtgatcaaccctttctcctctgcatcttcaatcattctgcagaagaaacatggaaattgcaaatgccaaggcaattttgaaactctttaacactttttatagatgcttctcacataaacacaattttgtaaatatttgatctgactaaaaaatgtaaacaactgaagaaacaagtgcactatatcaatcagaaaactatgacgatgttttgcatgaacgcacctgagggcactcctgtccttgacagagcagagtggctggtatgcttccatcttcccaaccaatcgagcctgtacgccttcgttcttcgcgatgttcttcatctcaacaagcggtgtccatccaatcagctgagagcaaagagatagaaaccacaagacgtaaattattgctagatgcacaatccagattctgaatacaagaacgagaaaaatagcaccataataccaatcaagaaaaatgtccaaacaccacactggctgactggcttactactcaattaaggggaaacttgatccactaaacagcaactatcaagattttttgcaagataccgaatacaacaaactgaacctgtaatgaaaagcaacaaaatccactggttctcatcagttttgttttgttttgttttgggagaaaagaaatctgctcacctgagtgatgttagaggcgatgttctcctccctggaggagagcagagacgggatgcctttcctcccctgctcctgctcctcctcgcccggtgcagccatgtctggtccctcctctccgttcttgatttcttc

SEQ ID NO: 6389 - DNA, 339 bp, Oryza sativa
acctgctctgtgcagtcatttgatgttcgatgtaaccttctaaaagaaaacatcttgcctagggtcagagaaggcaagtattttggattcatcatgtgtaggatttgatgttcaggtcgtgcttgttacaacgttgagtagttttctgttggtttaactctggaaacacataatttcctgttagttactactttattccttgtgtcaaaaggctatgatataagactctgttttgcaggtaagcaacaagaagcagtgatggattagctttccctttaaggcaggtaatagctgacttgagttaatttattaattggtggattactcatgcaacacctg

SEQ ID NO: 6390 - DNA, 461 bp, Oryza sativa
gggccccggaagggggggggggtggaaaaggagggcctgacaggaaagaaggaaggatcggggagatttgcggaaagtttcggggggggagagagataacgggcctagggctatagatcgtgccgccaaaaacgcaggggagtggggagagggggttgtttatttgttggcgacaggtgcgaatatagggagggagtgtttgagttgtttgagggggaggagactgtgttttgcgtttaatgtgtgcgcgaggggagaaattttggggccgggggtgagttgccattgcaaccacaagagtagggatcaacttcgaagccgcggaattcggagttaatatttattttgtcatatataaattagcatacgcagtttggagttcataagttcattacgagcaatctgaagataaatgagatgctatatatatgcgggagattcacacatagagtgactgtcgt

SEQ ID NO: 6391 - DNA, 234 bp, Oryza sativa
agatcaacaatgggattttttggtaattaaggttagcttttattttcctactccttggaaagaggtatctccttcaattttataaattcaatccgggggttgcacatcagttctgtttacagctcaagcaatgtatgcgtccacccatagagcgctaggggcacggccccctgaagggttaatctggcgtcagcggctccccccctaaaaacgcgtcgtccgcttaatgacaga

SEQ ID NO: 6392 - DNA, 1501 bp, Oryza sativa
acacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgcagaacgtcgaaggcagaggttccggagacctgctctcccgatcgccggtgcacgccggcgagcgggatggagtagtctacgagcgacggcgcagtacagagtaggaggcaaaccctagattgattttttgcgtatgttgcgtgaagacggcaggtcggtttatatagagaagggtcgcttgatcagggcgcccgcacgatctctactgcgcgtaactgaaccggataagtcgcgcgtaacttatccggactccacgccgtttgcacgcaccggatctttcggaacgtttccaaaacaaaaacgaagcgcaagggtgaggagccaatttttcggaccattcgacgcatacgtcgtgcacgcgcgccgcctgcccggccaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaagttcctctcaaaaaaaaaatcatatattagtcaatcaaagggtgtgtttacttcacaccaaaattagaagtttggttaaaattgaaacgatgtgatagaaaaattgaaagtttgtgtgtgtaggaaagttttgatgtgatggaaaagttggaagtttgaataattatcttgaaactaaacacggcgaaagataaaaggctgttcttgactaaagtcctctatagaaaacatgattataaaaatataggaatatggagaaaaaagtaagaatataatatcatatttattttattcctttaggattttttaaaacacaagaaagttttaaaattgatgtttgattagaatacatgaattttaagacataggaagaagaaaccttgaagtgatgcttattttcctttaaaattactctgcaatttctcatttcatagaatttaaaaggaatggtaaaaaaaaatcaatcatctgtttcaactttccagagatccatataattgttttccataagcgctctagaatttctatgtgttttttttttcaaagggtgccctaaatgcctggaaaacaacacgtcctttaatttgcctaaagcgaaaaggcaaaaatggggagcagaaaaagaaatccttgattcgccgaaagctacaaaggggaaatagagaacagaaaagaaaaaaaaaagggagaaaggagggaaaatgaaaacgtttcggccacgcgtacgtaggtatacccaagagatatag

SEQ ID NO: 6393 - DNA, 1501 bp, Oryza sativa
gaaaggtaaaggtgtagacgtgcattgtgcaaagggccaaaaagaaaacttcagacactttaattattagcaaacaatagatccgaagatttaaataatcggtacatgggtgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtcgacaggttcgggccgctgagaagcgtaataccctactcctgtgttctggtggatctgtgtgtgaaggagttacagagagccggagagccagagagttcaggctccagaacccctctagcgtcctttttctcctttcttttctcctttttggtgggcaaggtcctacttttatatctcaaggggataccacatgcaccacttctacctacttttcttttgggtggggacctaccctatcttgaccaaaacttggcttgcaccttcgcctggaagctaaatcacaacttgtccttgagtgaggctcagcgccgtcactcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaagccgcctgttgccacctaacccgcgatctggccggtctgtgaccggtcacacactgtgacctgtcacggaccgaacgagtgtgctgtgctgcattaaatgcggcgtggggcgctcgtccaacccgcaataaacgcggttaggtgagcgccgctgtgctcacctaacccacacacgtggcgccaaacccacaggggtcggggcgccccagccctcggggccgaaacgggagcggcccgacccctcggggagacagagggaggggcggccacatcaccctcgggcccgacccctccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacaggtggggccggtctccacaggcggcagaaacccagcggtcgcaaatcgcgcacatcggcaaggaaaaaccgaccgacaataa

SEQ ID NO: 6394 - DNA, 472 bp, Oryza sativa
catagaaaaatcttcaatttttttttgtactattaagtcttgagagatatttatagagtatggggccaagatccagctcctgaatgttaaatcctctttaaattacctatttcacctagctgtcgagtgctgaatataattctgcaacatgtgttgctgtcctgaagccctgaacattttttaattgttcagtgcaaccattggctggacaaccagacatttcttgcagctccggttgctgtggctgccaaatttaattactatattgtgtttctgctgatctgctattctcttgatgatttacatttttgtgaaaatgctgttacatgcagataatattgtactgcttgcagacaaacataaacctcaggagactatatctgctttggtaattttgttgcactcacatagatgatcagtattcagtttgatgcttctggtacttataggtcgtattctttcttctgctagg

SEQ ID NO: 6395 - DNA, 1501 bp, Oryza sativa
caaatacatattttaaaagtattctaatagaataaactcaactggacatgcatactaataaataaatagaatggcatgcaaattttgcacaaactcgatggtatatacacagttaaatatttttgcggacaccatcagcgtgttagtacaatcagaaaatgaaatacaaaaatgcacatcatatataatgagatatcgtaacaatgagatattgagcactactgatatagacctcttagtgttagaggtatatatatacctcttaattaacacactagaaaatctttacaccaaaatacttccaaaagacttaacaatagacccattgtaaccaaaatataagggatgacaggagaatgtactacagttgcagcgaacagtgatgcacttatatcaaaatggagcactgaaagaaacaaaaatatattttgaaacagtgctaacgataaaccatacaaaagatgcctttaagaaccataaaaccaattgtcaacaatatgtatctgctaacacactacattcagcctatccaagaaaaaaaaatcttattagcattcatatatataatatatataggcatattagggtatctttttcagccaagatatataacttaacttccaaaaatagactgtatttacctgttcaactatgacaggatcatctctggtacggttgaagacataattcctcaaagggtccaagtaatcacgtactgcaaagattccgtaaacactaataggataggacatggagctggacaacctcaaagagaagatctggagcatctccttgggttcaagccacccaatagtagatgcagctacaaacatttaaaagaaaagaaaagtcgttactttacaaatacattttggtaatttggtagcacacaatattaataactattgaatcctttataataggaatcgacaagcacttactctcagaagtatcattggtcttgtattcacggtgatagcacaaactcttggtggtacagaaatctgttgtctccgggagcggtttcaaaggaaatactggacaagaagcactcgtctcatcccctccctgcttttggaactcctcgcacgccaccatgaattctctattcctcttgtcgtatgtttctagccacttgcgaattatttcctttgcctgctccttcgtgaagttctgccctgagaaattaaaatagcgatagtatctgttcgtcttttaatctggaatcgaagctctctactggattattagtagtgttacctgggcaagttgtctcctcgtctgcgtaaccatcatcatcactatcctcgtcgatgtcacctatcaacatattgtgtgagttggctgaggcaaagacgtcatctgaatctgaatttttcagataatagaaatggtttacatctctggcctctacggagaggcacacaaccaatgtggtgttttagaattgaaaaacaaaaaagtgtgatgggacaaaagtctgaatttgcagtctgaatta

SEQ ID NO: 6396 - DNA, 1501 bp, Oryza sativa
cgccacattgccatgatgttgatgacatgatttgtgaaaggagaaataaaattaaacaactgtttttgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttaatgagcaccgggacatgtattacacttggctagactctaaattcttaacttgtgtgggatgggatattgcatggtgatttttatgctgatggagccacttcctgagagggagggaaggtggacgtcctcagaaaaccatgacgactcaatggcgggaagctatccttgggatcacaatggatggtggacagaaccgtcgttgtttaatgtgaacactgaaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagatgcccttgtcggtacgcttgtgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacaggttagtaatatacgattcggtcttgagttgtactattgttgtatctctgtctggtatataatgacttgaacagcctccacaagaggtagattgcctcaatagttttcacatggtatcagagcatcctcttccacaaaacatc

SEQ ID NO: 6397 - DNA, 1501 bp, Oryza sativa
aaaaggttcagatttagaaatacttttcggaaagttatattaataaaactaaaaaatatctaaaagtataaaattaaaaaaaatcatgattagttaggtgtaaattattctatacttaaaaatagttttatctaatattttaaatcaacttatagaaaattttcttacgaaatatactacttaacaattaaaaaacatgctcacgaaaatcgagataaaatctactatatcttaaaatgaattgactagtaaaagttgagatatcacttaacactatgaatctggacactaaacacaatctaaactcgaccttaggttcataggctgtatttagttcacgctaaaattgaaaatttggttgaaattgaaatgatgtgacggaaaagttggaagtttatgtgtgtaagaaagttttaatgtgatggaaaagtaggaagtttgaagaaaaactttggaacaaaacacggctatagttttaggtgatctcttatcttttattgttactatctctgttctataatatagatttaggactataaaatattactctgatttcaaattagaactactatatatcatgggacgaaagaaatacattttaagacggggatattatttagaactggcctatttccacgtttctcctcgtgccccgcactacagacctacagtatagtttattctttctatatgtctcatcaaagatgtcctttttcacggtccatcccagccgtcggatccccaggcggtggcaggggcaggacggtcattgcacaccccccggcgccacgcagagaagaaaaagcctcggtttttaaggtcgccgtggccagcagcggctgcgatgcgatgcgagcctgtgttgacagcggagaaagcagtgtaatccggtcccgccaccgcagccgcctccacctctcttcccggcgccaatggccgcgtcgtgaagcgcagcagcagcagcagcagcggagacagcggcagaagctttgcctaaggtcggtttgcctccccgcctccgccgcattccggttggagttttgtccgtgttcgtcggcggtttcttggctggccggatgaattgttgtggggagggggagggggaggggctctctcacgcactcgctgctggatttcggttaggtttcgcggctgggggaatcgcgggggaattcaggatctttgttttgttagttcttctttcgggcggggttggatctcgagtaatctgcgtcgtgttatttgccgcgagatttgggtgttttttttcttctctccgcatcttctctctcgttccttcgtctgtacggtctagtggtggtctacgggctacggccgtggtaaaagtttctctagatttttggtctcgtttttttctttattttaggcggcttgctttgcttcgcctgctttgacgtttgaccagcggtttatcctcgattattcttcctcgtgagtcgtgagcaagctatgatttgcagctaatgatttttgtgcttgg

SEQ ID NO: 6398 - DNA, 1501 bp, Oryza sativa
ataatagcatatatgttttctcaatttattattaaaatatattaaaatgacaacataattttaaattttgtactaactttatgaaactactaatgtgtaatattcatattgtattttatatacgtgttacttattaattatttttatatcaaattttagttatttctaaaatatattcctatatggactctacacttagtctttcaatatttcttattttttaattccgaattttcgttatctgtaaattgaaattgtatttctatatagactatcggctcttcttccaatattatttatttttaattctgaaattttatattttttctaattgtatttatatgtactctaaactcatctttcaatattatttaatttttaatttcgaatttcaattacttctaagttctaaattgtattcctatattgactttagactcttcttcccatgtttttttatttcaaattttagttatttgtaaactgtatttttatatggactctaaactctacttttaattttattatgtttattccgaattttagtttgttttagattcctatatgaactctatactctacttctaatattctttatttttaattctaaatttctattatttcttaattgtatttctatatatactttatactattcttctaatatttttttattttttaattctaaatttcagttatttctaaattgtatttctatatggactctagtcttctcttacaatattccttattttttaattccgaatttcaactatttctaaattgtatttctatgtagactctgtttctttttctccgattaatatgagaatttctaagccgtgaaagcgaacgtggaagctctttttttctattcctttaataaattaatagattttccatactgattagtactccctccgtactcgtaaagaaagtcgtttaggataatgtttaagtcaaaccttgagaatataaatcatgaataactctcaagttgttgagtttaaaaatgtgaaaattaaatgaatagatttatcttgaaaaatactttcataaaattatacatatatcatttttcaataaatgtttttaagaaataataagttaaagttgtgttttgaaaaccgtgtcactgtccaaaacgacatcctaatacggagggaggacctgacaataccatgtgacaaaccgagagtagcatttttcttgtaaagcaagcactgtagcattattctgaccctaaattctggaggtgattagagcccctaaatggccggatccgattcgtccatctctgcatcgtgcggtgggcaatccctttcacatccagtcatcaacaacaccacacacaccctcacacacacgcacacgcagagaaaaagaaaaaaaaaagaagaaaaaaactaaagaactagtcgtagcggccacactacaatttacaggaaagaccttataaaatccaagagaacggtcaccgcttgcttccaagccgagccca

SEQ ID NO: 6399 - DNA, 1149 bp, Oryza sativa
tttgtcgttacaagaaaccaacagctattttttgttgaacaacttgacaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctatcttgcagagagaggacaaaaaatgcaatacttttcacataataaagctctatgtgaataattaattgtgtgcgagacatacaaaataaatatagagcgaagaagagctttgaaaattcccatttcttcttaaaaaaaaactgcaaaatctcaacccgttgagcaacagggttccctgcatgctctacacttctactcaagcttgtccataattataagggggtttggtgaactgttttgaggccatatctttatcagtgccgcttcttgctgtgtggagggcgcgggctggtatatggtgggaaaacccttatcagcgatgtgttttgttcgactaatacccataggacggtataattgtgctgttttgttgcattgaattccactgaatatatcgtgaattatgatccagtagtagatccggaaacaccttaaaagcatatgtgtgataatg

SEQ ID NO: 6400 - DNA, 1501 bp, Oryza sativa
ttgtagatgcgactagttatggtccgtctgccatctaaagagggtctcgtccaaaaaaacatttctgtagcagtgtataaccacatatattagtattatggttatatagtttgtcaaacattttcttaacctattgtacatttgaattctatacttatattcaaaatttgagttcgttcaatccatcgccaaaatattggagtatagccatgtaagtaaaatattttttcttatgctacaatatcgagtaaaactagttaatggtgcggttttttgaaaccttaagaccataataactgcagttatatatgtgacatgtccaaactaacaaggttcttttacaactcaagccataataatataatacatacatgtgaatctataaaatttactcaaaagaatttattgccaaaaaattggctaacaaactgtcaatttgagtctaagcatacctcctatacatgagtttgtgcctttcggtatatggaaataccatatagccaatagtatacgtgaatgtatccttttattaagaaaatacgatgaatagagaaggaaattatcttcctaaaataggaggcgttagagttatagtcgggaagataatgcctccttagtccgtatcatattctatctctccgaattcttcttggagaggaagatgatgttcgatataatacaagaccctagaaggagagggaacataccaacaaaatacaagccaatacagataagagctatgaaggctgacatgagggattagagctacctgcaatctcgatgagttcatattcaaagacgaatactacactagctgtcgactacgtgtgagagctacatgatgtcaaaccgacaaaaaaaactagattaggtgatcccaaatattatactcatgtgatactgaaggtagactagattaggtcatcctaaatactgtactcatgtgataccgaggctattacctgtcagttaaggggcccgaacctatataaaattctgtctcctatctctttttaccgtaatctcgcatataccttggttacaacgacagccatactataaatacagtaggcgagtataacccgtcaatacaaaccccactaattaaaacgcaaacatttctatttcttttgaactccgcacgtctcaatttttttggagaggaaaagaacctttcttaacttaaggactcagcaaaatcgctggccaccaagtcctccatgcccggaggcatactgtcccatggttcaacggtattccgaggacatttacaacccaaagctgctaaagcatgcgctactctattacatttttgtggtgcaaaaacaaagaaacaggaaaggaaactacttccaatcagctatttcgttgaatatagtattttaccaaaatttttgggaacaacatattgtaccaatttcgttgaatatagtattttaccaaaattcgtcaaaatctgtatagacctgtacgggcaataaaccaaagaaatcctttttcc

SEQ ID NO: 6401 - DNA, 562 bp, Oryza sativa
tgtgctttcagtggtaggcgacatacccgtcgacggtgagcgcctgtggtgacttcgtcaatctcaaggatttgccggcttagtcttcaaagatgcttatagaggtagggtttacgtgcgtatgttcataggggtaagtgtgcgtgcgttgtgagtgtctgcgttgtaccatatgattaaaaaaaaggtgtgtcatatattaagagcctgattagttgcccatattccctgataaaccaaaacggcttattagagattaaaaaatcatttatatgtaaaacttttatatatattttttcgtagcgacttaaaaatcaataataaaaaaattacgtagaaaatatcttaaaatcaataccaaatttaaattttttgctttgacttatttggcgaaacgatgggatctctaatccccacccatccgaactcgatgaggcttctttaataatgccccaggtcataggagctgcttccctccgagctctatataaaccacataaacctcttccaaatcaccccaattcccaaagcaaccgacacacacacacacaagctacaaaca

SEQ ID NO: 6402 - DNA, 207 bp, Oryza sativa
ggtcattggtagcccgtgagggaaagtactccgccatgcctaggtggacctagaaatagattttaaaccaattcaatgatttggtcacccttccttacatcaccttattagggtgacaactagctaattggagggtggaaaagtgcttcacggagccttgcctgttgtccacccacatgtttcactcatagatggcgatgtgagcca

SEQ ID NO: 6403 - DNA, 273 bp, Oryza sativa
tttaattatcaattaattatcataacacgattaaccatcatgagctaccattaaatataaccataaataataatgtagtatgattcatcccattaatgagctaatgtttctaggcatggctaagcaattatatatatatatatatatatatatatatatatatatatatatatatatatatatatatatatatatatatagcttttagctgaaccaaaccaatatataaggttcaagctaatcaatttattacccaaggtaacaaggaataga

SEQ ID NO: 6404 - DNA, 1501 bp, Oryza sativa
cagtagcgaaagtaaccagtagcggaaaaaaaaaggagagggattttgcggggagagcgcagacctgcacgaaacgaacacggaggtcggcgacggtggcccggatcttgtagtaggcggagttatggaaccccgcctcctccaccttacgcttcttcggcggcggcggtgcgggtgccggcacatcgagcggaggagcagtaggagagaccttctgctcggcaacgaccgtggccgtgaccacgggctccggtggtggagttggcccaggtggaggcggcggggcggcggtgacatcagcggctgtggtcagctccgccatctgagtttgccaggtagagaaatggttttgactcggggttagatcaaccagagtgtgccttcccggctaatttactactacctccgtcccaaaataaactttataaaaatattgaattcacattgtctctaacattctattgttattagattgtacttggcatatattattttgttttttattctaaactatagtttatttgaatttattaattacctaatttaaatatctatactgttagtctaaattatttttgaaattaaaatattatagatatatcgcaatgttttagaaacgggaagacaaagtacgttcgatggtttcaatttataacctgataaagaatgttaaattagattaatgccaagtggcacaatatgttttttagaaaatttataacctaataaagaaaaaaatgttaaattaggctgcgtttagttccatccaaagtttggattttagttgaaattagagatgatgtgactgaaaagttgtgtgtgtatgacatgttgatgtgatggaattttgcaaactttggattcaaagtttggatctaaacacacccttagattaatgccaagtgtcacagtatgtcctttagaaaattttatggaatgaaaacttcttataagaatatataccttaataaaaagattttttgagtgactatgagtagtttgtggtatagattcttcttaagaaatttatgtgagttaggatgagtacaaattatgtgagcttacattttccgttctaatgcaactattctaagggtgtttggatgagattcagtaaccaaattacatgtgctaaaaacaaaaatcaaaattaacaagttgaaagtaggtgcaactgggcagaggcagatctaaccctgtttcggttgaggggtcggttttcggttgaacccccaaacttttttgagggataacgcagaatacctgatgaggtgtggatagggagggagggatggtcaccggcgatagacgatgcggtggaagcaggaggacgccgggcgccaccttgctcgcaggatggggatcggcgcaagcggcgggcgaggagacgaaattcgaggccgaggccggatgggatggattaggatgctcaccggtgagcgaatgcgaggagacgggagtcggggggcggcgggcaaggagacggggcggattggggagg

SEQ ID NO: 6405 - DNA, 1501 bp, Oryza sativa
atatggttttggtcccacgtcaaaattcctaccgagctgttgggaatctgcaaaataagtcatgtacctcatccagtctgaatctgatttgagttttgggccttgtaattgtgtcgtgggcttagcccataggggtgtgcgccctaggacaaccctaggacgtccctaataatatttattcagtaaccgtcattgtttggagtggagttttgcttagattaatctgtcaagaacagtttcgccgctagatcggtttgtgaaaccccaaattcgagtgcttaatcattcatatgcaattgttttgcaatctatgttattcttgcttgtgttcttcgattcgcatgcagggattagccttctcggcgaggtcaactgggtttcggcacggttgataaacagaggagacgtggtgttgcgattgtggggctcaagagcgtgttcgttcaaaagccgaatcgagttgtgtctcgactccgcccaaatcgactatttatcaatacctatcggaagatcgggacctaacatcctcatcagccactccacccgtttgccggctttgcccgcacgtcaccccacctgctccgctccgcctcctagcgaagtggcgagttggcatgggtgagagaagacgggaatgtgatggtgacatgtgggaccatgtgggccccactatctattattattttgtatgtgtaactgacatgtaggttctatggttttaattacttttccaggttaaattgacatgtaagtgctacgtcaatgccacgtgacacgaaaacttagttaaaaggagccacttagtcgttacatcagccaaaacccggtcatgtcgggtcccttgtcacgcggcccggctaacccggcccaaaggagcccaaagtctcccaccacattgatccctccgacgctgtcgtccaccgcattccactaccctcaccccatcttcgatcaccttccgcctcccggattctccggacaccggcgaccacttcccaccggcgtatttttcctcccgcggccgctggagctcgctccgtgtcccgaggtacggcattctgtcggatctcaccgtgaacaaagtaaaataatcgatcaacttttcgtggatctattctcgttcgtacgaggtagtaatgttttagggttattcacttgttttgtttccctcggctattgttgttatctttcggatgcgttgcaactagcctccactctacaattttcgcaacggcaagctcgtcttcttcttcactcttggaaaatttttactagcttatgttcaatgtgccaggccagggttcagaatctctccttcaagctatacctccacttgtttgtaatccgggcttcttccattacattgattttactaatgtaatgattctcttttctaaaatgtaaggcatgagctctgtcgatcagttaagaaggaaatgtaaaggcttttaggagaggtagaaaatgactgaaatggaagacggtatatctgatgttgaga

SEQ ID NO: 6406 - DNA, 1501 bp, Oryza sativa
catttacttgaagtaatcactgaggcgaataagccaactttttaccatcagctacatctctgtcgtatatgtacccaaaacctggtcggaagctagagaatgaacaacatcatgataatggaataaatgatagcttttgtttcaagaaaactatagccacttattgcataattctctcaaaagagagtaaacattcaggcgacccataaagactggcttctaacaaacacactttaagagaaaataattattgaagtatgtttgtaaatctccagccgaaaattctatatctgatattggccaaaaactcttctgttttggatgggaggaaaacatgctgcatcgacgattagtgagtttatttcacccctgcaggtcaatcggtggaatagagcaatggaggacacgtccaaacactagctgcttccgtccagaatgtcatctttgatatcccaaaaggctgtcctgctgtgcgcgacttctggtaaaaacaccttgttcctttcctttcctcagcaaagtgcgtcgaaggatttctggtagctgatccggaacgggatactcgcatcgagccaccaatctctcatgctgaggcctgagtctcccgaagacctgcattttcaccttttaatgtttttggattctattctaggaatatacctctaaaaaaacttattctaggaatatatctctacaaatattattctataaatatattcttttcgacacaccaatgtcattggcgccgtccccattgctcctcggtgaaaactaattcactaatatgaaggggacgacgccaatatcattggcgccgatgagctatttataattttttgaaaaggggacttatttgtaataaaaaaaattacaaaacaggacctatttgtaatttttttattacaactatatccttttatgttacaaattggttctttttgagtttttttggaaataggtcctcagcgtcaaagatactagtgtcgtccccgttcacattagtggcttagctccaccgaagggcaatggggatggcgtcaaagtcattggtgccgtcatattggatcacgacgccaatgacgtagccgatgcgaaaagggatcatttctagaataaatatttttaagggatctattggtagaataagtttaaaggaataaaaggtaaaaaaaaatccaggttggaagactgaggaattgatgacgtaacaacgcgtttcttttcccctaagtgacaactgaatgagtagtatgcagatcagcagatgtatgcacaatgcacacacgcattttttgtttcaaggaagtgtatagggacgcattcgcatatataaagtagtgatgtaaatgggttggcccatgggtttgtaactttttaccgaccaaaaactagggttaatcgaacttaaccctgaaaacaacgaggtagaaaaaaaatctacatttggtctataatttacctaataaaaaaaagaagtgggataaaaggttctagaataccg

SEQ ID NO: 6407 - DNA, 1501 bp, Oryza sativa
ttagaaagtttttaattttagaagatgctgtagctgataaaagctcctataaataggctcgttgatttctttgaaatggatggattttcaagcaatttcacacaaattaaaataatcactaaagaagtctcgtaaaattgttgaactctaggcccttagaaagattagttctacatatgggcttgttcaaattggtatcagtttaaaccatactattattttgtaaaattaacaaacgtgtgaatgctttagtttattactaaacattggtagtgtatagggacttttgattacatcacatttagtctatcctatcaaaacctggaatattgctaacttacaaaaaaaaattgacattgataatttttataaaggttgattttagcagtaaattgaacatgcctatgctaaatttgatgaagatgaagattaagtagagacacgtaaaacgataaagccattagcacttggttaattgagttttaatgattataaacttaaaaaattaattatctgatattttaaatcaatttttatttataatgtcttcatacgaaatatactgttgtcgaaacgacaaccgcatacgtcgaaagacgtggttactcaacagtggttggaaaaacgaagtgtattaaattttgaatttcacttgggattcccccgttacatggccctagggggctatttatagccctattataggctcttactactagggtttaggctatagagggaaatttacatgattacccttacgaaagggacatttacaggggtacatgatgatataggggctcacgggcccctgatgggccgtctggcgattgccggccctattgcccctaggtttgatgggccggaaaggcttcctcggccctcgcgggggcgaacttgtcaaggcgaagtcgtcctccttcagcagatagtcttcgccttgcacccttcgcctgagacgcctctggcctggcgcttgtacgactcttcgccttgcgccgttcttgctccatagccttcgccatgggtttcggcaggtttggtcgaagggcctcatgccatccgccaacaagcccctcacgggtaagggtgagattggagcttcggccgagaccgtgcaaaccatgtggtatggtatgcggtgccccctttcgacagatgctcttgccgaaacctacattattcctgcgagtgaagtttgttatttgtgtggctggtattgttttgccgcgctttcgcctcctgcatttggtggcatattcatatatatatatgtgtatatatatatatatgtatatatatatatatatatatatgtatatatatatatattatacacattttttttataaattttcttttcccgggccgaaaggaacagtattgggctttcccttcatgggctttttactgtgccgctcggacggtgggaagttaccgtttcgcctacccttgcgacacgtggcgctttattattggtgggtaggcgaacggtcgcctaagc

SEQ ID NO: 6408 - DNA, 1501 bp, Oryza sativa
cccaagtgaaattcaaaatttaatacacttcgtttttccaaccactgttgagtaaccacgtctttcgacgtatgcggttgtcgtttcgacaacagtatatttcgtatgaagacattataaataaaaattgatttaaaatatcagataattaattttttaagtttataatcattaaaactcaattaaccaagtgctaatggctttatcgttttacgtgtctctacttaatcttcatcttcatcaaatttagcataggcatgttcaatttactgctaaaatcaacctttataaaaattatcaatgtcaatttttttttgtaagttagcaatattccaggttttgataggatagactaaatgtgatgtaatcaaaagtccctatacactaccaatgtttagtaataaactaaagcattcacacgtttgttaattttacaaaataatagtatggtttaaactgataccaatttgaacaagcccatatgtagaactaatctttctaagggcctagagttcaacaattttacgagacttctttagtgattattttaatttgtgtgaaattgcttgaaaatccatccatttcaaagaaatcaacgagcctatttataggagcttttatcagctacagcatcttctaaaattaaaaactttctaaatagttcagatttttacctaaaatttgagaagctggtttgtcaatttctttagatctcatcagctacttcttaaaatctaaaactcctacgaacaaacccctatgcttagttcgaatttacctataggatttttgcaaaaactatatatgtgaaagtttctttaaaaattaaataaatcatttttttatgattgtaatagttaatatttaattaattatgtgtaaatgactagtcttattttaggtgcaaattaagcctatcccttatttgaaaaaagcctaaattttactcgaatttgaaggatctcacccagtgtacaactatcgtgcgaatcgatttctacgagaaaagaaagatttctacaagaaaacaagaaagagccttgtacgcggaggagttagcagctgggctcccctatccattattacctttgggacgcgttgacgcgaccgcggaagaggtaggtttgcgcgtgagctgcgttgttgcaattgcatagcgtcggtgcacgcaaagacgccactcccgccgacggtttgccggcttgcaagttggaacaccaaatgctaggtccgccacaaattctaaacgagttgtggctgtttggtgtatactgtattgctcttgctcgatagtcaattcaaccatactcttttccttcactacgcaaaatggagtgacaaaattagtacataattaattaaattatagtattagttaaaaaaataaaaaatagattaatataatttaaagtaactttcttatatatttatttaaaaaacacatcgtttatcagttcggaaaacatacactaaggactaagggtgtgtttagttcacgtca

SEQ ID NO: 6409 - DNA, 1501 bp, Oryza sativa
atggagttgctttactgacctctcgtttacgaagcacactgatgtagatatggccgagcggagtcgcttgcctcagccacagtggcgtcctaggaggagtaggcgggggtcacaaacggagctacgacttcgtgtatagcgttccacctggagcagaggatggagacggccatcaaaggtggggacgaaggcaggtgctcctcgatggggatgtgcccgcggcggcctcggcttggatgggggcgtggtgcggctacgtggggctggatggggcattgggcggcacggcggtgggggcctggttagcgcgcagcgcggcggcggggggctcgatggtttgcggcgcggcggcgcgcgggggcggggggactaggaagcgcgtcgatggggatgagtggtggacgccaggattggggattgttttgtgacctagccacccaagaggtttggataagagcccgccagatttttggtgcccgccacattttcggcacgatttctggtttgtggggcacgatacgttatcatgagtttttcttacaaaaacaaacgataaagatatatggaaattagccctatgtgatctactaaccccaatttaactcatcctgttataaaaaaaatccatttggaatttacgtcagcctggtgattttcatcgataaatctgtctgtttcaacaatactttggaaaaaaaataaaaacaaatcaaccagctttagggacctgataatggtattttaaggatatagggttcggctgattaaagaaaatgcaaatgataataatacaaagaaattaaataaattttgttctaaaattacaaatgctatttcttgtagtgaaacatactcatcccgattgaagttcaatacgtggcatgcgtactcgccttaacaactatttttgtttcagtggtaggcatttcatgcaaagacgcttgttgtatgaggtatccggtcttaggggtaggatgtgttgtgcatacgtttaaaggggtgagtatatgaccacttgtgtctgtgttgtttctaaaaagaaaaagtctgaattaccccagtgaattattgatactgttcggattataccctcctaaactaacaaaccagatattgtacaccttacgctcttcatcggtcaacctccctcctctccaatctcttctccactgcaatatgattgtctcatactcccattcactctcattaggcgtacaaacgaagcaagcggtggtgggttcaacctgtagcaaattttgccttaatagaataaggtcaggccatatattcagttttaaaaagaatggtcaaatgagtaaaattgataaaagagggccaaccactaaacaagataaaaaataattaaattggttgttagcctttaaaatggagtcataggcgcaattgcccctatgtttttaaatcttgagaaaaataaaggaaaaagtacgaattaccctcacccgaactatcatggtcgaatgaattaccccctaaaccc

SEQ ID NO: 6410 - DNA, 1501 bp, Oryza sativa
tgggagtatgagacaatcatattgcagtggagaagagattggagaggagggaggttgaccgatgaagagcgtaaggtgtacaatatctggtttgttagtttaggagggtataatccgaacagtatcaataattcactggggtaattcagactttttctttttagaaacaacacagacacaagtggtcatatactcacccctttaaacgtatgcacaacacatcctacccctaagaccggatacctcatacaacaagcgtctttgcatgaaatgcctaccactgaaacaaaaatagttgttaaggcgagtacgcatgccacgtattgaacttcaatcgggatgagtatgtttcactacaagaaatagcatttgtaattttagaacaaaatttatttaatttctttgtattattatcatttgcattttctttaatcagccgaaccctatatccttaaaataccattatcaggtccctaaagctggttgatttgtttttattttttttccaaagtattgttgaaacagacagatttatcgatgaaaatcaccaggctgacgtaaattccaaatggattttttttataacaggatgagttaaattggggttagtagatcacatagggctaatttccatatatctttatcgtttgtttttgtaagaaaaactcatgataacgtatcgtgccccacaaaccagaaatcgtgccgaaaatgtggcgggcaccaaaaatctggcgggctcttatccaaacctcttgggtggctaggtcacaaaacaatccccaatcctggcgtccaccactcatccccatcgacgcgcttcctagtccccccgcccccgcgcgccgccgcgccgcaaaccatcgagccccccgccgccgcgctgcgcgctaaccaggcccccaccgccgtgccgcccaatgccccatccagccccacgtagccgcaccacgcccccatccaagccgaggccgccgcgggcacatccccatcgaggagcacctgccttcgtccccacctttgatggccgtctccatcctctgctccaggtggaacgctatacacgaagtcgtagctccgtttgtgacccccgcctactcctcctaggacgccactgtggctgaggcaagcgactccgctcggccatatctacatcagtgtgcttcgtaaacgagaggtcagtaaagcaactccatgtttccatctgtggctctacaactttccacaaagaaccatggtatgttcatagttgatatgcattagaattagagattttagtatcagggtaaattagttctctttggtcagaagtttcttggttggggggagaacatattttgaatttgttgaacctcttgcagtcccgtttgtgcttgatggtacagattattgtgaagatttatttgccaggagtcatctagatattctaatgccactgtgcagtctttgtacaaagcaaacgaatatagtgttgcaaactctattgaatcgacatgttgtc

SEQ ID NO: 6411 - DNA, 1501 bp, Oryza sativa
tatgttaaactatctataatgataattattttgggacggaggaagtaatatacaactggttgtatacaagcacgccatcagtacccagtatcacttagctactatatattaattccagatgaccgtacgattatctattatatactatattatatactaaaagttcattaaacttcctagaaacgctcttaagtcgtcatgtggcgctctataaacactcctaaatcgccatgtggcgctctgataaattagaaaaaatcctagaaatttttttaaaaaaagcatctcaccattgattttcacttaaatcagtggacccattagttttaaccattagatcaattttaaagcaatatatactcaatccaacatatgggcctactagatcgatctcacagaatatgtacccttcccttcccctgccgtacatgccaacgtacgtatgtacgtaaatatgtgatacgtattccatatgccctccccttttctcctattttctaacaactcattacaaaatagtttaaattttaaatagctaaataaccatgattctcaatttatatacaacatttgattcatttgtactattttcatttgtaattaaataaatacatcaagatcggtattgcatatattttgcgaaggtaaagaaaaaactgaaatacgtttggacatagaccctagcatgtcagtcattaaacaatataaaaaaaattgacaacaactatatcatcttaaatcattctatatatacatatgcacattaaattaaatatcatgtaggacacaaaccatcacccttcacatcttaaaaattaagaaatatcgttgaaattctatgagaaataaaaagcaaaacatcctactatcattttacacttaaatcggcagacgtattaatttcagccattagatatatcattctactctcataagccgctacgtatcacatcttaaaaattaataaaaatcacataaattctaaaagaatgaagcatccgacctcaataaaatcattatttcagtcattagatctatatttaaagaaaaactataaaaaaacaaagtaccatcccattccccctccccctcacctggattaacaaagctccatctttatattctgaaattataaatatatagtaaatgaataaaaatatcgtgggagtatataagcatactaacaaaatcatggagtagggaaatcgtcaataattaactcaagttgcacgcattagatttttaacttatgtggtatgaaaactattctacatggaccaacgggagtgctagaaaggtccattaggacacttccaaggctacacgtggccgtcgatggagacaacaattaataaaaattcatacggaaaagcgtaattttgtagtagagagagcatgtctaatatcatatcacgaaaagacaacctttcatgagaaataacatataaactataacttaaatgattatctcaactctcctttgtactatgttatttgtagg

SEQ ID NO: 6412 - DNA, 1436 bp, Oryza sativa
agaccatgtttagcctttgcatgattccttttcagagtccgtagtgttgagtttgagtcctagtctaaattcctattgctggtctaatgcgtgttttagtctagtcgtgtgtttgtcctttcgtaaccctagccgctacctttcaccgtgtgctagggttcatcctttgagagccgtttccgccatcataaacacccatccagatcaccaccagaacaccctacaactccgctgccaccatatccccaattccaccgcaaaatagactaggttatatcccctttggaaaacctagccagaagccgaaacttcaaacggccataacttttgcatacggactcggaatcaggcaaaatttaacttttcagataagagaaaaaaattttctcaaaaattccaaaaatcggcttgcaaaattttcggcgggtttggcgaatccaaaattccgaaaattggcttgcaaaattgtctgttcgagctcacaagttcctgcaccttgtttatagtggtttcagaaaaatccataggccacatacctactccgattaagctgtaacttggaggtctgcctatttttgtgttctgaaaaaagaaaaaaatatcaaaaaaataaaagaaaaaaaaagaaaagttgatttccactagtgcattgagctcatgacgcgctccgttgagcttatttgccagttcggttttgtagtttttgctgaaactcgccgaagcttgcctgccagtccttctttgctgtttactagtgtcatattctttgagccatctttgttatcactactgtctaggacatgagtagactagcaactatgggcaagtgacttgggatttttattcagcattactatctgtcattggattgtgtaccactcatatacatatatttggccttcctagctccacatattacttctgcacagcacaggttcttgatccctgcaatcgctgactacgccttctaggtatcctttgctttgctggtaagaaccttataagagcttggttaggaactccatattgcttagaatcgttgagaggcaccactacacctgcgtagtagattattagggataaccttcaccattttgtttatgttttggtgtttcaatgtcaggtaacgaaggtgagaagagtccctaggattttgctgactgtgtcagccaagagcaactacgaactctccaacaaaatactcaaaaggacatcacggaggccgttgcaaagtctgttcaagatgccttcactaaaatcggtttcctgaaccacatggagaggttggacaagcggatatccacgctatctgatcaggtcgccgcgttggagacaccttccaatgaggaagtggtgagtggtgacgacgatgctcatcctgaagacacggtgtatgattccagtggctatattgatgcactggctacaaggcaagc

SEQ ID NO: 6413 - DNA, 1501 bp, Oryza sativa
tcaacaattaatgaaacaaaacctgcagtattggtagctgcactcgtgcactcgcgtgaccaacggtacgagtgagatgatcatcatacataacccaatcaaatactatctccatattttaatatatgacgccgttgatttttttgtccaacatttgaccattcgtcttattcagaaaatttatgtaattatcatttattttattatgacttgattcgtcatcaaatgttctttaagcatgacataaatattttcatatttgcataaaaatttcgaataaaacaaatggtcaaacgttggtcgaaaagtcaacggcgtcatacattaaaatacggagggagtatatattattcatccaaacaagctagccaaaaacaagttagctagcttaccaatttctccacaagaaattcaaaacatcaatcaatccggatccaaggacccaagagtgagctatttatcacacacacacatgcatgacccacacgatcaattcgaaggaaaaagggaacttaattagcgcgaatatatctaacatatgcatatggaagaatcgatcgatctcgaatttgtcatggatcaaatcatcatgtatatcatccgtcgtcgtgcggcggcgatcggcggacgagcagctggtggagctcgtcgcggatgtggaagtagacggcggcgaggaggtcccatagctccggcagcacggcggtgaggttccggcacgacggcaccagcgccgggaacgggcacagcatcacccccaccgcgaacagcgtcgcccccgtcaccgccgggcacatcgatcgcgatttcgcttaattttctactaactaaaaccatatactaaattaagccactgaaatgatcaatcggatttagctaatgttcaagtagcagcagcagctatatatacctgagttacgcttcacttcagtttagagcaagctaggtagaatgtgttcagttaacgccaaaattaaaagtttgattagaattggaacgatgtgacgaaaaagttaaaagtttgtgtgcgtaaaaaagttttgatgtgatgaagaaattgaaagtttgttgaaaaaaatttagaactaaactcggccctactagctactgctacatgtgatgtgcaagaaattaggttacttctaaaaaaaaggaaatttggttaggtagctcagtagctgtatactatgctgtgctcatctgcacgtgccaggtttgactggtagatatgatcggaccggtagctgagaggcccaataacaaaagggcctatgtgtctcttcaggcccattataatcggcccaatattcccattctaccaagcggcccaagccagacctagggtttgttcggggtggtatatataagcccccaccaccccaacccgcgtctccctcgccgccgccaccgctcgccgctcctctctcgccgccgccgccgccgccgccgcagcgaggaatctccggcgaggacaccaccgacgcaagcatggccgacacga

SEQ ID NO: 6414 - DNA, 1501 bp, Oryza sativa
tagtagggccgagtttagttctaaatttttttcaacaaactttcaatttcttcatcacatcaaaacttttttacgcacacaaacttttaactttttcgtcacatcgttccaattctaatcaaacttttaattttggcgttaactgaacacattctacctagcttgctctaaactgaagtgaagcgtaactcaggtatatatagctgctgctgctacttgaacattagctaaatccgattgatcatttcagtggcttaatttagtatatggttttagttagtagaaaattaagcgaaatcgcgatcgatgtgcccggcggtgacgggggcgacgctgttcgcggtgggggtgatgctgtgcccgttcccggcgctggtgccgtcgtgccggaacctcaccgccgtgctgccggagctatgggacctcctcgccgccgtctacttccacatccgcgacgagctccaccagctgctcgtccgccgatcgccgccgcacgacgacggatgatatacatgatgatttgatccatgacaaattcgagatcgatcgattcttccatatgcatatgttagatatattcgcgctaattaagttccctttttccttcgaattgatcgtgtgggtcatgcatgtgtgtgtgtgataaatagctcactcttgggtccttggatccggattgattgatgttttgaatttcttgtggagaaattggtaagctagctaacttgtttttggctagcttgtttggatgaataatatatactccctccgtattttaatgtatgacgccgttgacttttcgaccaacgtttgaccatttgttttattcgaaatttttatgcaaatatgaaaatatttatgtcatgcttaaagaacatttgatgacgaatcaagtcataataaaataaatgataattacataaattttctgaataagacgaatggtcaaatgttggacaaaaaaatcaacggcgtcatatattaaaatatggagatagtatttgattgggttatgtatgatgatcatctcactcgtaccgttggtcacgcgagtgcacgagtgcagctaccaatactgcaggttttgtttcattaattgttgaatgcttttacgtcctgattgtttcagcttaagattattataatctatattattaaattagattactttaagctgaattataataagctaatataaaataagctgcgagttgtttgtttctccggattattgaaggcatctaagggtagtgcgtcattaaccaccaataatatgaaaaaagcttctccaaaggagattattagattatagtaatctggcttacaaattataataatctatcataataatctacttgtttgtttcagcttactcataataatttagattataataattttaaactgaatcaaataggaccttagccttggttgcatctatctattgagtgattgagttatctggatcatatgatatgctatttggttagtttccgatgga

SEQ ID NO: 6415 - DNA, 1501 bp, Oryza sativa
  unsure (1)..(1501): unsure at all n locations
gagaaccgtcgctggatcgacgaactcatcattgaccgcccaacacgccaaatcgagctgtgcggcaccggatagagcacctggtcatggagctccagcgcaaccgccgaatcaaggtactcgtcggtcgctgactgagcgtgtcaccattgagctcaagccagcaacaccgatgacacgaaatgtctgagattggtgccacatcgccgccgccaagatcaacagatccagtggctctggatctatcgccgtctctagatcaaagagagagagagagagggagggggagggggtagnaaggagagcaacaagaaagatgagggtggggagcagagatttccccatggagcttaccgcgacactgccgatgagcctcatgtgctagccctgcccttgcctccgggtgaccggatccgccggcaaggaggtcgtggctacccgaatccggcgagcacggtctaccctccgccggaactggcctcgcggtggcaagggggaggtgcggcgatttggctgggtgcaanaagagtggtcgtagccgnaggcgnatncgncggtgtggtctagggagagcgagcgagaagagagaggtgacggaacggcggcggctagggtttcgtggggtgagggaccgggatagggatgcaagttgttgcagaaaagccccttagtttctatgttttcgagcgcagtcctattttctgttttttgcttctttgattagaacatttcatttttagaggtcctatacgtaataacgtagaacgtagaaactgtataccagagatctaaaaccaaattatcaattagtttaagggcttttttgcaaaatgatcagcgtcgggcaggcatggacgcacgatgggcatccaacgacggaggaagcaagcaacgcgcagcctccaaattcagctccggagaagggccggacgacgtgtcacgccccggcaagggccacgccagcggcaaacgctgattcgaggctcaattctcggcagctttgtatataagcgattgggtcttactcttaacaggaaaaatgaaaatttgtcacgtgcaatcctcgtgtcctaatccagccgccactgttcatgctcttctcctccgcccgcaacgcaaccgaaacctttttcttcctccgccgccgccaccaccccaccaccgttgctcgccggcgcgattttgcacactcgtcataccggagtgctcgctcgctcgctcgcggtagggataacccggccgggttaggattccgccatccaagggggtgggggaggggtgtgcttgaggcgcgtggcttcggtttttcgtgagaggaaaatccacggcctcgccgtgatcccggcggggattcgtggtctctgaggcactggtagagtggtaggtaggtaggtaggtaggtaggtagctgctgcgcgtgggagggggggagactccattaatctcgcgcgtctagggtttgtttgtgtgtttgtttgggtgggttccgtggtggtttcaa

SEQ ID NO: 6416 - DNA, 1501 bp, Oryza sativa
agtatagagctaattgaaattcggagttgaaaataagaaaattaaaagtagatgttagaaaccatatagaaatacaattcataaataactaaaattcgaaattaaaaaataaggaatattggaaaagagtatagaatccatatatgaatacgatttagaaataactaaaattcgaatttaaaaatttatgctccaaagaataaattgtttggtcaatttcatacataatttgaaattatgtttgtgtgtgtgtaagaaagtatattgatgctaagtgtgtaatctgaacggttcaccatgctagtttagactaaaagaatagtccatataatttggaagaattcttcccataagacttttatgattaaataagcaattccaatgtcatcagtaaatataaatttttctcttcttttcagaatatgcattatcattttacgatggtttaataactctgaggttcaaaattattattaataccttaataattttatgtttttcattaacatttaccaagttgtactttataccaactcattgtacttataacggttattatttagtcctaaaatcaaaattacaaatattattggatacaaatatcagtcccttggatgaaaaacctaaccaccacttttaccagctgcattcatatattaacttattaaagtaataaagaaaggagcctgcacgtttgctctaacggcctagaaattctcatgttggaataggagactagagtccatacaagtatacaattttgagcaaattgatattcaggattaaaaaataagaaaattaaaagttagcgtccatatagaaataaaatttagaaataactaaaattctaaattaaaaataagcaatattgaaataagagtctacagtccatatagaaatataatttagaaattaccaaaattcagaattaaaaataagaaatattgaaagaaacatctagagtccatataggaatttagaactaattgaaagttggaattaaaaaaataagaaaactaaagtagagcttacagtgcatatagaaatacaatttagaaagaatcaaaattaaaaagaaagaaagattaggataagagtctagcgtccatacagtaatataatttagaaataattgaaattcgaaggtaaaaaaaagaatattagaagaagagtctatagtccatataggaatacaagttagaaatacctaaaatttggaatttaaaaataaaaaatattgaatgaagaggtagaatccatatataaatacaatttacaaataacagaaatttggaattaaaaacaaggaatatggaagagaagactagagctcatacagaattacaatttagaaataactgaaattcagggtttaaaaataaggaatattgaaagaagggtttagagtccatatatgaataaaaaatataaattgtgaaacttaaaaattttaaaataaggaatttatattagaagaggtgtctagagtccaaattggaat

SEQ ID NO: 6417 - DNA, 705 bp, Oryza sativa
attatatttctacttttttttctccttttatttttttctaattttgaattttattttatttttatttcgaattttgattaatctcgtattgggttcttatatggaaacttgttcaatattgcttctttttaattccgaatttcagctatttttagattgtatttctacttggactctccttccttttttgacaaaaacttttggtaggctacagaattatttccagtgatctatcgtgtaggtgttgatagcaagatggatgaatgcacgtgattttagagtggcagcaagattatctgggcaagtgaacttttggtagctacaaaatactcttccgtggactgtgcatcttttttgttttcctttccttctgtggattgtgtttttttttcctttttgtccacacccaatcggacatacccttgcctagatactattaggactctgacatgcatgatgcatgctcgttagaatttttgtttcgtacttatacctttcctatttatgtattatataaatagagtttgtttcgtaccaatagaaatattgcccaacaaatctacaccctttaatctatatgcactatataatctaaaggtgtagcttttttctctttttctccgattaatgtgggaatttctagcctcaacagcgaacgtgatgcctcctttcaagactgttttaataatataatagatagattcc

SEQ ID NO: 6418 - DNA, 1501 bp, Oryza sativa
tcagggaaaccaagaaatgctcaagaacaaaccccaccaaaacccccccaagaaaacctccaaggtgacaaacaagaacgccatgacggcgaaaaacggaaagatcggagccagccaaccatcacttgctcccgatcatcagaggctcccgataccttctccttcttcttccccttctggccgaccgccgcagcggcggggctccatccgtcggccccgcggcctcctccgtctccgggctgctgggggaggcggctcccgacggacgagggaggcggggagacatcggcggcggcctcgggcggcgcggcgatcgaggtgggggcggcgctggagatggagtcctcctgggcgagatggggctcgtgctgcccatgtacattggcttgtgcggggccggacgcgggcgacatcgaagcgggtagagcggcaagggctaaattgctaattccgatgattcgagggggcggaggcgaaatgtttggagggtttcgttgttaattccaggaattgcaggatgctatttataaaggtaacattagtgtacgcagttggcagtttgctacggagtagattcgagaagatggggttatttttgcagtttagtccttccctttttcttcaactaaagtaatttaatccgatgtgcccgtaactcttcttttttttctcacatttactggtttttgaaactgataaaggtggatattaagttgaacacgtaaaattagaaagctattagcacataattaattatgtttttattattacaaacttaaaggaaattgttatatttgatatttaaagaaatttatatgtacaaagttttcgaacagaacacaccgtttacttatttgaaaaacgtgctaacagaaccaaagtaaaatctgaatcttaaagaacagtgttaagctggccatagtgaattatcttcttttcaaaatatttttttaaggcaacctcgacagcaaagatatgtgttcttcctcaagtttttccaactcaactatctcattttctgcgcgcacgcttttcaaactgctaaacggtatgttttttaaaaaaatttatgatactcgttattgcaggattataacgagtatcataacgactatcagtttctacaagaggcatgttatctataatattatattatagagatcgacaagtatgtgttaaattatcttcctcacattattttttcattatttaaactttcatcatttcaataatatttaacatatactcatccattaatccgcagcaaagcgcggggtattactgttgacgtttgatgtcgcgattccggtatttgcatagtatgaggatcgttggtactataatatatgcaagattgtagtaaaagagacagagacgaggatttttatacaggttcgggcccctgaattgttaggtaataactctacatcctgttggccgaaaccggtgttgctttttattcatctggatcacacaagtacaattaatatttggggtagcc

SEQ ID NO: 6419 - DNA, 835 bp, Oryza sativa
aacccaatacgagattaattaaaattggtagattaattaaattcggaataaaaataaaataaaatccaaaattaggcaaataaaaaagagagttaaagtaggaatacaattttgaaacaactaaaaatgaaaataaaaaataaaaatatcaaaagaacacaatacgaaaaaaataaattcggaaattagaaaaagaaaaaagatttcaattaggaatacaatttataaataactaaaatttgtgataaaaataaagactattgaaagaaaagaccatctagaacacacgacgacataaattaagtatcatggctataaaggagtagagtgctggcggttgatacgacatataaaaactgttaacaaaacaccaaatagaatcctaatgacgattaaaaggagggacgacaagcatgctgtgaagcaaacgagcaaggcgattgtcgggacttatagaaagtaaaaaaaaaactattgataatcatatttgaattttaaaatctcaatgaaaataaaaaagagaagcagcgggcggggtgtataggagtatagttgcagagctgccgacagttgacgggacttctagaaaataaaaaatgaattccaacgatagttatgttcaatttttagaatcacaatgacaataaagagtaggcggtggacgggccgtagaggagcacagtggcatcgtttgacgagacttctaaaaattataaaaaataaaacccaacaagacaataaactctaaaaactacatggttcaatttttaaaggttcggaacttctaaaagtaaaaaaaaaacaatgataataatgttcgattttaaaatctcaa

SEQ ID NO: 6420 - DNA, 1501 bp, Oryza sativa
agatccgccgccgcgccgccgtcgcgcatgggaggtcggtgaagggaggtcgccgccgttgctgagcccgccgctgccgcgccggatgggaggtcggggaagagaggccgccgctgcctgtgctgagcccgctgcatgcccgtcgtccagacccgccgctcaccgctgtcgttgtcgcattgcccaccgccgtcgtggaagggaggtcgctgccgcgcatgggaggtcggtgaagggaggccaccgctgttgccgagcccgccactgccggaccggatgggaggtcggggaagggaggccgctgccgccggtgccgagcccaccgctgacgcgccgctcccgctcaccgtaccgcgcagcagccgcccctccccatccgtgcctcgccgtcggtaagagagagagaggagagaaggaaagagtgagaggctgagaggagaggagaggagaggaataggataaggatggggaaagttaaaatatcaggagaggaggggagagagaagaggagatgaaataatttgaagggaggagggaaaaattaattttaaaatattgaaacttcgaatagaattttatcatactaaatgaactcgtgtgaaaaaagttgtaaaaaaaagttgtagaactcattgagatataccaattttattttggtcatttctccatccgagtttgattgaactatataaaatttaaattttaaaatataagaaattaaaataatttttcaggtagtgaatgattttacatggaaaaattatcaacaataaagttgtataacttatcaagatgtataacttttgttttggttatttttctatatgactttgtttaaacagtttgaatttggattttaaattataacaatatcaaacaacatttattacaagtactaaataaattcaactgaaaaagtcatcaataacaaagtggtataactcatcaagattatttcttcatccgacaaagtgatagtaacattttcacaaaatttacatatctctcttatagtttataaaactatttgtcggatgaagaaatgactaaaatagaagttatatatcttgatgagttatacaactttgttattgatgattttttcagctgaaatcatttactgctttaaaatactatttgaagttttaaaattcaaatttttaattgataaaacaaagtttaaaaaatggcaaaaataatagcagtaagaacacagcaacatgatagagcatgattttagaaacatttaggaaaaagaattatccaatttaaagttcatatgagtgagataaactagtttcaaattttttaaattttattttttgatacgactccttaatatgcccgtataaaaaaaatcgatttttccatgcgggcggttaagtgagccacatgcaaagaggcctgtataagaaaatcgatttttctatacgggcgttttaagaagccgtccgcaaaaataccgttcgatttttactgacgcccctagttatagttatga

SEQ ID NO: 6421 - DNA, 166 bp, Oryza sativa
tatataatagtaacaggaagcttagtacgtggcctttttttttccatttgactataggtctgctactatgcttcctttctctagatcctttcccaagacctgaaccctgacctgggtcatcttttactgtccaatcctcactctagatccgacgttatctattgaa

SEQ ID NO: 6422 - DNA, 1501 bp, Oryza sativa
gcttggccgagcttcaacttttaacttttctatcacattaaaacttttctacatacaaattttcaatttttctgtcacatcgttctaatttcgatcaaacttttaaatttagcgtgagctaaacacacccctttataacagcgaaagcaaagaacccaccaatttgagcaaaaacaacagtcctatgcacagttattaagaccggaccggaccgaaccggcgatcggaccggaaaaaaccggaaccagagcccccaccggtccggtccaggtggtcctatactcctatggggaaaagggaaaaaaagaaaaaaaaaagaaacgacccaggcggttcggcgtgaactgggccttgggcgggttgggctcgagcgaagacgttccctcatggcaccgcttcccctccccttctcgctcgctctcctccgacggcgccgcttcggcgcttcccgacttccagcggcgagcagccggctgcggatgcgcccgcgctgctccaggaggatctggatcccgctggcgtagtctccgtggcatcggcggcggcggccgggcggtgggaagcttcagctccggccaggtcgacggcgcgctcgccgccggcttcagcgaagaccaccaggtatgccccgcctctactccctaggtagggtctgcgcggcgtctgtaggctctcggactgaatcgcgtccagctatcgagttttgtcccacatcgccaattttgagagcgagcgacctgtttatcaacgcggttcgattctactccatcgcctccccagaggcacccaccccgaccgaatacagcgaaaagatcccaaatgtgggcatcggctgggtgtgtatccccttccggttaatggctgtaaaaaaaaaaagataaaggagcagtgaaaagatcccctcccgttatggggcacggcaggcgaccccctgccggttagctgcatccacgttaagatgtcaatacggcaacggtaagttgtcaaatacggcatatgcatgcagtcgggcctctggtggaaggcagcgctagacactagcgcttagcttttttaaaatttggatgaaatttttatttctgttgaatcgttttttaattccttgtcttaagccaagagaagcttaaataaggtgaatttggatgaacttttttttttctgttgaatcgtttttcaattccttgtcttaagccaagagaagcttaaataaagtcttaaaacattaagatagggtaggagatgagaggagatacttgctgtgttgatatgcccttactgctagcaatttcgccttaagacgcaaaacttctaaccgactgcatttccaagtttcgactggatgccggtcagagatgacttggcagatgaataattttgatcttactctgcagatactatggttagcatagtattagtaatgctttgtcatttgttcactgaattttggcttgtatgtagttttgtttttaatagtaaatttctctgtaaaatttgcacttat

SEQ ID NO: 6423 - DNA, 1501 bp, Oryza sativa
ggaatattacctacatccctaaagactcttccttttccctttaatatgagatgttaatagctagatgagacttaagtcatattcctctaaacctgcctaccgaatcttgatattgtagagtagggcagccaggaatatatggcaactatccacaatagtgttgctgatggtgatggagattgtaaaatcttaccttacctacagagatcatgatttttttagacttggaaagaagaagagaaaaagttaatggtgtataaaaacaagctatacaaattgaaagaaaaaagtgcatatatctatatctaactggtctaatttactcgagaaagatgtgaggattcgaatgaacatctttacaaagagaatgctccaattgtgatcacatcaaatgcaatgtgaaataactttagtttcggcataaatgagaaaaggggttcgataacgaagaatgatatatgtattcagagcgcatttacactctcatggaaacaccaatgtggcaacctatgatgaatattataatcatgtgaataagcttaacatagttttaaaaaattaaattataagagaaaaaaatgccacattggtgtttactgttactattgttaccatggatccaccaccataggatgcgtgggctcgtcagtggatcatcaaaatgagaccctcactttacattttttttctcttataatttatttttttcaaactatgttaagcttatttacataattattctaatgaattatacacatttttttttcatattttggaaaatacatatttctaaaaaatatattactagagcaacttgttttaagatagtactccaagttgttaagcttattccaaaaccatgtaaataatccgcgacaataataatccgtttggcaatctaaatcaaacggcgcatataggggttgtttggttgatggctaagtttactatacctcactttgccacaagtgtgttatgccacacaaagtgaggctagcaatttgttagccacaagtgtggctaagtttggtaagaatttgagtctataacgcataggcccaatgactagtaaagtgaggcatgacacaagtgtgacaaccaaccaaacaatatactaacaaattgtgacatgtctaaggtttggcatggcaacctttgagagccaaccaaacagccccataatacatcgcagcaaatcaaatgaaaatacaactcactttttgcagcaaaccccctcacgatcacctaaatttcgaaaagatcctcaaagccccaacccttcttctccatcgcgtcgcctataaatacccccctcgccttcctctcacttcttccgccattcccctctcctcctcttcttcttctccaccgaataaacccccgcaaaaaggtggtgagttcgagagagagagagagagagagtggaaggctagggttagggttagggtttcctcctcgccgccgtcgcgtggcgcgatggccgccccgccgccttcctccc

SEQ ID NO: 6424 - DNA, 1501 bp, Oryza sativa
acatcactgtcagctgagcccggccaaatctcgaccaaacgttcaagcgcagaggaaatggcatccccctatcctgggcgaactgaagctgaattttgatggggctttctttgatgaaggcaagaccggtggatggggatttgtagtacgggaccatggtggccactgtgtgctagctggagctgggagaattgagctggtgcatgatgctttgtgtgcagaggctatggcatgtctttatgctctgcgcgccgcagcaaacaacggaatttctcatgtctcagtagaaactgattgctctgtcctagtgcgagctctcaaatcagctgattatgatcaagctacggctggtgtcatcttcaagtaaatcagattgatgtctttggtggactttgtaaaggttgatttgtctttcgcctatcgattttgtaatagttgtgctcatgaactggctcgtcgaggggctaattgggacccgggtcagatgtccatttggactaaccccctcccgtgttttataagatcttttgtggttcgtgattacactgaaccagcgtatcaataaagagcacggtttgagataaaaaaaaaaacatcactgtcagcagcagacggatatcaagaggtgggccccacggggtcgccgtcgttgaccgccgacggggcctccaccgccgtcgttgcggacacgtgtcgggcgatgcggcgcggtaggcaccctagctagccgccccctactacttcactttcagttggaatgcatggggtgccgtgctgctgatcgacctgggccggcggttactgcagttacgttactctctctatgaccacccctcgattccataaaaaaataaatctaagatagtactactccatttatcttaaaatataaatatttttattataaatctagacaactgtgtgtctaaatttatagccaaaaattattatattttgggacgaaggtattataagatatgacatatcctaatattattacttcctccattccaaaatataaagcacaactactattaatctaaagactaagaaaaaattattatcatcttgtagtttggatcgtcctagtaaatgtaatgtatgcatccaataaaattagataatatgaaagtggagtatttaaaaaagtagtaatttaatagagaacatgtcatagttaattacatgcttgtatgcatgtctatattatgaaacatctaacaaaaaaatagttgtgccttatattataaaatggagtgagtataagcttataatagtattaagatgtatcacattttattttttgtttgtttgttttttataatacgaagaaaaataaaaatggttgatatattttctacgagtactgcgaatctagaaatgcttcctatctatttatatactcctatgtcccataaaaagccaatcctaattatgaacctgtattcgttggtatgattagattttttatgggacggagtgtgtacgttcttactccctc

SEQ ID NO: 6425 - DNA, 166 bp, Oryza sativa
ttcctgcagcccaggcgttggccgtacgcagctcgccatcgtcgccctttaaagtgcgccattgccgctccggtcgcggcccctccctttcccaaaagcaaacaagggataggtttgccgttcagcccccacccagagccagcggactgcacctcgcagtccggca

SEQ ID NO: 6426 - DNA, 463 bp, Oryza sativa
catatacatatatatatatatacatctatatatatatatatatatgtatatgtatatatatgtgtatagagaactactatacagcgctataggcgctacctaactaggtggagcgacacacagtgccaccaccctcgtgcaacctgcctccccccccccccccgtccacataacgcagttaaaatttaactcatagtaccccacccctgcgccccctcccccatgctcatagttctagtaaatttttaacttgatgttacccaacttttagcatatatatacatgtgttgttcccccatcttgtaaccaaccacatatcccgatcctactttttctcactttcatttttttatcccgatttacatggatctggcgacggtacggcggtggctaccgcgcagagaggccatcccgagtggtggccggtgacagggcgacctggtggggaggagcaacggcggca

SEQ ID NO: 6427 - DNA, 1501 bp, Oryza sativa
caccaaaattttgcaataaagggctatatgatttttcactatggtatcactacaagagatcttatgatagatgatgcttcatttacgtcgtaaacattaaatttttcgtcacgtttcgtaatctgtgacgctcgcgtgacgaaaattcattcgtcacttattatgcgtctctaatggcgttcaacgatgaaaccttatttttcctcattaatctagtgacgatcattctgtcgtcataactttgtgactctcatattcgtcattatctagctaaaaaacgtcataaaatatctgatggcccattaaaatccatgtattgagcaccctatttataggcttagcccaatggcaagcccgactaaagtttagcctggcccatctatgttgtagcatattttcagcccaattctattgtatcaatttgctttaatatcaaataataaatgggtcaagtccattgtaaaagcccatataggcccaaacatgtaccacaccattttcagcccgtcatattatattcatttatattaatatcaaataacaagtgggctaagcccatataagcccaacaatcaaacacaataacaacccatatagcacaacccgacaaacatccaatataacacaaatcttacaaccaggtaacagccaaatctagacacattccaaatacaatcccaggttcatatgtaatattaatcatggtagcaaagctgtagaaaatgtaattaagaaggccacatttatggcaaggaaaattcagtcacatcttccatcgctaggagatacaaccttgaagcatgcatcaggcctcggtgatagcacataacctgagcatataaaagcagttttgtaagacatcgtgctcaggaaatcaatcacgatgcaatctgtttttgttaaatctcttccagattatgaatggtgtttgattgatcataaataagccatattggaagcaagtatgggagttgcggctagaagatatcaactttttggcagagaaatttagggtttacttcgaggctttttgttgtttggtgtttctctagatcccaacagtcagaccggcattacgcgagcggtataaccagccagtggtctaaccggcgttaggcaagtggtcagatcagcggcggcagtgcgcaacaggcatgtaggagcaaggcgttgtatccgtcgacaacactctggtttgaccataggcttctatatggtcttactgacattgatcttgcaaccagcacaacttcatcaggtttgagagtaactttcaatttccttaaacattttcggtttttgatgatatcctaccattcacctcctctagtagcttaattcttgtaattcgatcctacacattatgttataatttattaaggacacgacgtatcttcacatcaattgagtacgaaaagatcaataaacttttttgtttggttgatgttctctagagttactgattacctgtagcgcccgttccgtcgtggcacctagcggg

SEQ ID NO: 6428 - DNA, 1501 bp, Oryza sativa
agtttcttcagtgcaccaacatgttgtccaagctcaaagatgtgtcccaagagatacctagaacagctcagcatgactttgcaaagggacattaaaaaaagagatgcagtagattctaaagggggtgagctgggcaaagaacacaactgatatcacaatcatgggggccgcaatgtttatggttcaacatatattttgtgttcaacctgtccatcaaactttaaccttcgaggtggcctttctcttccataaccaatggaaatgaataggtggttgcatggcctgaaagtttggggcataaaacttttgagaagagtacttaagatttccccaaatgtaagcgcaaatatcattctcctgagaaaagttaacctcctccgacattactgataaagtaaaccaaagagtaagtgatctatactctacgatccgttctatctcttaactacctaagacgaggataagctaaaagccccatggggagtaaggtaagagaggtaaaattactattgtcaacttattcaaattctaggtaaaacgatatgttgtaggcatagtgctattgtggaataaaacatagtagcaactcctaatgaacaacctaagttttacctttactcgaggatgagcaaaggtttagcttggtggtgttggtgatggtcgttaagtaccaatttcgatcgtgaactgccataataaacaaacggagaactaacatttcttgcacatatattagaattaaataatatagttcaacttgtattggataaatactatgtatgcagagattataaactaaagtgaaggagaaatgagccgacacccaaagaaacacacctcaagcgattcacgtgtgagcagacggattgatgggcccaaaagttagcttgaaccgacctaaagtgggactaaatcaccgggcaccgccttaggggcccacatatcagtcctcagtgaaatgtggttgagagaggtggtactgatgattcggcgaaacagttgggagtctcctgggaattagtaacattagttattaacataagcatggttcttaggttagttaaatgttgttagatgtgagtatgacccacggaaagtgaggggggtggcaggtggtgacagccatgtccatcctttatatttcttcacatccggctatgacggaaaattaaatcctagccttgtgaacacgtatgtacctgggtacctaggaacaaaatcctagccttgtaaacacatatgtacctaggtacctgggaacaaaatcctagccttgtaaacacgtatgtgttaagtgtatactagacattactagtatggaagtacatatgaaccttagctctctttagtccttctcccctgcttagtgtatctttattagagatgaatctcttgtgcgtcacactactcatatagcttgattaaggatatatgaactctacctttacaccaccgcttccctacggaaatataaatacgataccctttgaattctcttggg

SEQ ID NO: 6429 - DNA, 1501 bp, Oryza sativa
ttcgtactcaattgatgtgaagatacgtcgtgtccttaataaattataacataatgtgtaggatcgaattacaagaattaagctactagaggaggtgaatggtaggatatcatcaaaaaccgaaaatgtttaaggaaattgaaagttactctcaaacctgatgaagttgtgctggttgcaagatcaatgtcagtaagaccatatagaagcctatggtcaaaccagagtgttgtcgacggatacaacgccttgctcctacatgcctgttgcgcactgccgccgctgatctgaccacttgcctaacgccggttagaccactggctggttataccgctcgcgtaatgccggtctgactgttgggatctagagaaacaccaaacaacaaaaagcctcgaagtaaaccctaaatttctctgccaaaaagttgatatcttctagccgcaactcccatacttgcttccaatatggcttatttatgatcaatcaaacaccattcataatctggaagagatttaacaaaaacagattgcatcgtgattgatttcctgagcacgatgtcttacaaaactgcttttatatgctcaggttatgtgctatcaccgaggcctgatgcatgcttcaaggttgtatctcctagcgatggaagatgtgactgaattttccttgccataaatgtggccttcttaattacattttctacagctttgctaccatgattaatattacatatgaacctgggattgtatttggaatgtgtctagatttggctgttacctggttgtaagatttgtgttatattggatgtttgtcgggttgtgctatatgggttgttattgtgtttgattgttgggcttatatgggcttagcccacttgttatttgatattaatataaatgaatataatatgacgggctgaaaatggtgtggtacatgtttgggcctatatgggcttttacaatggacttgacccatttattatttgatattaaagcaaattgatacaatagaattgggctgaaaatatgctacaacatagatgggccaggctaaactttagtcgggcttgccattgggctaagcctataaatagggtgctcaatacatggattttaatgggccatcagatattttatgacgttttttagctagataatgacgaatatgagagtcacaaagttatgacgacagaatgatcgtcactagattaatgaggaaaaataaggtttcatcgttgaacgccattagagacgcataataagtgacgaatgaattttcgtcacgcgagcgtcacagattacgaaacgtgacgaaaaatttaatgtttacgacgtaaatgaagcatcatctatcataagatctcttgtagtgataccatagtgaaaaatcatatagccctttattgcaaaattttggtggcataatctacagctaccgtgagatatgctagaagggattaaatgtcttttaagcagtatggcggcagcaacatgcgcttcttcaa

SEQ ID NO: 6430 - DNA, 1501 bp, Oryza sativa
gaatgtatgtatttgaatttatatatacatgtatttatacatatatatgcataaatataaaaaagcagcaagcaataaaaatcattaaaaaacatttttagtaccgattagtaacgccaatcagtaggtcacgtggtcctacggtactaaagatgtttttttaagtcccgctttgtataatcaagactataaatattcatatttattcatgcattttgcgtccccattgcacaaacgggactaaaatgggctgtcaaccgggactaaagtgtatttccccagcaaaatactcttctagtaaacaataaatgcatattttttggttatctaagccatgaacttttttgtgatttgtgaataataccacacacaataaacccatatgaatataatagtctcctacatcaaattctacgcttctaacagtatactcgagaaatttatatgttccttcaatgactaagtatgtgttcttctcatccattggagggagctggttcctcacttgttatgagcttctaaactgctaaacggtgcgtctcgtgaaaaagttgtttatatagaagtttcttaaaattttcaaataatttattttcaaattagtaatagttaatttttgattaatcatgagttaatcatcactctcgtttcatgtttcttgtgcacccgttcagctccgctgaacagttcgaaccacatcctaataagggcaaaatgcacctatcttgcagctatttaacgctcaaccaacgatcaattgacataataataagtataaaagggataaaaatcaaaattcagtgctataccatggaataagtaaaactcgaggatatacaaggattggctaaatttgaaaggggcagataaaaaattttctcaagaaaacacgcttccctgtgcccaactgccgagctctatttaggcagcattgtctcggctatgtgcaaattattccataatcgtgagccaagtttgacagagatatgtagtacaattcaaagcaagcttgtgctcagtacactaggttgagtggttgaccaagaaattacatgctaaatatttcccccgtatccattgatataggcatgtatgatatgacgtttaaagtttgtacatatatataaatatttctacagtactacttacacaaaacccaaccactattatttagtgttgataacaattttataaataagtatttctgtcaattcagcccgattagaagttggtccatgctctttaatgtgggacacatcaaagtctttccctttcattctaaatctctaagaaaaaatatttatttatctgaacggagtatgtatataccatatatttgcttttggtcagatgattgcgcatctctctgtaaaatcaaaggtgtttttgattattattctgtgatgaacaattgggcattggagatttcataggtgaatcgcaggtttatcattttatgtggaccggtcagaccgggccggtgcggccggtcagaccggcg

SEQ ID NO: 6431 - DNA, 1501 bp, Oryza sativa
tgagttaatcatcactctcgtttcatgtttcttgtgcacccgttcagctccgctgaacagttcgaaccacatcctaataagggcaaaatgcacctatcttgcagctatttaacgctcaaccaacgatcaattgacataataataagtataaaagggataaaaatcaaaattcagtgctataccatggaataagtaaaactcgaggatatacaaggattggctaaatttgaaaggggcagataaaaaattttctcaagaaaacacgcttccctgtgcccaactgccgagctctatttaggcagcattgtctcggctatgtgcaaattattccataatcgtgagccaagtttgacagagatatgtagtacaattcaaagcaagcttgtgctcagtacactaggttgagtggttgaccaagaaattacatgctaaatatttcccccgtatccattgatataggcatgtatgatatgacgtttaaagtttgtacatatatataaatatttctacagtactacttacacaaaacccaaccactattatttagtgttgataacaattttataaataagtatttctgtcaattcagcccgattagaagttggtccatgctctttaatgtgggacacatcaaagtctttccctttcattctaaatctctaagaaaaaatatttatttatctgaacggagtatgtatataccatatatttgcttttggtcagatgattgcgcatctctctgtaaaatcaaaggtgtttttgattattattctgtgatgaacaattgggcattggagatttcataggtgaatcgcaggtttatcattttatgtggaccggtcagaccgggccggtgcggccggtcagaccggcgtgtattgcgcggtcagaccggcgcagcctgcggtctgaccggccgacactgtgtcggtttcggtttcgggttgtttatttggatatccgagtttatttcatgattatgacttctagatggatactatacgtatgtaatactattgtttgctgctaatgagtcaagttggagatagcttggtctcgtgtcgcgtcccaaaacaaccctaaaatatatcatttaaattatgactagaataattaaaatccttgtgaaagccttcaaaaattaaaatgtgcaaagttaaaagtcaattaaggcttggaggattttttatatttcctaaaagcctaaaatgtgtaaataaattttagtggaatttccagagcacaaataataattattaagaaataaacaaagttaaaatgattttgtaaaaagaaaaaccctaaaacaatccctccctccctctcttgggccggctcggcccatttccctccccctctctcctcttccccgcggcccactcggcccctccccgcgcgcgcgccgctgacgggcgggcccgcccgccaccctcgctgacgggtggggcccatccgtcatccccttactcccgccgctcccgccgtcccgcccgcgcctagc

SEQ ID NO: 6432 - DNA, 1501 bp, Oryza sativa
gaggagaagagccgaattgagttcatggctctcaaggtggtggtggaatctcattttacagtcgtggagaaacgcgtggatgaactccaaggttcggtggtggaattgcaagacaaggtcgagaagctgcagattgtggttcagcaggcttcccgtgagccattttctgctcctacgtctcctacaggtgctatttcccaccttaccttctcctgaattggatcacacatgtcacgcccggaaattcactagtaatttccgaactaatttgtgcataaaaatcctcatccaggaatcagccaaggtacacaaattgacaatttaatatacaaatccatcataaaaataaccgtacatacttacaaaagaaaagaaaacagcagcggaataacggtctagcgatggcttcagctccactcctacaggcagctcaactggggtataagccaaacgtcttctccttctggatcctttttgaggtttgatgattattgtaagaatgagcatatgacatactcaacaagccacacagcaaatatgcaagtgcacaaggataccaaaggatggcataatataggctcatttgcaaaagcagcatttagcaaagatttaaaagaagtaaaacagtagagtaattaatcagaaattttaatcaacactgaacagcacacccatgctgcacaggcccaaccatcctgaacaaccatacccggctgtacagacctaactccaaaccaggagctacacaaattattaccggttatagcatcaataattattgtgagaggtgtgagactaatcacgaaaaacattgctcaactcgcccataacggcgggcatggctattcgaatagttttactctggccagaggtgtaccactgtacccacaagacacagcctcaacatcatgtctaccatgcgtcgcgatactggaaagtacccgaatagaggctatgacaataccccctgcacaacacaactcaccacagtgcaccatttctggatcataatcaccccctctataaatataaccagaggcatggactccccagcgacctccacggacttctcaccgcttctcagtctggtgccccgcaatgaatcatgctatacaaaaggtaaagccattgcacatgctggcttgtggttggcacggttaatgtctcacaacagtagttcgcgaaccagtccttaattgtaatgagcacgaccttcacaaccatgtgctcacaacccaccattgacaaattttaattggcaataattaattaaccaatcacgattgaccatcctgagctaccattaaatataaccataagtgatagtgtaacattagttatcccaatcatgtgctaatgtttctaagcatggctaagcaattatatatatatagcatttagctgaacccaaactaatatataaggttctagctaataggaaaataaagtcatcttcggccattaattaattgggaaaggctcaccacccgatgacattcga

SEQ ID NO: 6433 - DNA, 1501 bp, Oryza sativa
cggtgagatcgcgttgttctcctctacgcgtaggtaccctccaaaagtccagtcgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcgtaactcggattcgagtggttcaagttgctaaattcatctaaaatcaaaatctacatgttaaaaatatccacatgtactgtttttgcttgtttttgtactgttttgttgattttgttcttttgttttagttaccgacgttccggaggagagtattttcgttgaggaaggttcggaagtgtttgcggaagctcaaggcaagtcacacagatcccaaacaaccctttgagcatgttgaacccgtttaaagctattgtttgatttcaacttatgcattattttcgaatgtcatcgggtggtgagcctttcccaattaattaatggccgaagatgactttattttcctattagctagaaccttatatattagtttgggttcagctaaatgctatatatatataattgcttagccatgcttagaaacattagcacatgattgggataactaatgttacactatcacttatggttatatttaatggtagctcaggatggtcaatcgtgattggttaattaattattgccaattaaaatttgtcaatggtgggttgtgagcacatggttgtgaaggtcgtgctcattacaattaaggactggttcgcgaactactgttgtgagacattaaccgtgccaaccacaagccagcatgtgcaatggctttaccttttgtatagcatgattcattgcggggcaccagactgagaagcggtgagaagtccgtggaggtcgctggggagtccatgcctctggttatatttatagagggggtgattatgatccagaaatggtgcactgtggtgagttgtgttgtgcagggggtattgtcatagcctctattcgggtactttccagtatcgcgacgcatggtagacatgatgttgaggctgtgtcttgtgggtacagtggtacacctctggccagagtaaaactattcgaatagccatgcccgccgttatgggcgagttgagcaatgtttttcgtgattagtctcacacctctcacaataattattgatgctataaccggtaataatttgtgtagctcctggtttggagttaggtctgtacagccgggtatggttgttcaggatggttgggcctgtgcagcatgggtgtgctgttcagtgttgattaaaatttctgattaattactctactgttttacttcttttaaatctttgctaaatgctgcttttgcaaatgagcctatattatgccatcctttggtatccttgtgcacttgcatatttgctgtgtggcttgttgagtatgtcatatgctcattcttacaataatcatcaaacctca

SEQ ID NO: 6434 - DNA, 1501 bp, Oryza sativa
taaaagagtaattgtcaatgtgtaatattagtgaaaacaatctagttaaatatacttacaacttgttgagaatatatgaccaatgtacgatccgcatgatccgcatttgaattatatagctgccaaaaaaatgaaataaaaaaaaagctacatatccctaaaaaaagactatagatgaaatacccaatttcttttctagtcaatgtttcaaggaaccaaaattatatacttcctctgttttataatgtaagtcattctagcatttctcacattcatattaatgttaatgaaactagataaatatatatgtttagattcattaacatcaatatgaatgtgagaaatggtaaaatgacttacattgtgaaacggagggagtagaatgataagaagaataaacatgttatgaattaagtcgcatgacagtaaatttaaatgtgatgtcaaagaagatagcccgaaaattatattttcttcgaaaaacatatatataataatttactatgtagtacattagccctctatagtaaggagtacttatatttcttctaaggaatacatttgtcttctatagtacaatttggaacgaataatgaaaagaataaacgtgtgtaagtatattaacctctctaaaccccgtaggatcggtgaaaagttagcacaccacgtcagccgatcttttgcagaaaaaaccccacgctttctattaactacgcgacagttcccgccaacgtcctccgtctgatctcacgataggctcgatctaaccgtccatgtgccctctacctacggcgaccccggtctcctccgcgtagaggtggccaaatgggccgggccaaacgggccgcgcgcggcacggccggacctgtagcaggcacggcccggcacggcctgctacagtaacgggccgtgccggcacggcccgtttagccgtgccgtgcttgggccgctggccgagcacgcgggccggcacggcacggcccggctactgtagcgggccggcacggcacggcccgcggcacggcccggcacggcacggcggcggcccgtcaggcgcggcaggcgggcggcggtccaatgggacggcgacacgtggcactaacggctatttgaccgttgaaatttgaaaataaccgttgggaggctaaaaaattcataaaaattccgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 6435 - DNA, 1501 bp, Oryza sativa
ctgatcaactcgtaatatttttactcctaggtattttcataagtttaataccttttagtaatatttttactcgcaagaatatttaccatgacatgtttttactatacttaattgagcctcacagtggccgtgagccttaagaaagtccctttagtaattattttactacaatcacttgaatgctcacatgtattagaatcatccagtcgtgaaggggagtaaaagagttactgacatgtattagtatcatccaatcattaagggagtacaaagttactggaccttacttaggccgtatttagttcactcccaattttcaacttttcatcatatcacatcacatctaaaactttcctacacacatgaactcctaactttccctaaactttcaactattttcaggaactaaacacagccttacatgagtagaaaaattacaacatacttcctccatcccagataaagtcgaaccctagaagcctgatgcctgatgcagttttagtccaagcaacaaaggaccaaaacaccctcattaagtacaaccacgattagcacttttcattaaaaaaaagttcatgtgaaattcgtgccaaactacttcctgaaagcctcccttcactggagatgatacggtgatttcatttctttttaattcacctggtgggtggtggacaagacaacacagggcaaatgataaagatgcaattagtgtttctcaatctctggcatagaaatcgatttattgtgggacaaacgatcgaccctaggaatcgaatttttgtgggacggagggagcagtcatcaggcctgatatatagtcagtaaatattttactgtacacgtgtaattggtcatgccatcaccgttacaaacacacactcatcgtccaaaaaatcacaatgcagaggacattagtcgccaagattcttccatcgtatgccgccggagccagccgatcatcagtcgtagagagctcgtccggacaaatccaagcctgaaacctgacgcaggcaccaaatccattaatattttttttggagctcaaattcgaaattctggccactgttcatttgtttttatacctgcccaaagtataatgatgttatctgatagcatctgaatatgtactcccatctgttccaatttaatgcactcaaatttgaccaaattaatactgataaaactaggatttcttaataaatagatgaactctagtttttaacatggaaacaagcagagcttcaacacccatgaattgatcaaacaaagaaaatagcacaaaatgtgcataatggagcacgtgcacatttaaaaaacataatcctaaaattctgagattaaatcactttgaaccgtttgtaatgagatccaagcaattttatcaaggattatatggtgtgaagagacatctacagatgtctaagaaaatcagtcatcgattgcagtggaaaagatttgggtagtttagaatcaaactgcaaatatgaaactattacaaaca

SEQ ID NO: 6436 - DNA, 836 bp, Oryza sativa
ttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcggaagaccatgataaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 6437 - DNA, 1501 bp, Oryza sativa
acagtctcagctagttaaatgaggaaatgaacataatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctgctacggctgtgctgccacagctagcacaaacaaacaacccaaatataaataactttggatggatatgacacatactaaggctatgttctttgcccagggttcccaacccctcttcttcgttttctacgcgcacgcttttcaaactgctaaacattgtattttttgtaaaaagtttctatattaaagttgcttaaaaaatcatattgatccatttttttaaaaaaattagctaatacttaattaatcacgcgttaatggaccgctccatttttcgcccggagggaatgagtttccaacctacatgaacgaatgcaacctaatactacgaatctgaacgaactattcgcttggattgagggccctcttgatgcttaggttaagatttagttaaacttttaattttctaactatcaataatttttgaaatgcttagtttgaaaccaaaagaattgttcagcatatatttgtcttaaaaaacctataatcatcataaaatttattagatcttaagcttattttgatataaaattgatattggaatttttttatgctttaccaaatctataaacgtcaaaaaaattattgaagagaataatatcgaaaataaatatgtttttattgaagggtataatattgtaaacttgttttcgatgataaatatttaggacgtcgaaaaatgatgagataccaacatcgttgtcattgatacatggttatttggccttagagcccgtatataattttctcttttcaaaaagaaaagaaacattatacttcattcgtcttagagaatttagattaataagacacgtcgtattactacgaatctaaacaagataaatatttctatgtgccatccaaaatccttatatttcagaaggaaggaaatacaaacgtacacgatcaccacgcgcacactgacttaatgtacacatttacatccctacttatatgagcacttttcaaagactgtgatgtgtcatgatgattacaatttcatatactttttacacttgcaagttggaactatccaaatttttccataaaaatgtaggaaaacgtgttcgcggtgagcgtgccattgtgcatttgtgctgccaccacattcacacgactaacatggttagcgaatgagaaattgctggacaggttcacacgacacgagtgcactccactagtagtggatggttagcgaataaagagaagagcggacggcgttatcaaatccgtcaaggaaaccacatctgaagttgtgaacccccaatccaattccaatc

SEQ ID NO: 6438 - DNA, 930 bp, Oryza sativa
cagacggtatttgtatagtataagaatggttgaaaccagggtataagcagaggtaaccgagatgggagacatagatttttatataagtttggtttccttaactgacaggtaataaccctactcattttggccaaaatcggtgtcttttatatatcggtatcacacgagtagatgtttgaaatgacctaatctggactttgttgacttggcgtcatagaggtctcacacctagtcgacagctagtgtactcttattcctcgaacatgaactcggtgagattgaaggtagttatagatccctcatgtctagctatgtggctgctacattgggtttgtctagataggtatttgcctctgttggcgtgtcccctcttttttttaggaggtcttgtatttatagtgaagattatcttcctctcccagtagaactcggagaaatataacaagatacgaactaagaaaactttatctttcccgattaggactctaacaccttatattccgagaagataatttccttttttatccgtgtatactattaggtatgttattttcatataccgtgaacccacatatatagaggaggtatgctttatccttacactgacatgaatatactacctccctagtccctatataaatatttgtgatttgtaacagaactgaataataatattaaagtttttaacattgatgtttatataccattttttacacgttacaaatacgacaaaatgtgagctaaccatatagggtgagaaacatatctaatccacagttagaagataaaattgatggcttgccacttgagtcttttttttaaacctaaggcggaagtttgttccacttttatatttagaagaagagaattgacctagtttataaggaaaaccgggcccaaaaaccataccattgcacggtttattacagg

SEQ ID NO: 6439 - DNA, 1501 bp, Oryza sativa
cgaatttcctgaattcgaaattgcactgccgagacacgagaaattaagtaccagcattggctccgtggctcaattcggcgtcaaatctcaagctcccgtcggctccgcccctctgcggccactcctcgatgttcttgtcgtacgtgccagaatcgtgccacccaagacggacctgtacatggtagcaggatcgcaggatttcatcatctctgactcttctctgttcatatggatgcgagagctgagatggcgcgggcgttccgtaccatgatggggtggcagtaggtggtcttgaggatctccctgatgtcctcccgggcgctcttgagctgcgccgcgtcggacgccgccaccgccgccgcgcgccatgcaccggaccaccgcccgcgcccccgcgccggcgcgcccgctcctcgtcgtcgcagccttctgcaggtgccacgcatcagtcaactcagaacacctcgattcaaccccccccccacccccaaaaaaaaaaaaacacgagccgagctaaaactattgcgaacctgcgggaagcgaaacgggcgggagcggaggcggagccccccggcgcttgtggagcagcatggaaaggaggcggcggccccggcggaaacgcgggggcgcggggggggaggggacggagcaggcgaggccgaggcacccggaagaagggaggcggcgatgcgctcccccatggcgcgcgcgctcgagtcgagtgagttttttcttctttcctttttttttttttggcctacttttttggaatttgatttggcacggccgagtcggcggcgaggggtgcgatgcgatgcgacgcgatgggttgccgttggtggggagaggcgtgtgtggcgcggcgggagcggagtctaatctgcgggggccaatagtgggtggacgcgtgggagggtgagttcgagatgattgtctttctttttctctaccttcgagatgtcgcttgaatatcggctcgattcaagtttggatagaaacaatttactgtattttgggttttctctccctcgtatttttcatggttgtagcggtagaatggttctagtgtccaaagtgtccttgtttcaaaaatgtcgtgcttggatatatatttcgtggggttacatcttaatacgcggaagacacgtggtgatgaaaaaaaatgattttacgataatggactatgtcctaaaatatagcaacttagaattagatgagactagtacgacgaatttggttagagatatggctcatctaattaggtgttatattttggaatagagggatttatagtagatcaaaagctaagaaataaaaacttctaaattgattctcaaaattaaaattaagttctaaaatttaaaaatagaaacccaagaaagtacgacataaattaagttttcacatagaatgctactattttatcattaaatgaatgctataattatagaatacaatgtcgaaaataagtgtatgtaactgttacacaagattagccatg

SEQ ID NO: 6440 - DNA, 1501 bp, Oryza sativa
gattcttagctttgattataggaagccagggaggcagtgatatgacggcttgacaaaagggggtggcgcgggtttggtaccaccggagccacatgaggaggctgctaatacagagtgacagagctagaaaatcttcacgcatagagagaagctaatgggaccttaaatatttttagtaaatcatatatccaacatttttaagataataataaagattatggagctagtctagggctgaagccttagttgctcatgcgtattttcgcctatgctaatatagtgagagtgacaacaagccacggctgtttaggaggcaaaaggctattacactactatagaaatgtcaaaataggactatactatatgtgccagttcataaaaaaacagcacttatgatcttttctcacccctcagacgcgtctaaaataaaaaccgacacctttgatcccttgcaagtgccggtttattaaaaaaactaacagggttataggtactaattgtttttttagaaaaaaacgacacttacgaggagctgagccgacccggcctttcacgggcgttggtttttcacatacgccgagggacacatcctctcccttgtcctcttgtctctccacctctctcgaaccctctccacctctctccaactcctttctctcctgtgcaacaacgcaatgacctccctttactcgatgtgcattatttgatttgtttttggaataaacttgttgataaatggttggtttctatgacgaaaacttatcgatatctatgaacttgtttaatatttgatatgaacatttctctcttttttttagattttattatttatttttggtggctttgtggcatccgatataattgagctgagtcagaccgtgttttttttttcaaaccatatatatacctctcaaatgtgtcggttcttgattcatcctcatcaataccgcctgaggggtgttggttgggaaatatgttacctatgggagttcccaactgacaccaatgatatttttctatagtagtatcataatactccctttgtcccaaaaatataacaaactataaccgaattagatatattttagtactacaaatcttaacagagtgcatatctagattagtagttatgatatgttcaatccaattctacattactatgttttaaaatattttaaaaaagatgaagtagtaaacttggactcactaagaacatgcatgacgacccaaggcccggtgatcctaagtaggcgtagtctcaccgatgggttaacattttttagactacatgttagagacccggcttttaatcgaaagccatccgataggttaacataactatgtactaacatagtacactatcttatgattttcaccactacttacgcatactaggtagctcccatgtctagagtatagaaatatgtagccacacgacagccgacagaggatcagcctaggacggattaagaagatgacgtgaccgatcacacgttgaaag

SEQ ID NO: 6441 - DNA, 1501 bp, Oryza sativa
gtgtacgaatacaattatatggaaagttttctatgaatcaaaaaagacgcatagaaaaactttcatagggatttggatcctatgaaaattctctaccaatcatatgaatcaaaggaccctttagactcatagtggcgcccaagaacttaggaatcgaacagtaaggcataaaaaaggcaacaccttgggtagactaagacggttgaaggggacaatgacgtctcgtacgatttagaggatggtgtaggtcacgggatcaataagagtcaccatagctgcagaggtcagttgccaatgtgcggaaaccacgagtgatgagggcggctatctggtggttccacgagagccataactctaggaatccaaggatgaggagcaccactagagcatcagcgaggtcctgctcggggacatggaaagagatgcttgttggcacatttcatatgcaagattcgaggaggcaccaaaaaccaatccaagtagcaacacatgcatttagtggagccgaaggacatgttgaacgagaaagccattagtgacaccatgaaggagcacaacatgttccacggcagggaacatatacctccgacccaataagctccttgccccttagcatcaagtcttgttggcggttggaaagggagctgatgatgaatgtcgcacatgaaggtgtaacgcgacactaaacaagtgtgtggaggagtggcgaggtgtctacaagcttgagcgcttgacaaggccatatagaaagagcatgatgttcccaaacgaccaatcagagcagcaatgtgctagttttggtgaagccaaaggatagtccagccgagaagaccatcaataatacatgcggatgctatggatatgatctagttacctagcattcctgttattttcaaccaaatgaagtcatagatgcttactttcttaaaaacaaaactaggcttcaaatcttcctatccacatatataatatagttgtgtgcatgtgaaggccaaaagaaatatttgtgttatctaattaaaacataaccaggtttagataaaagcgtggtaaatcattgtatcatttagctatgaattcatttcacttaagtgatggcaaggttatcgatctattgtccggcaaagagtatcaactctatcataaatccgatgcgagatctcacgaatttagaaagttagtttagtttcacgcgattttccagctaaagctgaaacgaattcaaccaaattcgaggaaaaaaaataattccgaacaaattttgcttttccttttttatctaaagttgccctattcgaacaaatatgaaaaatttgagggggcaatttgcaagttggcacgctcaccatctcgacacccggaggaggaggaccccaaccactgccctcgcagacagagaggagaagagcgcctcctgcctgccgctgcagccgcccgcgacacgctcccccctcccgagatctccgccgctcgccgccgcagatccgcgcggcgtggactc

SEQ ID NO: 6442 - DNA, 1501 bp, Oryza sativa
actgtatccaaatgagattataaatcattttcagctttacctctaatagtagtagaggcagacaaatttattgctccatatgcttccttcttccactacctgtactctcaattcttttgaagcagtgagggagggatacttcttttttctagcatgttttctacttaatttgagtcaacttgaattttagtttctacataatgatgttccatactttattttttggggaggaggagaggtgtggtaagcagaacagaacagaataaaacatgaccgaagagggaaaagatcagctataggaaagcatattaccagcgacatagttgcaggaggctgacttgaccaagcacccattgatccagcaatgcatgcaatagaaaacaaaattaagtactactcaaatacaactgacaacaacaaatcagctagctgcatattatattttctagctcttcggctcctgacattatgtatgaaatgcttgagcccttgcgcagaataaagcttacattttgcatagcagaaaggcatgattctttgcctcagttattttttcacatcatgattagtggcaatcaatattaaacagtaaaggaaaatattcacattgttcacagtgacaaatacagtatcaagtttgaaagaaatacaaagaaatcacctagagaaaactcacatacttacataagcaacctataccactaatgaaaacatccaataacacttagagcaaaacgttggttataattagcagttattcagtcagattgtcccaatatttctggattggtcttcagatgaaaaatcaccttttactcctaatgtagcaacttgactgcagcttctccatacatttcaccatctctacaacttgactgcctggtgatgtttgacagcttccaactcttggaagtgtgatatattttatattaatataccttattattttttagaagaaaataatatttatttaggtgatgtacaagaaacaagggaatactctctaaggataaaaatactttcccaatactactcttcatcttgcccacaactcatctgtttccccttctgttctcgagggcaaaagatactgccatggataattggacatgggccgaattctggaggccggccggcccatttacaatgagaagtctggctttccgtttaagcccaccgagatatctctcccggcccgttccgctcaggcgttttttaacgaaatttgtatctgtttagaatagaaatcgtgtgtcaatacaagatagcagtcgtagccgattttgagtgtgtttctctccggaagccttctgttatcagagtttgtttcggaatacaaatcgctagtttttctcccgagacgaaactaaccgtgtctctctcctctctccctcttcgtcgacgcctccactaatgcaagccctaaacctcgcaaattacccctaattttttttaacctaatcgatgcggaaaccgcgaattagtttttgcacctgatcga

SEQ ID NO: 6443 - DNA, 1501 bp, Oryza sativa
gcatcataccacttccctgaggccttggagcaccagcaacattcatctgcggctgcggagctccagcctgccctggagcaggtgacaccgcggcatttacctgcggcctgggagcgcccgccgcagccatctgcgggggagcttgcccgccgccggctatcttgggagctggaattctagcagcggcagggccatacagcgccgactgcactatgtcgggcgtgagctgacgcccgctctgcgccacggtgacgaggcgcagcgcgttgaagaactccggccggccgaggaagccggtcttgttcttgtcggcgtgcatccatacctgcaacacacgaagttccgacaccaacaaccatcaactcattcgaattcgcgggagcgagagagatctactactgctactaccatccaccaccgagatcacgcctaaaatcgggcgcactctctccccaatcggagagtggccattagcagcggcggcggcgagggaggaggggggtgtcgtcgggacgaacctgggcgaggacttgctgcggcaggttggcgccctggaagaaggcgacggcctcctggccgctgatgcggccgtcctggttcaaatccgcgcggcggaagtaggcctcgaaggcctccatcccagccatcgccgggatctgggccggagtccacgccgcgcggatctgcggcggcgagcggcggagatctcgggaggggggagcgtgtcgcgggcggctgcagcggcaggcaggaggcgctcttctcctctctgtctgcgagggcagtggttggggtcctcctcctccgggtgtcgagatggtgagcgtgccaacttgcaaattgccccctcaaatttttcatatttgttcgaatagggcaactttagataaaaaaggaaaagcaaaatttgttcggaattattttttttcctcgaatttggttgaattcgtttcagctttagctggaaaatcgcgtgaaactaaactaactttctaaattcgtgagatctcgcatcggatttatgatagagttgatactctttgccggacaatagatcgataaccttgccatcacttaagtgaaatgaattcatagctaaatgatacaatgatttaccacgcttttatctaaacctggttatgttttaattagataacacaaatatttcttttggccttcacatgcacacaactatattatatatgtggataggaagatttgaagcctagttttgtttttaagaaagtaagcatctatgacttcatttggttgaaaataacaggaatgctaggtaactagatcatatccatagcatccgcatgtattattgatggtcttctcggctggactatcctttggcttcaccaaaactagcacattgctgctctgattggtcgtttgggaacatcatgctctttctatatggccttgtcaagcgctcaagcttgtagacacctcgccactcctccacacacttgtttagtgtcgcgttacaccttca

SEQ ID NO: 6444 - DNA, 264 bp, Oryza sativa
tattcacataattaaggctactatttaatacttcgtctattaatttttattgtcatatttgctttaaccagcaataccaagaagagtgccaaactttattagggcagtctcaacccatagtgtccataagtagtgcctatgatgccatatcaataagacatcacaatagaaaccacactccacaactcatagtttcttaaagtgagccattaataaatatatcatctctcttctctaccaatcacatttattcttcatttatta

SEQ ID NO: 6445 - DNA, 1501 bp, Oryza sativa
ccaggtggtctcgcctcccgaaccacgtacgcacacattcaaaaaaaggcaaaagaaaaaaataaataaaaaacgaagagaaaaaaacacatctcccaccgcaccgcgacgcaggcgcagacgcctgcttctcttctctcctctcctttcacgcacacagcacagcacactcatattctcttcctcccgatcgctaccacctcctatgcagctcacacccaacccccacgcaaatctagaaccttgtggattgcgcccttgctcgatacgatcgccctacccgtcagccgtccgatcggatccccaaagtgaagctcctccctcctacccattgcgttcagatagctccatgtttggcatccgtttggacccatgcgcgtgctccattgaatctgagctcttcgcctgatgctgtttagggtttccggtttgccgcccccgcgatttagatggtttacgatggcgccgtgaaggaccaggagagctcggctaacccggcgtcggcatcggctgctctgtcggaggcatcggcggcggcgtcggaggtaacagcggctgccgcggcgggggcgggggctggggcggcggaagaaggggctgctgttagtgggcgaccgccgaggcctccccacgacaagcggctcggcgtgcggcatcccttgaagcaccgcaggttccgcgccggggggaaggtgatggtggagcccggggatccgccgtccgcccaggaggtggcggatgaggaggccagcgaggtggagcaggaggcggcgccggtggagagggaaccaccacaggaggagggtggtgatgtagaggtgtcgtctgcaccggcagagatggaggtggtggagggggatgcaatggaggtgtcacctgagccagcagtggctgtgggggagtcggagttggaaggccgaccaggcgaggaggaggaggtgtcctcgcctgtggtttctcaaggggagaggaagcaggagactgctgctgctgctcctgtgccagcagtggaggagaagaaacacaaggatcaagagaataagcacaaagagagggaaagggagaaggagagagagagggtggatgaagtgggctacatgagtggtggatggaagaggtaatacttgcttctcttttccctattggagcttgcagataatcggttctgtaggcaggaattctcgtttatgcatttaattcaaatacaccatacagcttctgttctgatatcgttcatatcaagtggcgtaatagacgtacgttgagagcatgcttctgttctggtatcgttcatatcaagtggcgtaatagacgtacgttgatcatgcttctgttctggtgtcgttcatatcaagtggtgtaatagacgtacattgatcataaaatagacattgcatgcccaacatagctttgcgacagtaagcggatgtggctttttagtagatttgcaatgctccattataaccagaaatgtaatagtgattgacctatttagaattgt

SEQ ID NO: 6446 - DNA, 1501 bp, Oryza sativa
tttattatttgaggatttatctttttttcttttttttttgcaacatgttcaattcttcaaaagtagcatatcctgatttattaatggagtagcaaatcttcacgtgtgcaacttttcgattgctccatcaaggcatgccataggagtctcaaatgaggcagctcaatttcggtaagaattgtggttgttctcacattccacgtggcctcaggactaagtaggtggagtcacattctcatctaacggcttttcactttgctaccatttttaacattacctttttctggcaaagttacccaaaaataaatgactacatttaatttgttgtcaaattttagtgagtacatatgaaatcttactaaaatttggcaacctttctaaaatttggcaatgcccaaaacttgtatggttgaaaatgaaagcaaagtgaacaagccacaagtgtcttcttttaacataggctagttattagtgttctcattttgcatggaattctggacaagaatacctggctgcttaccagttaccaccaagcttttttttcttttcagaacaacctagcaccaagctgaatccaggttggtgcctgtgtagtatcaagtgatagccttctcggtgtgcatttgttggagcacaatacagcattcaataggcagtatttctggttagagcataggagtacttaaatagtgtagaactggcaacttaaaggagtactcgaatgccttgtctggtctgtagttctactgtacaaacagtagggatggaacaggtagaggtggtccaatgggctccatctcccaacggcactactggaaccaaatccacagtacacacagccttacggtgtttacggtacggacacgccgtagctaccaacgcaatcgaatccattctcactcaaactattactctgccggatgtaccacacaaacaattaaatggaaatgtcattgctcaagcttgtaaacttgcccccaaggctaaagcagcatctctgtagaactatagggccaggagcaggagcaggaccatcaatcatcttcctctctggatggtcgatccatggcccatgggaatagagcaaccatgtgtagttcacgttctatagtgctgcttctgctccagatcttgccagccttggcaatcctgtctgtgcttctgcgcacatgacataaatgtatttcaagtttgagccatgccattgccacggatcagactatgagcccatttaaacctccagtgccagaaagatggtagcccagcattgggagctcatgtaatgcaactccactggcctgggatcagtcttgatcaacaagctcatccatggacttcacacatattggcttggatgtattcggcccaggaaagatttcattctataacatctacaaaattgcagactaaagagaagtatagatagcaataccaacttgtaaaccaccagaggcaccaaaattagggatatatagacaggcgaacatgaagcgagtcttta

SEQ ID NO: 6447 - DNA, 1501 bp, Oryza sativa
tcacggcactgtccgcggacggcgggggcgggggcggggccagcaggacggcgctcaccgtggccgccgtggcgctggcgctcgtcgccgccgtcaacgcgcacgacctcgcggcgcacctcgccggcgtggactgccgcgtggggctggtcaggtacaacgcccagctcggcctcgtggagctcctcgtgccggcgctgcacgtggctgggtgcgtcctcgccgtcgtcgccatggcctttctgctctcccaggtgcgtttcaaatagctagatcgttggcaaaagtgcacaacgcgcatggcgatcactctgctttgacatggaacagggcgagagggagacgcacgcggcgaacacgctgctcgccgcggcgctggtgtggctgctggggtcgatactcaactcgtgccaggtgtacgagcgcgccgacgggcgggcgcagctgctgcagtcgagcgtgcaggtgccgatgcttctcgggagcctgctcttcctggtcggcgccgtcgtcaaccgccgacgacgccccgagccgccggtgctagtggtaagcgcgcgatccattcgatcgagcaacctcgccgccggcgttggcatgcacgacgccatgacaaaaccgtgtggtttgactgtcacgcaggggcggagctgggcgtggacgatgtgcgtgttggggagcgtgctgtggctggtggcggcggtgttcaacatggggaaggtgttcgtgatgcaccagagcgacgcgccgcggctggagaagctgcgcggcggcgcgcaggagcggctgagccgtgaccgggagggacgcttgccgctcaactgggaggaggccgctaggagccggagggttgcgctgcccgccgagctgcgctgatggcaaccatcttcttcttcttcttcctcagccccgtgtgctgtaaaagttcaatgttgcccctaacgtcagtgacgaaataattctacgggatctaatagtaatcaaagattttagttgttttgacgtgtttattcaagggtcacaatacacggattgaggattgacaaatatagggaacgagaattgctaatctttagggtctgtttagttggtgaaatataaatttttgggtgtcacatcgaacatttgaccggatgtcggagggggttttcgaacacgaataaaaaaactaattttataactcacttggaaaccgcgagacggatcttttgagcctaattaatccgtcattagcacatatgggttactgtagctcttatagctaatcatggactaattagtcttaaaagatttgtgtcacacctcaatctggcaccgccgtacaacggcacgtggcaggagcttgtcgtagtaaaacggcgtgaaccgcgtcctacgaaaccgcgatctcagtaccagtcccaggacatagcgctggtacccacagtgacaaacatgaatcattgcaaatccttataattaatagaggacttatttaccttaacttaggttgcagctcaga

SEQ ID NO: 6448 - DNA, 1501 bp, Oryza sativa
aagcccctgccgcccatccaggctccccccgtacgtgggacgcgggcacatcgggcaggatccgatgtcgccgactagtttatccgcaggctcgcccgagtccccacgacgaggcgaggccagaggctcgtcgtggtacaccagatgcaacggttggaacacgtcgtcctccttgatttcgcaaccgttccacgtcagaacagtgctggaaaagaacggatccatagagagttcttcgtggccgtcacgatttcgcggcgccaaattaccttgcccttatggttaggggcggcatcttgtgtaccgaaagtcaataatgactcgagctaaacccgtactacagactagagtgtggccccaatgcgtttcgcaggacaggacgggcgaaagaaatcaaaaggccgacatgccaccgacatttccccccacgaaagctatcatcagctatcatcaaagcgaaggaaagaaagaaaaataaaaggaaaagaactggctggaaattagagaagccccggacgactcgatctgggggtggcaaattaatcagtgtgatcaacagggataacttatcccgtccgaccaaatccaccaaccaaaccaagacccgatttgttaggctgtgaaagacggatcagtgggaccctgatctacggaccccatatgtcaccgtccaggtctctggatctctcccgtcgtcctaatcagacaccgcgcgcgcggtgccgtcgctctcgagccgtgtcccgctcccaactcgtcacaaaagcgatcacagactcttccttcctctgctgggagagaagaaaaattggccgcgatgatgccgataaagaggaaaaagggatgagaatccgatggaaaaaaactgatgttaatctatcgctactgctgcgcactaagacgaatcgtatccgaacaagaaacgcttacgttactgttcctaaatggatcgctccgctcatcacttaaccaaaaatcgattaggaaattgacggacagcgacgcccgaagccaagtgtctcgtcgcgtaggcgtcgaggcctcgaagcagagggagcggagaggcggacgcgccgcccacgcctcctctccctcggtgacacggccgtctggctccacatggcgccgacctctcccgatgcgtccacccgtcccgaggcaccgccacgtcggaaccagccggccgccccacgcgattgccgacacgcgtcgcggcgccactggctcacccgctgcctgcctctgcctgccccccatctcgtcgccatttcccgcccacgcttcttgtcctcgcgtcgcctacgcgtacgtacgatacaaacgccgcacctttcgatcccctccgctatataaggagggcatctgcctcgccaccttcttcatccgaaagcaaaagcgactcgtcacagctcaaacaagtcaagagcgaatagttcttgctgatctgttgtttgattactttagttctcgagaggctttagctgaatccatcgatcgatca

SEQ ID NO: 6449 - DNA, 1501 bp, Oryza sativa
aaatgttatactaatatgcggacagtgatgacgtgttcagcccagcaatttaacattttagcccttttacaaacattattctccaaataaatccccatacaattataactaaaaatagagctcaacattagcgtcaggtccatggcgacgaagtctaacatctcagcaccaaggggcaatacaatagtaagcaccagtatattttgtacttttctatataggacagctaatataattagaacgctttctacagagttcgatcagctaatatcaccagaacacttcaattagaaaagagaatgaaaaacagaggcatgggaagtcgatcatgccagggagagattgcataagaaagccactaagctactccctccattttagtaggttataagaagatttaattttggtcaaagtcaaactactctaagtttgactaattttataaaaaaaaaatagtaatatttttaaccaagacaaatatattatgaaaatttactcaattataaatttaataaaactatgctggtgttgtaaatattactatatttttctacagaattagtcaaacttagaataccaaagtcaaaacgtcttataacctgaaacggaggaagtacttaacatcgtatagtaaaaaaatagcacattcatatttatcaagtactataaagctgagcttcacatagctaagtggcaagactgatgacgctgagatgttgggcttccgcgtcataggtgtgactgctgaggtttagctttagtatttatgaggatctatttatagattaaattttatgaagggactaaaatgtaaaaattgttgatgttcagtcagagatgatatgttctacggagtatctacgacctggcaaccaccattggtgatgctagctaggcgacaaagcagcactttcccgggagagactgggaatctaggctatctgtactgtagctcccggccacttgctacctgccttcttgcaccttttctagcccttctgtccttttttttttgcttgtcagaattcagaaagaaagatgcactataatctatgcatatccaagtcaatcattcattgtaaaagtgtgtgtggttctatttgtaactaatcgttgcaatttcttatacaatctttagccctttcaaagaaaataaaatagaagtctgtttagagaagccttaaattctaaaaatcaactagcgagaattcggatatcctgagaaaaccaatttaagtttggcttgtagtttattttctaaattctgtaaccgagcatttttatattttaataaggcagctatcaattggttacttctcaaaacagagggctatattaattgctagccctcaattttgttgacacaaaatcgggctggcatttgctgagttcctataaatacaggcgtacgtggttgcgcagtttactgcaccagcttaagcttattagctcctgagagtgaagcccctatagctgatcgaagctatgaagaagatgtggc

SEQ ID NO: 6450 - DNA, 1501 bp, Oryza sativa
ttgtgtgccttgctacgcatctttgctctgcaagggctatatccttggatgaagtgctcgaagacctgtatggcttcaggttggccgtccaatatctcgagaataatttctttgcatttttcaatcgacatgttcctgaattcaggatcaggattctttatcatcagtcatcaaaactcacagccgagtagatgagaggatatagtgattgatacctctgcctccttatcttgatcatagatcggacgaaatggctgtatacgtcgtcaggaagctctgacttgacaagtaccaaaaattccatcgtctcgactctgtagggatccctctccgtcctcgcccttttggacggaacgccatcgccaggatcaccggcggaagaatccattctatttctcctaattatttaggcgaacacctgcacaagagcagacagatgcaacaaatcagcaaagacctgcacgagaacagacgaatctacagtgacggcctcgtctaggcaaccaaaatctaccgccgctccggttatcccctcgcaaaaaaaccgaaaaaggaattcgattcaaccaagtcatcaatccgccgtaagggctgacgaaaccgaggcgattaggaggagtactctcgtgatctcggcgccttgattcgcgcacgcgagtggagggactgacctcaagtatgccggcggcggcggacgcctggaggaaggaggcgagcgacgagggcaccgagactccacaccttccggaaccttctagaacccccgcggcgcggccgcgcggccgagggaaagaagagagagagcgcgagggaagagatgaagagaaggaagacgcagagtatttaagtgggctggattggattggaaaccgagacgtttccttccggtttgaaataagttcattttgggtccctctatttgttgctcagtccgaatttcgtcctttgaccggggtatgacccatcccctaatttacgaaaaccgggcaaacgtggtccctcggcggttttggctgacgtggcacatacgcggtttgtttgactatatctccgtcccacatgacaatgacatggcgcttacgtggcaattatatcttataaaaataataaaaagcgtggccccacatgtcagctgcaaaaaaaattgaaatggtggggcccatgtgggccccacatgccagcctcactcctctcttcttccctctcccttctctctcttcttccctttcccctctctctctccttccgggcagaggacggcgcgggtgggcgtcggagcaagcgagctccggcggcggcggcgggcgtggtcggcgccgccccccgaccggagcgccgtctgtccgcgtgaaggcgagtagcgcggcgacgccctggaagacgccatcgacgccgccatccgtgtcgccgccaccgaccacccggacgccctccacgcgcgccgggacggcatcgccgagagcctctcaccgccgctccacaagccgcctacgccgcgctc

SEQ ID NO: 6451 - DNA, 599 bp, Oryza sativa
tgtttctcgcccgcgccattgccgtccctctcaccgaccgcagccgtcgcgtgtgtgccggaggagccggtgcgcactaggacgcggaaggggactccgggcgctcgtcttcctcctcttccccggcccgaggccggagagatccctcccgcgccgtcggcctctcgtcacagcgcctctcctcacctcggggatgcctccctccgttcttcctcctcactccatctcccccccttagttttcggtggtagcacgagtagcctccccgtagctagccggcgccgccccgaccgttgccgtcgcccgccgtgtgctcgccgccatcgccgctcgagctccgtagcacccgctcgtcgccagcctcgctcggcgtagctccgcccaatccgacgctagcatcggattcccttggccgtgtagatgctctcaccgccgggaatcggcccctcgtgacctcgtcgccggtttcctcttccctccccgccggttgccgccgccgcgattcgccgccgtcaagcttcctccggcgaatcccgagccgtggctcgtctccccttgtctcgtgcaaccacccggtgtgctcgctttcgccggtatcg

SEQ ID NO: 6452 - DNA, 307 bp, Oryza sativa
attctaataatttaaattttcctgtttaacaaaatttttttcattgttagcatgcccattaccagcttacaattttcccttgaaatttagggatcaagccaccatgatgaagttgataccatcataattgaacctttttgttaaggtacgttaaatgccaaaagtaagaatagtcatccaaatagaactgggtagaggattattccggtttgacttttccttattgcagatgccatcgtagcaaaacaaaatgttttctatgcatttgtcattctttaagttcaattattttttttctatttatagg

SEQ ID NO: 6453 - DNA, 1134 bp, Oryza sativa
cctgcaaaaggacccctgcacagtagaaatccactcgacttctccatccctctctcctcctcttccaaatgctcctcatcacctacaccacccgcaccaccaccctccttttctcccctctccgcctccccacctacatcttccagatccttgccgactcagtcctcggccacctccctcacttgtccaaccttgtcttccccatccgcaacctcttcatcctcgagtcatggcctttctcgacctcgtgtactacaccttcatcgtcggcttcaagatcgaggtccccaccatcatccacgtcggcatccgcagcttcaactttggcttcactatcagctgcacgctcccgcccttcctcctcgacgcaaatgaaataacgtttttcaaaatcacatagattctagcacaaaattaggtactacgccatccaaactagaataaaagctcattggctaccaattccaagtgtatagcaccaatgcacatagtattctattgttcatgtgaaaacatcatacaccaagtgtggaaccaattaaaacacataaagataacatgcataatgttaaacaatttcttatggttaaaaactatatcattacggaaacaccagattgaccaatatagcacactagctccaaataaaatcttttttggaggggcctaggcactccccagccaatcaccaaaatatattttgcattgtgaggagggggatattgaagacaaagaagacacatcgccaagcaaaatatgcaacgtggtagtaaaaaaaaagatattggagtaaaagattcccctccattttctctatgtgaggttatctttcgttaagattatttttttaaaagcaaccacataaacactttgatttttagtggtgccttttacctcccattgttgtcctttgataggcatgcaacccatctaaacctctgcatgcaaaaatccaaaaatagcacactcctctttcccttccctcccatcaaatgagagatcgacgatgtatcttatcactcctcctcccctcacctcaccttacctaagaacgccacccattgccggagttgataccaaacaaggaattcatcaatggcagcgcatacagtgacggacccactggaggagcta

SEQ ID NO: 6454 - DNA, 1501 bp, Oryza sativa
tcgaacccccctgtcctattcccaatgactagcccaaactacaacatactagtctggaatgtgagagggttgaacgcaggagcacgccgggacgtagtgcgcttggtggtcggtctccaagaaacaagactgaatgtaatctcccttatgtcggcctctcaaattttaggccctaatctatctagtttcatctatctcgcggctactcaaatgcggggagggggagtggatcctccttgcctaggatccgagtgtggctagttgtttcagccaccgcactaacgagttatcaatcacaatgcggctagagttcatagacggaacgatcaattggttcacttctgtctatgggccgcagggcgactccgacaaagttcgttttcttcaagaactccgagaaatccagacttccttctccgaacttggttggtggtaggggatttcaatctcatctactaggaccaagacaagaacaacggaaacatgcaccgtcgcatgatgaggcgctttcgccgggtcatttgtgaccttcagttcaagaggtgcacctcaaatgcaaggccttcacttggttcaacggctgggacagaacgaccctagagcgtatagatcgcatcttcgtgaccgacaactggacaaccctgccttcttgattcctcaaggttctctcgatggacatgtctgaccactacctactcctcctaaacacctcgtcttcttcttgacgctctgctcgctctctttgagagcttctgggtgaagcgggatgggttcctcgtaacagtccaggattcctggtacttcccttgcccattcaaagaccccattcaccgattggacgcaaagatgtgatgcctagcaaaggcgctgcgcagttggtctaacaagaaggtcgggaacgtcaagctgcaactggccatgacaagggagataattgacatatttgacgctgccgaggagcatcgcccgcttagccaacaggagtgtgtgctccaccatgcgttgaagaagtgggtgcttgcccttgtgtccctagaaagaacgatggctcgacaatgctcacgcgtcacctggctcaaagagggggatgcaaacgcccacttcttccaccaacaagcaccctataggcgatgaaagaatttcatccagcagctggctaacaataggatggtcgccatctcgcacgcaaataaagagcgaatggtacacgagtactacgccggagtgctaggctccaccccttcaacttcaaggaagcacacactcagcttacccttctttagccctagccgacctgtcatgcacaacctcgaggtgtgcttcactgaggacaaagtccggaatgcaatcaaggacacccctaatgattgcgcgtcaaggacggatggcttcaccggcttgttctacaaatcttgttggtcggtcattaaagaaaatatccttgtagccctcaaccaactctttcatctggacggatcaagatttgacaaagtaaacaagg

SEQ ID NO: 6455 - DNA, 453 bp, Oryza sativa
ttcctgcaccccaaacggatgtagtaatgaccaatccgatccaagtctcatactatacgggcagtggagataaattattaaatatttaaatccagttgcaagaaaaaattaaggtgtctaatggagtgcataattcggtaatcagtgtatgattggtggcttgattcccattctgttataggagaccgtaccacggttttagtgtccgtgatcagcagtagcgttttttttttctgaagcagatcgaataatttgaagttaagcacgtgggttctatgtaatacagcatcttttaatacaaacgatgtggttgggactggaaatcctatggttaaggattaaccttttctaatttttggaagttttcagtagttaaaaaaaatcgatgttttcctgttgaattggcaactatttggtgaagtttcatgtttacaaacgaaatccaagccaaaa

SEQ ID NO: 6456 - DNA, 1501 bp, Oryza sativa
tcacatcactgtacttgcaattaaacgattaattactaaagcatgtgtctcgttgcacctgagagcaagtttaatagtatggccaactattacccaaatcatatatagcccatttaataactcatctaaacaatagttatatataaatatatactacacaattaaaatatggtcccacctctcatacacacataacgctttggagtctatgttacagttggctccaaatctatagaccgcttttattctctctcttatcttatcttctccacatgtgcatatagctaatttgtagcctgttattgtactcgctctgataaacaatttgtcgtggcctcttatcccttgatattaggagatttgcccgttacttctgtcggagtttgtgtttaacaatctacaacaagaaattgtctagtactcaagaatcaagataatatataaacaaggaaaaatagatgatcactttcccttacatctccatgaagtcattgttccaatgatgaggtccactgtacacaggcattagcatcatgatggttggaagcagaaactctagattctgagaaacggcagcctcagctgcctgcaaagaaacctatgcaagaatagaacagtatgggtatgtttaaaggtagagtccatataaactcttagataatgcatatttatttaaaaactatgtctttataatggtggagactacaaaggctctaaagtattaataaaactttttttattactattcattccttgttcacacccacatgcagtaaagttttcattctatagaggttaaaagtcgttcctaagcaattattaactgtagcaacgacgttggcctctcctcacttctcttccttccatatcatcaaatattcctaattagcaagactaggaatcgttattaattatcattgtatatgtcataagttttttttatttataggcttacgcctgcttataatctaaaaaatctaaggcaaacaaacagttttttagttttttttttcatttggcttttttaaaaccaataaaccataagctactcttatattgttaagctaaaagctaagttatagtaatttttagtttatgtgaagtgaagataggacccttaaaagcactagtaaataaaccctaagtgttggctgctaacctagcataagtgctagattggcagccgtcacctacaaagcagcaccaattaatgatggtcatcagtgttggttttacaactggcagatataagagcctataatattggtgtataaatcacatgagccaaaaagttgcttaaaagtctaagctcaaacaaaagcctaaaccggttcatatagaaaagttaaaataataattaaaaaaagactaacctcacgaccgaaatggttcaagaaattcctggcaaaatgtgagcaactgtttagatccaaagtatatcgtggggtccataacgttgagttgttattaggactataattgtatgtcttccacatgtcag

SEQ ID NO: 6457 - DNA, 1501 bp, Oryza sativa
tagctgtgatgaagtgaacacgagtcggcggcgacagaaccagttggcgacggaagaagtagaataatgacgaaaacggagatgttctttaacggtggtaaaataggccagccatgaaggtgaagtcacaatgggcggcggtgaaagcaaaccggcgatgacgatgacgccagtcaatgacgatgaagacgcgcagccgtggaggcgaacaagccagtcggcgttagacaaggcgaccagcaatgaagatgaggacgtccatcagtagtggtagcggtataaatcaaccgtagaggcaagggcactagtcagtagcagacgagatgaccggcggtgaagacgataaggccaatcaacactggcagaatcatgtagccatggaagtaaagaaaccagtcggcagcagacgtagacagcttgcgttgaaggtgatgatgcctgtttgcggtggtggcgacgtggccaaccgtgaagacgatagcaccagttggcgtcatatgaggtggccagtcggagaagatgtagacgtcctacaatggcggcataataaaccaaccgtgcaggcgaagacaccagtcggcggcggcgaaggcgagccggcggtgaagacgtagacacccaacaacggcggcataataggccagccatgcaggcggagacaccagtcggcggcgacgaaggcaagccggtcggtgaagacgtagacgcccaacaaatggcggcataatagaccagccgtgcaggcggagacaccagtcagcggtggcgaaggcaagccggtcggtgaagacatagacgcccaacaaacggtggcataataggctagccgtgcaggtggagacaccagtcggcggcggcgaaggcaagccggtcggtgaagacgtagacgcccaacaaacggcggcataataggtcagccgtgcaggctgagacaccagtcggtggcgacgaaggcaagccggtcggtgaagacgtagacgcccaacaaacgacggcataataggccagtcgtgcaggtggagacaccagtcggcggcggcgaaggcaagccggtcggtgaagacgtagacgcccaacaaacggtggtgtgaccaaccaaccgtataggcgaaaacaccagtcgacggcggacgaggcagccagtcggtgaagaaaacggcgcccaacaacggcggtgtgaccacccaatcatataggcgaaaacaccagtcgacggcggacgaggcagccggtcagtgaagaaaacgacgcccaacaacggcggtgtgactacccaaccgtataggtgaggacaccagtcggcggcgacgacggcaagccggtggtgatgttctgactgatccattcctgtaacataggagataagcttaaagccatgaatccctttgatgcatatctggatctggatcctgcagaacaaatatataggatgagtagtatctgatgtaaatacagtacttgagaaagattcaagtattaaaagtgtttataaatatgtatt

SEQ ID NO: 6458 - DNA, 1083 bp, Oryza sativa
agactaagtggtatgctagatattttcagacttagctaagtggtagttctagtttaaattttttttgtggttggttgtattgtgatcctgagtgtgaaaaaacatccgaaaaaataaaataaaaattatctgtttgccagtgctccccagagaacacggaatgcagccggccgcgccagcatggccggcgccctcctcctgccacgtcggttcacgtgcgccacggtggcaggaggacggcgccagccgccgtcccgttggatgacggcgccagccattctggcgcccaaaaaggaccatttctggtataagtttttttagaggtctatttgtgaaataatttttttaaaaggaccaaaatgtgaaaaatccagctgcaatcgccatagagcaagtgaacgggagtcccgagaacccggatcgcatagtatacttgtatataaatagaagaagttttcttctaaacttttgtatcctgttatctaagcaataagaaacacaccaggttagccccaatttccagattgagtgtcattccacattttatttccctttgttctttgccattgcaggacaactacattcacccgcaaggtgttcgattgaggttctaggcaacaaaggaattccaaagtattgaaagtaaatgtgcaacatattaattataaactgaaatgtaaaaattcgaaaatgtacatttttctgatcgtttttacaggaatatttttatggattgtcttcccaccgtcaccgtgatattatgcataatttatctacttaatttataatcttgtaggtcctgtcatgccatatgatactacaggacagtgtacgtcgtcaatgcgtacaatcagacgggggcagagctaaaataaaatagagaagggtgacacttgcttaatttactctctttagattaagtttaacctgatgcgggtgtctaaatttgtattgagtgggatacacacataatgaaaataagtgagatatagcttaaaaaaaatttcttgaccgggttcctggtacccctccaatactctagtactcgatgctctccgccttcgacgtcgccatcagctcctg

SEQ ID NO: 6459 - DNA, 1501 bp, Oryza sativa
aattgatttcatccggtttctggtgatagaactagcgctgtggagattatgggtaccccatacccacacgacatggttatccgactggttataggggataacttatatctatgaaatatataacggatcatgacttgggtattacgtttccctgtatattatggaacggcctaaagtcctggtttgataagattgtaaagtagatttaggaaaccgataccgtattggttaagatttctatcttgtaatcctgccccccatcctatataaggtgggcaggaggccctctagggggcatgagacaactagatcgtcagatctataatacacatggtggattcaaatccccaaacaggagtagggtattacctctcatcgagggggcctgaacctatctaaatccttgtctccgcatccatccacttttaggtctcgtgcgctacccttttattattgctgaattcatgtttcgacagttggcgcgccaggtaggggtgcgtcaagttttccgtcaagaagtgtgatggaatcaagatcaggagtggccggattttccttcaccccgaaggctggctttcggttttgacggattcgtcttctttgatggtgactccaacaatctctccctcttcgacttgggttttaaccagtcgagagaacggcgatcaaagatttacgtcatcaagttggaggcttcaatcgtcggggtcaccgatatctcctgtgcatctccacaaagatctctgcttcaggagctacactttgtggttacaagaataaccaggttcgtcgttccaatctactaatcgttattagattggtctctgatataactactaattaaattaatctatgccttgcatgtactgttgctggttctgacctccgagtctttcgatcattgtcacgggagatcaagacatcagctcactgagcacacatctctatatgggtagatcgtattgatcttataccaggcgtacaatagaagtccagactcggatttagctgattggatcattctcggactcggctgactactggatgatcaggtcaaaacaaaaatacactcggcatgcaaggaaagcactgggaatgtggtcggcacgagccccaacacttaccagtaccccagctctgggaaaagcaacgaacgctatgcatttgatcaattccagagctattggttttgcatctacatcccagaagaattgccaggcatacacatcgttaattggttgtcatgagctatcctcaataagggacaccaattaatatttccatccagctcatacgcatgtgagcatatatggctaccttgccaactaatcagatcaggagtcctagcaccatactcctacgtgaggatatatgatatattggctgacatcatcaggagatattatctcggactccatcaaaacatgctccggttttcccttcaagcactcctctgacatcatgagcttgagttataaaccactaccggatcagtacaaca

SEQ ID NO: 6460 - DNA, 1501 bp, Oryza sativa
taaaagagctgcaaaggtggtccgagattccgaaaacaccccgcgccatcatccctgataccggacaatcgatgtggtttaacaacatccaccaaaataccgcatcgaagtcataggtaccgtttctgaagtcataggtaccgcggaaaggggcgatcgctcgcctggtggcggtagcaatcaattcaccccccaccctccctccacctggttttatttttttggcaccgcattacttttctattttagtaaatttatgcacctatttatacacctcaagtttacacatctaaagtttagagacccaaagtttataagtcaaaagtttatatatccgatttaaatttgaatttgaattcaaatattttttatatatagtatttcaatacatttaaagtttatagacctaaagtttataagtcaaaagtttatatatccgattcaaatttgaatttgaactcaaatatttttttatatatagtatttctatacatctaaaatttatacacctaaagtttatatacccgtttcaaatttgaatttgaattcaaataatagtttatagacccaaagtttataagtaaaaagtttacatacccgtttcaaatttgaatttaaattcaaatattagtttatagacccaaagtttataggtcaaaagttaacatacccgtttcaaatatgaatttgaattcaaatattagtttatagacccaaagtttataagtaaaaagtttacatatcagtttaaaatttaaatttgaattcaaatatttatggtgtagtaggaagagaagaaggggaggagaaagggggaaaggaagtaacgtacagggggaggggcgggtgatcgctggggtggggagggagcaatcacccgcccattaggactaccctaggtaccgctttataattaaaaccagcatcattaataccacaactcatatatgtgtgtttttagtaacttttttatacgaaatcggacgaagataaactttatctgaaatttgtaaagttatatgagttctacaactttctagctaatgattttctatttgaggttgtttggataaccaaaaatatatattataaggtctcaaatctatttggataagtgaatttttaaaatttataaacgatctcggatggagatagaacctatacgaaagttttatattttgatgagatctacaattttgtagttgacaaaattttcatttgacatcatctacagtattaagtatggactggagtataatttctttaaaaaagcatttgcttccaagacaataattgttcctgggtgagatagtaaggaggttatatatatattgttgcacttaacgggacggagggagtacattccaaagaatatgggttaaaaaaataatatgacttgggggaagtaaagtgtgattgtggttgacgtctaataaaatgcaaaatatttttttgggttttttcgcacttagaaaaattaaaaagggtgcacccctatagt

SEQ ID NO: 6461 - DNA, 1501 bp, Oryza sativa
gaccgcccataaccacaggcacggctattcgaatagttttactctgatcagaggtgtacaactgtacccacaagacacagccccacgacacgttcccgtgcactgacatgccactatgacatactggaaagaggccgtgataggacccttcagataaccccctctaaccaagcacaccacacctcaggtttcacccccactcctcgcaaggcagcgggcagtcccctcttgtgcctaggtgaatctggaagcgacaaaggctgtcgcagggcccatcccgctccatcacgcccacccttgcctggatgcgtcagctagaggaaagctacactacaagcccagcagttgcccatgctggcttgtggtaagtacgaggaattcttccagggtttcccgcgaaccggtccttaattgccatgggcgcgaccaacagaaccatgtacccacagcccaccatttaatatattttaattaaccaacaccaaagcggtggcactaatccaacatcaatactagaatcttaagtctatgcattaatgtaattcccccattgtgtactagttgatctaagcatggctaagcgatccagtaggtagacatcccatggtagcattataaaacaatgcaatatttaaaaagcatttgcaatatgggatcaatatgttcaagtgacaagcatgacttgccttgctctatggccggaggaacttcgacgactatctcgaagtacaccggagcgtcgggagagctggaatctatgcgacatacaaagcaaacaatgcaaataggctaaaagacaactgaaacaaagaacaaaaccatttttaatggattatttgcatttttcttgacttactgatacttgaatgggcttaaacagagcacggatgaattttctatgaattttagaagattcactgtgcttttactataaaaaggaaaacattaattgatttattgcgcaataattaaccctagcgatgtcagcacaagggggcgcctacatgcgggccccacatgtcatcggctcggggacgccggtccacggtggaccgagtccacggtatcgggagaggggatcgccacgtggcgcacacgtggcgccgacgtggcggccacgtgggcttgccacgcgggcggtaacggacggccccgatctatctgagggtagatccgacggcggaggcggcacgcggccgggcgcggcgctagcgttggcggctaggcggctaagcggcaatgctaggcggcgcgggagagagaggggaaaagggggaggggcctcactgacgacgatcgatgacggcgagtggtggaaggcgacggcgacggcgggacgggctccggggaaacctagggaacaaaatgggccaatttagaaagggcgagatggtgcgaaaaggggcgggaacgacggccgaaggcagcggcaatggaggggttcaccggcgcgcgacggaggacggctcccggtggcatatttcgacggggaaggagtgga

SEQ ID NO: 6462 - DNA, 1501 bp, Oryza sativa
ttgccgagttgtgggctgttgggacaggctagggttcggccgaaccagcagctagcccaatcagcccagtttttcaccaactggtagttatcaacgtcccaaggcggttgtgaccgtttctacctgaagaaaccgtcgctggacacttggcgcaaggaggtgaagcaagagggaatatgctcattggataccttgagcatctccacactcccaaggcacctcatggcctataaatacccctcctctcattccattcacacacactcaagaagaagatcaaagagctctctcaagtttagtagtgttctagtgctagtggagtaggagatataataattttcttagtcctcgagtctttagtagggtatggctctagcagcttttctatcttcctttataagacttattaaattaatataatattcttctttatatatcttcggtattttatcccctttatattatttgagtaccgactttattttatacttgtatcgatatagttgtttagctagcttaccagagatgtgcattggtgtgggtcatggttgttaagtcaaacgaataatcgtgctcagatcgattaagtcgggtgattttgacagtgatggtttgttggcccatacattgggtgggcactgggccatatattgactagctcattaaggggatactatagcaaaaagagaaggaaaccctagtcccactcccacagccgccgcaaggcaatcagcagaaaaagaatagggacccgatacgagcgctggctacacaggcttgtgcgctggcgcctccagccaactcctccttcccttttgctttcatcctctctatctctggcttttctcttctcccatcccaaatcactggtgttgaatgcaactggtgggcaactgcaattgagttcatccattaggaatcaacctcgaggttagtttcaacttctctccttttccctaaaggtttctatggtctcatgctatgctttgcttactctttcttgctggttgctttgctagttctcttctctcactatctcatactctgctgtccaatttattggcctgatgcaagttgttgcctgctctagtgctctgctagatgccatatgccctgcatagtatatgtttgttggtctagtagggatgcccatgtgtgcttgctgcaagcctacaatgttgcttttgctagtgttgtgtggaccactggactagtggacctgctacttttgctagtgctttgtactatctagtgttattatattggcaagtagccaagtgttgttgctttgctgtttgttttattcatttatcttggatggcttttagtgatttgtcgtttgtgccatgcttgtgctgtggttttgtacttctgttagtaacttggtcttagcaagttagcatactatattgtcaatttgtgagctaacatctagcacaaatataataatttacaggtagcatggcagtgacaacgatggatcaagctaacggcgttcaag

SEQ ID NO: 6463 - DNA, 1501 bp, Oryza sativa
  unsure (1)..(1501): unsure at all n locations
caaccgagcaaacgaccgaagaccgctactttggttttttcggtttcggtgtcgattttttaggtacggtattcggttctcggtttttatgctcacccctaatcgtacgtacgctaaccgctgctagagcatcaccaacacatcttaaaattttattcccaaatttttagttatggggatgcaaaaacataatttgaggtgttaaaaattttctcactccaagagattaggtaaaattggtttcctaaaaattaaaagggtgggccacgataaaacctccacgaaaaaaaatatgttttgcgctccttcctcccgtcagatcacgtgtgcatctcttccccgcacgtgaagcgccgtgattaggagccaaaacaagacaacacatggatatattccgacgaaaaaaaaatttagcttattatttaattttttttaaatgttgcacgatgttacaccaggtatatcgaaattgtttcactaagtagatcgaaaatgtttcactcgtttaaatcaggtgttgtttcaccttataaaaaaacaatgtttcagcaaatagcgaaagaatgtttcagttcactgcaacatttgatccatacatagtgaaacattgtgtacactaggtgaaacattttttttgtggaacaaaaaataaaccaaattcccttaatagggggtttccaaaatatgtgagttttttttttgcaatggaatatttcgttcactacaacattagatttatacatagtgaaacattgtgagtacactaggtgtaacatttttatggaacaaaaaataaaccaaattcccttaatagagagtttccaaaatatgtgagtttttttgttgcaaaagaatattttaattcactgcaacattagaaatagtgaaacattataagtaaattaggtgaaacatcttttgtagaaaaatgagagaggaaagtgggtgggccgaggtacacacgtggggatggttgtggaaaaatgggagagggtagtaggtgggccgaggtacacacgtggggaggggcgcgggggagcgtccgatctggctcccccgcgccggtcacccggctacaagtattttcggaattttgggaatgagattagatttggctcccatcggttgccattttacccaaaatggcttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttggcttattctttggctgtttaggccaaacgatggggctatctgataagatcaatttttttcaaaaaatatcttcagattattggatagagaataataaaccgattctgttgcactgttggtgatgctctgaatccccgccccgagtcctccttgactatccaaaagcaccgcccgccgccgtcgccgngacgccgcctagaaaaaa

SEQ ID NO: 6464 - DNA, 260 bp, Oryza sativa
  unsure (1)..(260): unsure at all n locations
cagccttagctcgcgctattcggccaacaagagccataacatggctatatgttgcacttttggattgtattcagatgaaatcaaaatcccggtttatttttctcgaggtcgcttcgctcgggtatgaaactatgctaaaattcatgtcaaacttattctcacaaggtatatcgttctcgggtgtttgcactgcatatgtataaatagcatgaatntacgatgctgtctatggcaaaattttataatgccccttatctctg

SEQ ID NO: 6465 - DNA, 734 bp, Oryza sativa
tctgtctcatcatggacgaggaggtgtgcgccattgtataaacttagtaatccccttggttcattagatattgcatcggtgaaccttccatcctcacctttaaatattttgaacacatctgcaggacataccatttctttgtattaactgtgctgttccgtttcagaatgatacacccagaaaaaatgagactatatatcctagtattcattaatcaatctacttacgaactctgcatcaatctagtatttatgcatgtcttgtcatttctatttaagctatatatatatatatacatatatatgtagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcattcatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatgtatatgtatatacatatatgtatata

SEQ ID NO: 6466 - DNA, 1501 bp, Oryza sativa
acgtggttgatggagattccatatggcatacgatggaggtattgtatgcgtatgggatgcggagtcgaatttggaaggagtccaaatttagtatgattggttatgtaaagtttgtttcttatactagagggtttcctaaggtgtttaagactcctagtatgagtttggttcgtggctttaggttgcctacctcgggtataaatagagggggagtgtgaggcttcccggtatcgcttttgaaagcaattgagttgagttttgagttagggtttcgaatttagtcgaaatttttgtaagaagtgatgttggtgctgtttgtaaacacagagagaatcaataaagtcatcatccactttaagagttcatcgatttgtgtttcactgggtttcggcggtctaaccgacgactcaccggcggtcagaccggcggcaaggtggcggtcagaccggcgggagcgaggcggtcagaccggcgtcgacaacaggcgcggctggcgatctcggcggttcgaccgaagttcgatctcggtcagaccgacgtattccaggcggtcagaccggcgcattcacttcggtcagaccgcgatccgttgaattcgaggataacttttatttccgctaaaagttttcggtttttgggtataccaaccattcacccctctctggatggcttagttattatgattcgatccttcataatactcaaaatctatcttcttctttcgcaatggccatcattttcccggtcatgaccacaggtatgaccatgtagttgtgcctagtgttgctactcctgcacgtggtggattggtgacggcggaatccccgcgcgatggctggtggccacaccgctgccctcggtggctagagtttaagagctagggcatgggggcgtggcatggcccgaggagttgagccagagatggagaggaagatggggaagatagaggacggacgggaacgaaggacagggacgaggattgtggccagagacaggtgaagatcgatggctgatgacgagcggctctgttgactgggattgcaactacaccaaataggaatccttgaccctccattatgcagggtgggtcaactaacccagctatagttcacgccacaaccaaacccctagacctcccacttagtcctaggtctaacccattagccagcaatccaccatcaacctattaaatcaatcaagcatttcaagtaggaatgaaaatggtgactgaaattcccgaccaactgaatatatattatttctctataaatagtgccattttttaccatttccgatttggctatataaaaatttgaatttttttatgttttcttttagcatcatattgtagttctcactaaatagttagactgttaaatatgaaaattcccaaccgacgtaagttgtctttaataaacaatgttgttttttgccattttcatccctaatccaagcataaggcatccatagtcgtcttgtctgcgtgaccacgctcaccacc

SEQ ID NO: 6467 - DNA, 654 bp, Oryza sativa
taaaaaaaaaaaaagggggcggggggggaacaaaagggtcttttgaaaaaaaaaggtttggggattctcccaccctaattccaacctttggggcgccgccttgttacaataaagtaattcccgcccccgcgtgttcgtcttgtcacatttaatgaataatgtatctcattaagttcacatatatgccagtgaaaacgaccgctatataatttacaatctaaaggcaacctctttatatcttctttcccagtagcactccacactcgaaaatggaagcctattcattggtaatacgtaatctagatttgagattatgtagaacattcttcactacaattttacattttggcagcaagccaaatatgatcaaatgcaattttcccttaccaaatatttggtagtgccaaaacttgcttatattttggcgctaacaaaatatttgtacggtaacaatccaaatatgccctaaaaaataataaaattatattttaccagtcttggagattttaatcttgtatagttttcaatataaaaagatttgataactattgatatttatacaaaaatatagagcacagtataaaatcgccctcccctagggcggcaagggggccgcctgcaaaattccatgccccctcgccgcccatttgcagg

SEQ ID NO: 6468 - DNA, 1501 bp, Oryza sativa
catgttttctagcttgtcagtcacttcaacggaattatgtgtcagtgtcaacagttttacatgcacaaaatcgaaaatatgaggctaaccgcacaataaccacgggtattggtcttgtcaatttatttcacatcatcgacgaaccactaatattcacgtcaacaattttaaaggcataaaccagggtttgaaaatatgatgctaaccgcacgataatcacgggtattggtattgtcaaggtagttcatattgacataccgctcggttaacctaaccaagtttaaaaaaaattaagctttctttcaaaagataaatggcaggcgacaaacatttagagatgaaatcgatcaccaaatttgtatcaaattcatgtccggtctccaaggccatccatggccatgtgccaattgttcgatcacacaggggtcctaaatatttcaatataagccattgtgtttcaatatgttttcgatatcaatcatttattttcaaaaatttccctcttcttaatctattgattcggttatatcgtatttgtttttttagataagtttgataataattatggcaaccatataaaatacagtttacaatgacgatatgaacgtgtattctcatgtgctaaatattccattttttcgcttggaataaaataaaaataaaattctaaattttctttaaaattaacagaccttgtgatatggggacgtactccctcagtcccaaaataatggaatgtggcccatcctaaaatgacgaatctggacaaaggcttgtcaagattcgttctcctcggatagatcacaggttaagttattttgggacagagggagtaggtagtccctttctgaatttcactgaaattgtcaatgaggacgagtagtaatcacggttatcaacaaaaccgctaatgagcgaggatcggtatttcgaaaccctggcagtggcacacatacatatagtatcatcaattacgagccacttagaaaaaccaaggcccctaatagcaaatctgtaccacggtttacgtatactatacattgaatttggaaggccaagctgagggtgtgtttagtttacgttaaaattgaaagtttggttgaaactggaatgatgtgatggaaaagttgaaagtttatgtgtagaaaaattttgatgtgatggagaagttggaagtttgaagaaaaagttatgaagataaacaagggctgattgaagtgtccatagcaatcgccaggtaagatgacaaagaagctttactgaatgctaattgcttgctctgccaatggatggtggcatctaatctcaactttctttctgagtacatgtactttttggactcatacatcatgcactaaacacgcactcgtgtgggcagtgtacattccaaaattgatggacatttcatcaaaaaaaaagaaaaatgattgatggacactaacgttaaatctaaaatttgaaacctaataacgacccattcgattatagatataaattaaat

SEQ ID NO: 6469 - DNA, 1501 bp, Oryza sativa
gcctcctcaattataattacaaataattaatatttaactttaagaacatgagtactcccttctattcaaaataagttcttttttctcctcccattaatttatcacaaaatagttttatttttaaataatcattgcatgagagtttgtgaaagcagatgataaatacatttggagcagataaaataattgcattaaaatctgataaactagaaatattctagtctttttttattggtatgtgtggatggataaaaaataaagttattttagtacagatagagtacattcttaccggtggataggttatcacttaaaactacttcagcccgtcacataatcaaaaattagaatctccgaattgatattacataaccctagctccttaatttgcttgatatgcagtttcttgtgtatgtggaggagtttaagcatatatatttcttgatattttttttacaatatactcataataaattaagtgtataaggacgttaagccttccttgatctttagtgaaagaatttatttattatatgatgattaaatagaaacagagcaagtgtcgatataggatgcctagaagttaaagaaaaaagagaggaaaacatccattattcttgtctgtccgaacaactaacttattactactccgaccgactagctacttgatcttataaaagctgcaggcaaacacccaccacacctctaattaacaagcgctatggtggtctataaactatccattaatattcatcttctcagatgtagtattgcttcttcttctatttttaagctgcagcttataagggcatgtccaattatgaaattcagaaacataatttaggtttttttttaaatcgttttgtgtcacttaaccttaacatttgttccgttaaaaacagaagtacaaaagttttactaaaattattcttttttaacattaataacatgttttttttaataagccaaagccctgaaatgcccacgtttagagactaaacttatcatatactctttccgtggacccaaaatatgacaagctttatttcagcattcaaaaattgttatgaaacatatatacttgtccacccgctagcttcttgtcatcttgagcaatcagacctgcatgtgtcgtttaatttctctagctagctacttatgcttactcatccttactaattacaataatctattatctaattcccgtgaaaaaaaagctatacaaatgttatttatattttgggagggaggaagtattatgtcctaggttatctatacatgtatctagcggtgagacatggaagagagaaattaacataatgggggccggcggggtttgagatagacatgtcatttgtttgggatgtacgcactccatgcatcatatcgtacatgtcgggtttttgaatggagatcttttgaatgcgtagtgtcgtccgattgatcgatggagctacaatagctagctggatggatggatgcagtgtgggtgtctactact

SEQ ID NO: 6470 - DNA, 1501 bp, Oryza sativa
tgccgggcttgtagatggcctccagctcgctgaagagcttgtagttgacggcgccagcggaggcggcggatgcggcggcggcattgtcgtcgggcttattcttgaagtaatacgctgggggcggcggcgcaggggagtcgggagtggcgggtttgtccttgggcggcgccctcttgctgctgctgctgctgtgtatgtagtcgatgtcgagtggccgcctgcacagcaaatccaacaaaacaaaatcaatgtcagcaacagctcgctccacagctaattaatctgcacaatttggctgcagctctgttgctaattgatttgcaagaagaatatggcgtgcgggcggggcggggcggcgaggaagaagaagaagaaatgatgagtgcatgcaatggcgaattgaggggggcggttgggttggcttggcgctttttggtgagtgaggtaatcatcaagtcgaaaaagggggagacgaaaaggtgatagctttgcgttgttgtggatgtggctgtgaattctgttgatggagaagaagaagatgagatgagaggaggaatcgcgacgcatccatcatcatcatctgtgtgctgtgcataaatcagagagggaggaggaccctgcgcttgcgagcgatggctccctttctcaatcatgacactattattggccgtcctctgctcccctctcccgagcaaagagagcatcctaagcaaaaaaagctctcctccttttcctctctgttcttctcttctccaccatggatggatgcatgaatccactccaagcacgcactcactcactccaatttcaactcaattttaggctgagtaaggataacttgtacgtaccaggtcggttctttgatggaagtttcctcgtcccccggccaccgccggagcctgctctccgtggccgcctcgtcatccccgccaccacctcctcctcctcctccatgaagcatcatgccgctgcccgcgccgcccccgtcgttcagcgcgtcgtccgttccgccggtggcgccgctgccgccgccgccgtcgacccccagcttgaagctcatggcggcggccaggaacggagggacgcccggaggggcggcggcgccggaggcagcgctcccggcgccggcaccggagctctccggaacggccgcctcgacgtcgaggccgagatggtggtgcgggtggtggtggtggtggtgctgcggggcccacctagccgggggcggtggctgctgctggtgcttctggtggtggtgctgctcgtggaagagctggaggtgggggtggtggccggcggcggccgcctggtggagcagctgctgcgtgaagggaatcccaccggcgccgccgaagtgcgccaagtggggaggcatctgaggcggcgggtggtggtggtggtggtgctgaggcagggcgtggtggtgcagcggctggtacctgaacggcgcgcccagctcctggccaccggccgccgccgccgcggcagcagcagcggcagc

SEQ ID NO: 6471 - DNA, 1501 bp, Oryza sativa
gacggcgaagttgcggtctgaccggccatcaggcccggtcggaccggctgtctgcgccgctccatcggttccattacttgtttgatctataggagcttggctagcactggtagaggctttatcttttaacataaaattggccatgagagggccgaatttagttcttaaaaactcatcaaatcgaccttcaatagttgcatctaacttacttttaaaaataatcatggatgaatctattgtagatgcaacttgttgttggatagattgtgttacctcttcattgcttaccaaatcgggagtgagcttaggacgtggcccgggcttgatgatcacgccttgacaagtcctagtgcacaccctcatcaacgcctcctgtgtgatctccttaatgtactcctccatggacttgcgatcttccccttcgaagtcatccaatgtgattggtatcacattggtcggctccacctctgccttggatgatgactgcttcgtcatggcgaagtcaaagttgagttgacgctgaacggatctccccaatggagtcgccaaaaatcgtgttggcaactttttttgacaagttgacaactacgatcgtagcaccttatgccttgcggtgaccctagagtcgccaaccacctcgatctagcaagagctagacctagatgggttttgacaaataaactggctagcggagccgattctaaataactacccgtctcgtgggcaaaatggaaggttttcaggacaaacctacaaagagatgtcgcactctcgcaacggcggcagacggtttacggcgcaaaccgacaaagatggacaaactaagagatcactaaaagcaatatgaaaaaccggccatgtcccttatataggggttggtcttgccctctacaagcccttctccacgtccaactcgggacagaaaccaaaggaaacccgaaacatgccttcccaagcaaggaaacctcgagacccgacgaaacacagtcggactcggacctgccggttataccggccacacaccgccggtctgaccggccctcaactggcggtctgaccacccaacacacggcggtcagaccggcccactcgaaggaaaccggtagacttccaaattttggcaatctttcctattttaatcctaggtgccaaatttgggtgtaaatagtggtgttgcatcctgtacgctgtgcttctgtccctgtaatcaaaactcaaatcaggtttccggagttaaaaacttgctgaagttgtctcccctgcaattccatgaatgaactagctgttgatctgattgggtagctgagctctatagctatttatattaacaactatgatcaattaagcttatgtatatgatgcgaagactgttcgtagcccgagtttatctttttacacccttgtcacgggaacatgttgatataatgtttgagtaactcgtactgcctagtttgactttaatttatctgatcagctgcattgcacgtatttgattcctggc

SEQ ID NO: 6472 - DNA, 1501 bp, Oryza sativa
aactttagatttagaagttccacttgttggtgacggtgacttcaactatacccattgagaattttctgtgttcttaagccaggaatcaaatacgtgcaatgcagctgatcagataaattaaagtcaaactaggcagtacgagttactcaaacattatatcaacatgttcccgtgacaagggtgtaaaaagataaactcgggctacgaacagtcttcgcatcatatacataagcttaattgatcatagttgttaatataaatagctatagagctcagctacccaatcagatcaacagctagttcattcatggaattgcaggggagacaacttcagcaagtttttaactccggaaacctgatttgagttttgattacagggacagaagcacagcgtacaggatgcaacaccactatttacacccaaatttggcacctaggattaaaataggaaagattgccaaaatttggaagtctaccggtttccttcgagtgggccggtctgaccgccgtgtgttgggtggtcagaccgccagttgagggccggtcagaccggcggtgtgtggccggtataaccggcaggtccgagtccgactgtgtttcgtcgggtctcgaggtttccttgcttgggaaggcatgtttcgggtttcctttggtttctgtcccgagttggacgtggagaagggcttgtagagggcaagaccaacccctatataagggacatggccggtttttcatattgcttttagtgatctcttagtttgtccatctttgtcggtttgcgccgtaaaccgtctgccgccgttgcgagagtgcgacatctctttgtaggtttgtcctgaaaaccttccattttgcccacgagacgggtagttatttagaatcggctccgctagccagtttatttgtcaaaacccatctaggtctagctcttgctagatcgaggtggttggcgactctagggtcaccgcaaggcataaggtgctacgatcgtagttgtcaacttgtcaaaaaaagttgccaacacgatttttggcgactccattggggagatccgttcagcgtcaactcaactttgacttcgccatgacgaagcagtcatcatccaaggcagaggtggagccgaccaatgtgataccaatcacattggatgacttcgaaggggaagatcgcaagtccatggaggagtacattaaggagatcacacaggaggcgttgatgagggtgtgcactaggacttgtcaaggcgtgatcatcaagcccgggccacgtcctaagctcactcccgatttggtaagcaatgaagaggtaacacaatctatccaacaacaagttgcatctacaatagattcatccatgattatttttaaaagtaagttagatgcaactattgaaggtcgatttgatgagtttttaagaactaaattcggccctctcatggccaattttatgttaaaagataaagcctctaccagtgctagccaagctcctatagatcaaacaa

SEQ ID NO: 6473 - DNA, 1501 bp, Oryza sativa
tatgcccccatgatttatattcaataaatataattaagatacctcatagtttggaatgaggaaaatcaagcacatctaaacctacagtcctatgtcaaatcctacaattggcatgtcactcatcgattagcaccactatatgacagaaggatggagcgagacacggaaagcaagaagagcaggacagaagttatatcaaactactataaatccagatgtcaaattttacatccaggtgcaaatcattctgtagccttttagcctctatcaatgcaagcaaatattgagcaagtacatgcatactgtaccaacttcaaggggtaaatcagagcatgctcatgcaaaactttaacaaagcatatgatagttggaagttccaaataaaaggagacaactattttgtgcatacccttctactgccacaagacacctattatttgggataagtcgccgaaaggaagccttttcctttatagactctgaccgtgcattgaactgcacaataaaatatttcagtgattaaatcaatttaaagaagcacagtaatgggacataataaaatgtaaatcaagctctatagcaggcagtccaatgcataagcaatgtggagtaagacatcagttttagaggagtcaaataaagaaatgaataattttagctataaaatgaagcagctaagctagcgtacataggaacagattcccattctgatgtccatagaacatatttttaagagaacattccaaataaatgctagaatttgaaagatgatagacaaataagcacacagaaaaatcaagaatataaaatatatactaggatgacagcacaaatatttcatgttttggaaaaaaattgcaaagcattacactgtgttcaatactccctccgtcccaaaatatagtcgcttctagcgtttaaatgtggtcccatcatatagctacttctctacctactccatttcaaccaatcccagccatctcccatttaatttctccacctactccctcatctcaaccaatcacaaccatcccctgtttaatttcacctctctccttaatctctgtgaaaaactctagaagtgcttatattttgggatagatggagtagctttgagtgtactaacaacctgtcctttcaaatggggcattattaccataaatgtgacactgaaaaccaacatcacaattgcagaagccgtccaaattgcctaattggagtaaacgtagtaatcaaacaggaatcaactaacttggatggttaaaatttgcagctcccccctgccactcatcgccggcccgccacggtggcagggggacggcgccagagatgttggcgccgtcccgttggaccacggagctagcgactctggcgtcccaaaaaagaccatttctgggataagttttccaggggtctatttgcaaaataagtttttcaaaaggaccaagttgtgaaaaatccagagggcgagaaggggccacctgcaaaattaacacggcat

SEQ ID NO: 6474 - DNA, 1501 bp, Oryza sativa
aggactctggatagagaaagaggttcctacgcaagtattagagtagtaattaataacttaggcgtggtgtctaggttagggactacctttgtttgttgtgtatcccacggatttgtcagaggtaggcgataggtggtgacagcctgaattccgtcccggtaatcctccacgttcggatacatcatagagctatagccagaaccacgctggcagaccagcaggggtcggtgcctgaagcaatagataggaaattatctttgcttatcttagataattaaaacacatagaaagtcctctctagcctgcctacctttagtttttgtccttggatagtcttagccttagatagatttcacacgttccctgagttcgatatccttttggggtcaccccattagttgttaatttatccaagtctaggtcatccttgtatctttttttttatttcttcttcttttattcctttccatgatggagcaacccacaattcaaaacctttctgctcctcgggttgatctttttgagccatcctgttcttcacaaccaatcctatccgatggctacgaaatcagtcctggctttatagcaaggttcgagagaaaaccttctctggtagtatcggtgaaaacccatacctccatcttcgggactttgagctagtgtgttcttgcctatccatgtcgtaggcatgacacatgaaacttttaagtggaaattgtttcctttttctcttagagatgaagcgaagcaatggtacaatctgtctgtcaagaaattccacggtgaatgggaggagcttaagcgaagcaatttctgccttactttctttccactaacccgtgtaattaatcttcgattagacatcctctctttccgatagaatgagaaggaatctctcggtgctgcctgggccaggttctcactgttaactcagtctggcccagacttgtctttacccgaccatgtgttgttacaacattttcggtactgattagacaaggagtctgctgaaaatctcgatatttccgccggaggatcattcgcacacaagacaactactgaaggaagagaactcttagatatgatcttagagaacgattctttcggctgaagcgaagcaatcccagaggtcgagattatccatgaggaacctctgcacgtcgagtcggaatccgactctactgctgaatcctcatcccagtcgcaggagccggaggaaaaagaaattcatcctccggaaaatccattcaattcgaggaggatctttttgatgattgttggaacacctcgaattattcctacgacaagagaccaccgaccaaggtcaattctaatgatcctctcgataaagctatgcttaaagagacggtgaagaagttgaccaccatcatgagtaacaaatggttgaggggaggagagctctcatgagaagcaattcagatccgatgcccctcctcaaccgttacgtgtctcattggagggaaattggtccgtgctctct

SEQ ID NO: 6475 - DNA, 1501 bp, Oryza sativa
cttgcatagcgtccaacaacggcacgttgatgtggatcttttggataacttcaacaaaacgagcgaactgctcgtccactgacggtttcctactccgctgagggaatggcagcaatcgtgtgtcgcagtactcctacggcacggtcttctctggctgaatctccttgttagccgagtcagtagatgacttttcttttgacatcccattagttcctgcagggttaggatactacggatcacgagtggacttacctcccctcgttgtgatcgccttaacattttcaatggaggagtcgggttgccccggaatcctcctagattcatttgcagggactaaagatgccaactgagctaactgggtttctatcatcttattaaagctcagctggttttgaaatgcggaagcaaagccatctagattcacatttatgttttctaagatcttatcattggcagcaagctttttgcttagcgcatcagtggttttagcttgcgcaaaatcaagattctaggttggttagaggagttatcgttattatttcctccttgatcatacgggcgtggttggttccactcctgacctccttgtggacgataccagttgttcttgcccatgtacatcacctcctcacaggtttccgggcattcattcccagaatgacccgtgccgccgcagacctcacacgtgacgtgagattccaaggccttaacggtgccttgtggccgtttctcgtggtcgtccaagcgtttcatgaggagatccagcttggcagcaagtaactccgtctccttgacggtgtgcatgcctcgctaacgagtctggagtcgttcctcgctccaacccatattggagaccatcttctctatgagttgaacggctccttgaaccgttttagagaagaacgctcctctagttgccgtgtccaagtgatcgcgggacatcggggtgagcccattgtaaaagttgtgcaggatcagccagtcgtccatcccatgatgaggacaggcggccacgtactcctgtagtcgttcccatgctttaggaatggactcatcccttgtctgctggaaactagaaattcgtccacgaagggcattggttctgcccatcgggaagaactttgagaggaatgccgtagagcatttatcccaattgttgatagcagtacggttggcatagaaccactacttcgctctcccgaggagggagaacggaaacagccacagcctgacggcgtcgggactgacacccttgatggtgtatgtgctacatatctccaggaattgctgcagatgagcgttggcatcctcattaggcttgccacagaacgggctgttgatcctgaggctttacaagacaagggctgttgatcctgatcctaggcgtcagagggtgaactatttgaagaatctgcccaagtgtggaaaggatagaatgatgagtcctgacacaatgcctgctgactctcaggatgacagattcaggaccttggtacaggtt

SEQ ID NO: 6476 - DNA, 340 bp, Oryza sativa
ttagaattggctattctatctatatataaacatctggaggtaaaaatcactaagaaggatggaagaacaacagacctgtatgtgcgacagcaatatttgctcacttcaattcaatagcacacataaaaaaacgcaactcacttagcaaatatgaagccttccctcaggatactgtgtggtataaaattaattagatgaacaggtactatcatcaaaaggaataagttcatattatcactgcatgtaccaataaaagaatcaattcaaaattaaatatgtttttgtaagccgcataacaaaataaaccttatctaaatcatgtttgctctaccttctcaga

SEQ ID NO: 6477 - DNA, 1501 bp, Oryza sativa
gaacccgatggtggcgacagcgactggagaaggcggctgcaaaggcggcgtggcgcggctagtacataaatgtaaacaaacatgtaaatcatgattttagatgaatttagagacttgaaccacttaattccaacttcaaataaattagttatgaattttacaagataaatctgattttagccttaaacaaaaaaggattaatgatgtcatgacgacatcactaccgggcatggtactggaccacaccactgccggcgatggagggtttaggcggccaaaccgaaggcaccagaagaaagaacacgacgtgggaaactcactgaggggcggcacgacgaaggacgacaatgaaaaacggccggcaacgagatcgaggcggtggtgagctcggcttgacggcgtcggcggcgctccagcgggcttcggcttcggccgagtggtggacggtgtgcggctcctcctcgtgaacctgatggtggcgacagcgactggagaaggcggctgcaaaggcggcgtggcgcggctggaaactcggcggcgacggcggcgctagagcagacgcggctagggcgctacggccgacggcgagctcgggcgagggtggcaaacgaaagaggagagggaggggactctatttatagccatgggagagagagatcgggcttggaacgcaaggaatcgcgccgggaaaacctagggtttggtggagagataaactcgcaaacgaatccaaattcgcgtcgaattcaaagggataaaactggatttttgggggaagagatagaggaggataagggaaacaaatcccctcaactaattttcggaatacacgagagataaggccggattcggaggagaaaaaccgagccaactcggtctcagttcggctgtcctgaggttgaagatgaacaacagcgacagggaggaaaagtagacttttcactggtctgaaaagaaaagaagagagggataagtaatagacttcttcgagaaagaaggagacaggaagcagagacaggcaaagaggaaggacgggctgaggatgacggatagacttttccagtttcagcccgaaaatgaaaaggggattttaattacttttccaattaaattaatcactgaaatgatccttgaattgttaaaaatacttatattgctcaaataatttcaagaaaaatcctgaaagtacttgaacactataagtatttaataaaattataagaagaccatttaatgattaatttaatatgtgaataattactgaaatgttctttgtatgattaaaattaagaattgagctccgaaaaatccgaaaaaatttcagagagtataattaatcatggagaatttaataaaaattaaatccaaccatgctttatatttaggaaatttgatttcccacatttaacttcagttgtaaattaatgaacatttaatataaattctaataataatttcttaaataatttataaatcctaagatgaaaatcaggatgtgaca

SEQ ID NO: 6478 - DNA, 499 bp, Oryza sativa
tacagtagcttatcaccgtcgtccagccgccgtcacgccgcgccgtgggcgggccggccaccgtcctccaaccgcccgggccgccggccaccgcccttccggccgcgcgcaccgccttccagccgccgtcacgccgcgcgggacgccgtcgtccagccgccctcccgccgcgtgggcgtcgccggccaccgccctcccgccgcgcgcgccgtcgtcccgctttccggccgcgcgcgccgtcgtccagccgccgtcacgccgccaccgcccctcccgccgcgtgggtgtcgccggccaccgcgcccccgccgcacgggccaccggccaccgcccctcccaccgtgcgggccgccggtcgccgctcctcttgccgcgcgggctttgccggccatctccctcctgatgccactctagctggcactcttccatctacaagggtgttttagacatttggaaccacacataacgtgaaaatgaaggaaacctaacgggaggggca

SEQ ID NO: 6479 - DNA, 711 bp, Oryza sativa
aaccataattatttttgtcactaagattcaaaccctgacgaatgaagctgtacgtgcccgattccacgccgcatgaatggtgcttcacataaactgataaattcaagttgcgttttgtttgtttccagagaaaagaaataatcaaatgccactgtcagccacgtattgttttgttcttaattagcaaagcgtgtaaaacacatcccccgctaactaaatgccatcgaaatttctgttcatgtgtttgactgccgtatagtccatgagctttaatctagttattcgatttatcagataggcaagtggtttaaaagacatagttattcaatggtgagtcgaccgaaactaaactcgatttatcatgacataatagacacggttgccacttgccacagaaagaataagagcgctgctacacgtacttaaaagtgaaatacttgcaaaatccttacaaacaataatctgaactgtttgatttaactagacgagagttacagaaaatctatatatactcacagtttgataagagtttagtagaaagaatttcatatttatagcctttttccagaagaaatgatcaaatcaagaagtgaaaccggccggagaaagtctacaccggcaggcccggctcatgcagcccacgttaggaagcctggctgcactgggtggcccaacggtggggtgggccacctcgggccagccgcagcagaa

SEQ ID NO: 6480 - DNA, 675 bp, Oryza sativa
cgtatctcaatatataataaatactctctccggttctataatttttgactttttctttataatgacacggttttcaaaacatatctttgctatgattttctattataatgtatacaataaataaatatttatttctattatagtacctttagattattctatatgtgttattctagtttatttaaactaatttttttagttactagtagtttaactttaaccttgtcgaaaatattaacaattactcttctggcattggagggagtactactaaacaaatctcttttgctttcttgagatttataatgttttttttttgaaagagacgtgctatctcttctagcaattttccctagtaccgtatacatcagcagtaggacatggctatgtgcatccggcttgatgtagaagccaagtttatattccatttaatttcttaattaaatgaaacatcagtatcaggagttcaggaccagagaatcggaccagcaagaaatatatataatatatccatgcatgcatgcaaaacctttctcatcactataaataggtacgcaaatctcgatcgagctcgccacatcgatcacaggctaacagctgcaagaaagcaagcttaatcaatcaattaagccaagtggtacattaattaattacctcaagcaagagtaacaatgc

SEQ ID NO: 6481 - DNA, 1501 bp, Oryza sativa; identical to SEQ ID NO: 4677

SEQ ID NO: 6482 - DNA, 1423 bp, Oryza sativa
agggtcccttgattcctaagtcccttgattcctagaaaaaacatagtaactttggaagatttcaatcatatcggaaaatttcccataaagtttttttcaaacaaaggattgaatcatatcctctcatttgaaattactatggaatagacaattctatatagaatttggaggagaatagcaagagcctcaaccttttggaaaattttctgtatgtctctcttatctgatttctacttctttcccacgatccactgaaacagtcttttcctgtgtttttctcgcgttttgcgattctccattttgtacttgtatttctgtcagaatcctacatttttcttatttctttgtttttctgttcctatgattcaaagggtcctcataattttataacatgatcaatatataaataagttaatactattaggttgagttctttgctgggtgttaggaactcatctctcacggacgcaaaacaaagcgattcattagcgtataattaattaagtattagctgattttttttgaaaaatgaattaagatgatattttaaagtaactttagatttttttaaaagaaaaatattatttagtagtttgaaaaacgtgcctgtggaaaacgagaaagttgagttagagcaggtacaatagcaggctataaacctgctgcaaacatattttaagaacataaatgaggagacagaagggcagcgggctacagatttatagccagctgcagcacggactccaagacgtaacgtgtgtatgacaggtgggaccaagtattaatagtgtagtatataattattgtatgaatgagctattagattggctaaagatgaattagagttagggcctgtttggcacagctccagctccagctccacccctcctggagctggagctcagccaaacagtttcagctccaccaaaattgagagtggagttgggtggagctctctcacaaaatgtactagagttgtggagctgggtttaggcatctccgcaactccactccagactcaactcctggagttatatttaggagttggagctgtaccaaacaggcccttaatagttggcacttagaagtctaaccactccagtttataactcagcgttaatgaatatttaagcaacccaaatagtacaagtggacatcgccatcattaattaatctacatcaaaaagaaaacgacttccctaattaccgttcttaatcacaggagcgggggtggccgaaagcccgaaaagctttcacacagtcagagactcatcagtcatcagatccacttcctctcatggccacccacacgcatgcgcagttcaaatttgaattctagcgagatcgcccattactagtctcctctactctaccaccccccggctcccccacctggccacctcactcagtttccgcgcagcca

SEQ ID NO: 6483 - DNA, 325 bp, Oryza sativa
caatggagcccgacacaaggcatcgccgtggtgacacaaatagctaggggtgggcatatttagaccgaaccgaaaagaccgagaccgagaccgaaaataccgagaccgagaaattcggtaaccttttcagtctcagccctcaaaagaccgaatttatttcggtcatttcggttattgggctcagttaaccgaattaaccgaaatgacagaaattttggcccaataggcctaggaagtccaataagcccataaaaaaaaccctaccactactgccgcacagcgccgcctcctcctctaaccccaccacgccgcctcctcctccagc

SEQ ID NO: 6484 - DNA, 313 bp, Oryza sativa
agatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcaaattgcagg

SEQ ID NO: 6485 - DNA, 272 bp, Oryza sativa
tgaggggaaatattcctgttatcctcctttatcttttcccccaagaatcggactttatcccgaagaaatcaacgcagaatcgagctcgattcgtgtttttctctccaaaccaaaccctagaaaatcccggctccgattctctcgttgttggatcgatctctctcccatggctataaatagagtcccctccctctcctctttcggctggcacctctccctctctccgccgtcgcttgtagcgccgtcgccgcgttcgtcttctctgtccaccg

SEQ ID NO: 6486 - DNA, 1501 bp, Oryza sativa
aactcaagcggaggtcgaggtggcggttccaagattggaagatcgagagtctcttcgggttccgcttcttccttgatgaagtcagggacttcatcttccaaaagggcctcgggagactcgtgaggaggaactgttgtaaccttctccgctgactcaatctctaggagagaatcgatcaaggcgaaccttgcccgtgagaatgggactgagaattcattccctcccaaagttatcttgaggctatctagccggggtgtgcttatgaggagttgctcaatgggaagcccgattagaatgtcaaaatcttggatttcaaaggcatggacatccaagactggctccttgtcacgcccggaaattcactagtaatttccgaacttatttgtgcataaaacagtcatccaggaatcagccgaggtacataaactgacaatttaatatacaaatccatcaaaataactaaagcaattaatacttactgaagaggcacttagtcctcacaacgaagaaaactacagcggaaaaataaaatctagcgaaactccggctccactcccactagcaactcaactgggtataagccaaacgtcttctccttttggatccttttcttcaactgaggttgattgattattgcaaggtgagcatatgacatggactccctagcgacccccacggacttctcgccgcttctcagtatggtaccccgcaatgaatcatgctatacagaagataaagccgttgcccacgctggcttgtggttagcatggttaatgtctcacaacagtagctcgcaaaccggtccttaattgtcatgagcacgaccttcaaaaccatgtgctcacaacccaccattaacaagttttaattatcaattaattatcataacacgattaaccatcgtgagctaccattaaatataatcataaataataatgtagtatgattcatcccattaatgagctaatgtttctaagcatggctaagcaattatatatatatagcttttagctgaaccaaaccaatatataaggttcaagctaatcaatttgttacccaaggtatcaaggaatagagtaatcaatgcaaattggccataacaaaggaataggttcacaccacccggtgacattcgaaaataaatgcacagttgaaataaatagagaatttaaatataggatcaacatgctcaaaggaattgtgtttgggatctgtgtgacttgccctgcaataatcggtcttcaattagtcttctgaatctcttccgacacactcacgagccttcgcaacgacggaaacgacaagctaacacgcaaaacggaaaaaaagactaataaaaaccaaataaacagtacatataaagtaaacaaacatgtagatcatgattttaagtgaatttagcagcttgaaccactcgaatccgagttacgatgatttagttatgaattttctaagattaatctgattttaagatttatttttagaagggaaaaaggcttca

SEQ ID NO: 6487 - DNA, 1501 bp, Oryza sativa
cacctgccggcggggcgctccctgccgggagtaccagcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctgg

SEQ ID NO: 6488 - DNA, 1501 bp, Oryza sativa
ggccacatcgccctctggtggcttgatcttccagaggaagcaccgcccgcttgactccagcgccgcggcgagctccagcatgtgctcgggtcgtatcatgctgttggtgccgaacgagatgtacagcacggatcccggcggctgcgtgtccatccagcgcagcacggtgtcgtcggtgggctcggtggctgcgtcgcggcggtcgcgcgagagcggcccgattggccagacggggaggactctgagcgtgcgccgcagcatggcgagcccggccggctccggctccgccacggcattgaccagcaccgcgtcggtgttgttgccgtgagctagctgccggtccaagaaccgtctgtctgctcggccgccgctgccgtcatttgctgcaccggcagcgggcaggccgtactggtagagcatgtacttgggcacctgcgacctgtggatgacaaggtcggtcggggtactcagggagaaacacacgtccgctcggctcctccgggcgcagagggaggtgggtgaagagggagtgcgtgacggcgctgccgaacgcgccgcacgaggcaaagaacgcgtggccgcacccgtgccgccgcgcaacctccaccgtccacgcgacgaacacgtcggagatgaccacgacgcgcgctgcggcggcggcggtcgacgcgacgaagtcgtcgaaggctggctggagcgtctcgaacgcctcgtagagggggatgagcagcggcgggaagatctcgtcctgggactcgccgccgggcggaaggccgtgttccgccgggtcgaagcggagcgcgtggaagtcgaggaacggcgcggcggcggcggcgcggagagcggcgacgttgcgcggggtggagacgagcgtgatggtggcgtgcgggaggatgcggtggaggcggctagcgagggagaggaagccagcgatgtggcctttgctcgtgaaggggaagagaacgtgcttcttcggtgtggacatggcctcctacttttgtcgacaatcctactaactcttaagttatggggagttctatactatggtgacatttttattcagctcggatatctattcgtcatcagagatcagacaaacaacacgccgcccacgtaatgtcgacacattttactctttgccctttaatattgttcaatatttttagggcaaacacgttttgtggacccaaattcgcaaaaagttaggttattttggagggaaacaattgtaaattttgcataatattttttccgagttgagttatttgtttcaaaccatcaacaaagcgtgcagaatatttttaccgccaccaggattggtcagcttgcacggtatgcgttcgattaggatggaccgctgggtattgcctaactgctttcccaacaagtaaaacggtgtcataatctatctatctatctatctatctatctatctatctatctatctatctatctatctatacctatactaattgaatactttctacgagtcctcaagtta

SEQ ID NO: 6489 - DNA, 1501 bp, Oryza sativa
tcctggctgagccgagccgctgcatgctgcctgctgccttccaaacagccaacgcatacatgcaaacctcaaagccaaccaatcagcaaactgcacatgtacagcaccatacatgcatacatataacctgcatgctacagtacctcgtgtactgtagcaccatatacctccaaatattatcactcaatttccttcgcgaacaccgacgcttgcacgcacacctcgtgaagcccgttgcgatttgcgaagatctctcccacacggtgtccatccaccatgcgccatctcgtatccaacttcgtcacccggcatccttgaccgtctggacctcaactcctccccgagtttagtcccgatcctcaccgttgaccgaagttgacctccaagaatcctgactctagtcaccttctcacatggtatcccgaccgcactagacctctattcctccctgaacatagtctcggtcctcaccattgaccaaggctgacctcaagtcacctgcaaactgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggagaaacacacgcgcgcgctcgctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcgtgcaacatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcacaacggctcgtcttcctcttcgctcgcgtgtttcgtgccttcgtagacatctgcgaaaagtttcgaccaagcagtcggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 6490 - DNA, 336 bp, Oryza sativa
actcgccaaggcctcccagacaactcaaaacccaacggtcactcttccccatcgaccagccaagcccaacttttttaagcgcctagccttccgttcgcccaccgcaccgcgccacgaccgagaccgaaacgccaaaacgccgcgcaaatcaccacgccacgccccgcccgcgcgcgtctcgtcgcgcacgcggagctgaactcggccgcgccggccgaggaacggagcagcgaagcgcgtactacacccgcgcccgcgaaagcaagcgcgcacgtacggagaggtgtaactagttagatagaccccgtcacgcgcgcgtggttgggaccgatcgga

SEQ ID NO: 6491 - DNA, 161 bp, Oryza sativa
caaaccagtcgatcggctatcattgaaggactcatttcgttttctttctatatttcttattggtggcaggatcaaaccaatgggcatgcctagaacccgaaagcaatatttaggacctgcactagagttaagcaaatctctcaggccaatgtgtgtttttt

SEQ ID NO: 6492 - DNA, 1501 bp, Oryza sativa
ggagttacttgcatcgtaactcctatgtcaatattgtgcaacttggactcgagattagaaataggtgttagtgcacagtggcatatctgggatttttatatgggtgatcgaacctatacttttttagaaataccctaaatataacaaagctataagtataaattgatcaaatatgcataacaatatattaataagggagttagtattttttttactttttctaattttttaaatatatgtgtatatatgtattaggttaggattttttttccggtggtccttggatccgcttgtgttactgtacctcaattagagggatgagcttgtgctcgttttcttcaccagtggtagtgattttttttccatctttcagagtaaatctaacagtctaaaacttaaatattttccccaaaaaatccgtcgaaagaaaaatagcaatttcgtacacgaaaacatatagctactgtttcttaaattaaatctatttatagtatagcaatctactgttgcaaggaaatgtgcctaatacaaacaaaatgacagctcaatcaacacgcaccaaactgaaacggcccacgacttatattgagaggaaggacatctatgggctaggcccacgacattatttttcaacttctcagggagaaaaagaaaagaaagcgaagaaatagactacactcctactgtcctacatacagtatacggactaccaatgtggagagagctgtaaacatctggtggagccacgcacccgatgccttttccttttctttcacggtgacgtcgcactctaaatagatcgaaatactaaccttggcatatttcactcatgaatcaaatacatatggagcatagactatagaggctttgtttgtttggggtgtgtttttgtctagaggtaaagtttttaaagtatacagatacagatttgaagtattaaacgtagactaataataaaataaattatagattttgcctgtaaactgcgaaacgaatttattgagtctaattaatccatcattagtaaatatttattatagcatcatattattaaattatggcgtaattaggctaaaaaaatttgtctcgcaatttacatgcaaactgtaaactgtgtaattgttttttcccacgtttaatgtttaatgtatgtgtcaaacatttgatttgatgtttttgttcaaattattttatctaaaccagccttggtgcatcgagatatcaatttcatttttgggggcaaattccacgtggtagacggttgagaggatcgcggtcgacgtggcgacgcctttttgatggttttttttttccccgcaggagaatctgcgtcgcgcactgacccgtacagcactcaactctctctctaacctttcccccatcggatcggttggttggtcgaatctacctcgctacacagtggtaggggtagagggagggtagaagagaagaggggggaatcgccggagggttcgagaagattctagagggatggaggagg

SEQ ID NO: 6493 - DNA, 1501 bp, Oryza sativa
gttttcccatgacttgcatcatgttgtattttcacttttgcgtcatgttagtggccttaaatcctgtagacctaattaattaatattctctagggttagagttaatcatgggataaaaaaaattaaaaatagatatagtttaagataagcacgtcaagaaaatagaccaacggtataccactgtgcctcacgttaaattaaaaaagaagtctttttctcaatacattctactgctacaaatatgatgctcagatttttatgattagcttgtgagttcaaagcaagtgcctaatagattgaggatgtggtgcttacaatcgaacttcttaactgcaattagtcaaactgacagaaaacttttatgaattaattactgatatgcagtgaccacggatggacttatttggggcaagcaaactttgtaaatcaacatctcaatacataaaagttataatatgatcatataaggtaaataccaaaaattgttggcctgcttaccgggtcactgcatggatgagcttggctgcacgtcttccgtcgtgtcgcgatgcgatgatcggccttgcgagcagaacgtccaggcgggatgaaagaagtccgctcgtcaccatctccgggcggccatgccagcgagcggaactggagtgcaaagaaggaagtcctcacgtttacgagcaaacatacgtaataagggatgagatcgatacattaacatgtgcaaatctaaggttggatctaatctagatatgattggactttactgagcccacggtacataatatacggttagaatgctaatcgatggctatatatttctagttaacgtgagggctcgtagaaagtgtccaattagtataggtaggtatagatgtgtatagatgtgcaaatctaacgttggttctaatctagatgtgattgggctttacagagcccacggtacataatatacggtcaggatgctttaatctattgaatcgatggctatatatttatagttaacttgaggactcgtagaaagtattcaattagtataggtatagatagatagatagatagatagatagatagatagatagatagatagatagatagattatgacaccgttttacttgttgggaaagcagttaggcaatacccagcggtccatcctaatcgaacgcataccgtgcaagctgaccaatcctggtggcggtaaaaatattctgcacgctttgttgatggtttgaaacaaataactcaactcggaaaaaatattatgcaaaatttacaattgtttccctccaaaataacctaactttttgcgaatttgggtccacaaaacgtgtttgccctaaaaatattgaacaatattaaagggcaaagagtaaaatgtgtcgacattacgtgggcggcgtgttgtttgtctgatctctgatgacgaatagatatccgagctgaataaaaatgtcaccatagtatagaactccccataacttaagagttagtaggattgtcgacaaa

SEQ ID NO: 6494 - DNA, 589 bp, Oryza sativa
  unsure (1)..(589): unsure at all n locations
aatacatgctgaatntgcctttcatcccatcgctgttgcacacgcataaatttagtatgcttttaatgtagatatgcccccccccctcctctttctatttgcgaaaattagtaattttcaatgtacaggcgcctgtctttccaagtggatacgcgatagtttgtagaatacttttggaaatcaaccttagagattgtttatatagtttgatggtgatggtatttatccaatcccaaagtattgttttgccggcgctttgtttacacttagtgaattcctttacatttttccattttcaggcaaaaggcaaagaagacatatactccattttctacaaagggcagaacgggactgcacaagctgggactgcaggtagttgtggtcttgtggattgacccaatctcttccttgctcttatgtaggaaggacattcttattccttggtgccattaaagacactgttgcgaaaatggaacataataataagcacaactatatataaacgaattcaaataaacccaaagaataccagttccatataaagcttgaaaattagtagcctcgtacatgacttgtgtaaaagacaaat

SEQ ID NO: 6495 - DNA, 731 bp, Oryza sativa
gtttggctccaccaccaccagatccggccgccatggcatcggtgccgccgttgccgtcgccgtcccacaacagacaatgacatccttcccgccggcgccgagcgtcgccggatgcctccccgccagatccggcgcagatctggtggcctcgtcctccgcagcgcctctaaacttcgtcaccaccctcgccaaacgccactgctcgaacacactaccacgccgccggctacctccccgccagatccggccagtcggcgcggatctgggcggtttccgcctcccgatgctaggcagtcccccctgcccttgtgcagtgagacggagcgaagctccgccgccaccatccttgtggccgcgtggctttgcccgtggccgctcgggcagcgtcgagatggaggaggagggagggagctgtgggcgataacgagctgggcgcctcccgtgtcacccgcagtttatatctcaaatagtaatgtttaagcaacaataaaacatcttacaaatgaaacaaataatcacacttaattgtaccaacaattggtctcattatcttttacacacatttgattttggacacatcgaattcattagagggcaaaatagtaacaaaaggcagttaaataactaatctaaacaacacgaacattaacaccatcaacgaataataccggagagtccccgcaaaaaaaaaataccggagagaaaaaaattctctggtctctggtcaaaaa

SEQ ID NO: 6496 - DNA, 1501 bp, Oryza sativa
tcctccgcagcgcctctaaacttcgtcaccaccctcgccaaacgccactgctcgaacacactaccacgccgccggctacctccccgccagatccggccagtcggcgcggatctgggcggtttccgcctcccgatgctaggcagtcccccctgcccttgtgcagtgagacggagcgaagctccgccgccaccatccttgtggccgcgtggctttgcccgtggccgctcgggcagcgtcgagatggaggaggagggagggagctgtgggcgataacgagctgggcgcctcccgtgtcacccgcagtttatatctcaaatagtaatgtttaagcaacaataaaacatcttacaaatgaaacaaataatcacacttaattgtaccaacaattggtctcattatcttttacacacatttgattttggacacatcgaattcattagagggcaaaatagtaacaaaaggcagttaaataactaatctaaacaacacgaacattaacaccatcaacgaataataccggagagtccccgcaaaaaaaaaataccggagagaaaaaaattctctggtctctggtcaaaaatggcgagagatgcttgtatcagcacgagaaaattattgcacgagatcaaagataaaaggagaggtaggtgtcctgtttttaattgttttgctaatgataatgacgatacagaagatggattaagaccttaattaccatgtacagggcataattgtgtgttcatactgattgaggccgacatgaacggctacgggcaccaaccaacgtgccgtctcaatcgcatcattttccactgccgatttgggatttgttttttgcgtgataacaaatctagcaaggagatgcctaaccttgcaaaaaagacagaaaataatcagctctgaaagtgttatctgatttactacataataacaatataaaattaacggtctcgttgcaaggaccacttgttgatttctttgtcaatattaggaatactagcatattgcccgttacaaagggattttaattaaataaatttattattaacatgttattatcatctcgtaatcattgtacatgtgaaccttattaaatctatatttttttccttcccaccaaagtaagagttggtgagagtagttgatatatgagcactctaaccctacatgtctttttttttttgttaaaagatgggagttggcattggggtggtggcaccactactcccttttacaaggactcaaggatagatagtaatgggatgataaaaatactggtatgagataaatacatgtgaaaaacatagaaacaatggagaaacttgtttaaaacgtataagaaaaacatagtattagaaatatgtttttttttcactaagatacttaaccatatcataatgtaatcttgtgatacctacttgaaaaataaaaaactatccgcttgtgaaattacttattttattatacataggtactatatatatatatatatatatatata

SEQ ID NO: 6497 - DNA, 757 bp, Oryza sativa
  unsure (1)..(757): unsure at all n locations
tttgtatgtcctcaccgggggacatactattcagaaacatctttttgtggagagagagaggagagctctcccaccactctccacccgtgttttttattgtaaggagcgggagangtgtttgtatattctctccgtgnggggtaaaaccacacgagggtgtgtgttatatgtagtgccatatatacccgccaccccacccccccccttcaaagaggttggcgcccctccagaacaccgtttttatacacgtctatcaggtgttttatataagagacggtcccccccaatggtgttttgaacctcattgaatggtagagcccataaaagggccccttgtgctttcacaacactaagaaatggggcccgtgttggcgaaaaaacaagaattcgggttctttttccaacgtggggcggcgtggctattatcttaaagaatggaagaaccattgtccataaattcaatgaaatgggggttttccaatttgacgcaaatctcaagcccggagagagttccccacccaaccccttttccaagttaaccttaaagcaaccggcgataaccagagggaggtttgccctaaacctgggggccattagggtttcaaattaaccccacagttttttctttgtccaaaaacttaccttccctcaggtccaagcggcttcccaaaatttatagacacaacttggacgggggggttaattgggaagggaaaagaaaattcctaccccaacccaatcccaacccgggaacaga

SEQ ID NO: 6498 - DNA, 1501 bp, Oryza sativa
cgaggctgctatcatcaaccaaccagccaagcttcctaagccagaaggacatcgacgaagccaaagagaacgataggacggccaacaagccaccacttcccaccggcctcagccatcatgtggcaaactctttcgaccagtctgcatcatcttcgtcgaacagccagatatgaactccatcatgtggcaaaccctttcgaccagtctgcgtcatcgtcctcgaacagcgagatgaatccaatctgtagttctatatagaagctgttgctattcccgttgagaaacctgggccacgctacgcagttttgatttaatatgcataatatcacctgtatgaatccacggatactctcctggattgctggtaactacaagcgtaataagaaaagcgctattgatgaagctatttttcataagcaacactcgtgttgtgtcttgtatatgctgctgatctgaagatatgtttcgtcagctgatcgtatattgaccttttctgtctctgtcactgcagtgcaatgcgtttatgttgtggtacccaaattaggcctgcttggttactggaatactataccacttactactaagtattctgcgcacaaacagcagatcaggagtttgtcagagaatatcatcatatgctgcgtgtctcccgtcagtcccgtgccgaactgccagatgtcccggataagattcagacgaattctgggacgagccacaagatcaacaaccaacccggcaaaatcgttgatgataataagaaaccaattaccagtacgcagtacgcaaaatgcagaacgagctctcatgaaatcatggccaatgatttgatctgcacgaactgcccacacagaatgctggtcgcagtttccggcgcggcgaaaaagtcaagagtccactggccaatcatgcgcccagctgcactgaagtcaactccaacccatgtgaatatgtgatttgctcgtcaattccccagttagttgcagggtcattttatttgggtaaaaaaaattccagggccatagagggtcgaggcattgacaaagaggtggcctactgccctactggccttggtaaattcagaataggcccacccgtcagaggaaacagtccatacatatgcgacgcgtcgactacggcgctcgacaattggcaagcgacgactggacagatgtgctgagtgctgacgtggttaaactaacctcgatggtgtgataaaaggctagttgtagtaagtgatattaagaatgttaaatttgatacttatttactgggcagattaacgctggatataaaaagagcacgtacgtccctattattatgcttcagtagttcagttagctcgctgctgcctgcatgtgcaatggagcgttcaacgccgggaacaatggcggcacggtcgtggttgcttctcctctgcttcgtcgccgtcgccaccgccggagtgctccaagctcgtgcccaacctgacagcaacggtacattccaccatgtcctgtctttc

SEQ ID NO: 6499 - DNA, 1501 bp, Oryza sativa
caggaaaacagttcgaaaaaatatatccccaaaagacaggaaaatatggagtaatacaggaagtaaaaaaaaaaaaagcaacctcagcattggactattattacctctttcacctcagcctccgtaatatggccatctgcgttcttatccaccctgaataaatcgcataccaaaacggagtcacattaacggaacaaatcaataatcagtccacaaattggtacggcacggtagttacatatcgaagaagatctggaggcgcgagtcgaagctgttgtcggtgatctgctgccagatctcgcgcagttcttccttgttgatcttgtccacctgcatctgccgccgccggctcaaggtgtcgaacagctccatggcgaactccttcgactccgtcatccctgcatctcaaatgcagctggggaaagtaaggagactggaatgtttgggaaggggatgggggcgattggggaagagattgacctatgcattgcgggaaatcgtcgcgggagaggtagccgtcgcgggcgaggcggtcgaagttggcctggacttcgatccacgcgttgctggccttgttggggccgctgatgaagcggaggccgcggatcgcccgctgcgcgccggacttggtgcggtcgagctgcgcgcgctgccggcgctccgcgcgggccgcgagggcggactcgatgcccggcggggcggtggtggtgctctgggtgcgcgtgaagcgcttggtgaggtcctgcgagaactggcgcgcgcgggccatggcctcggccttgagctcctgcgagaactgcagcagccggtgcgacgacgtccgccgcatcgccggcgacctcgaccgcgacgccaccccgccaggcggctccgcccgcctcggcggcgccaccgctgacggcgacgcacccgacgacgacgccacggccgctccccccgccgccggctcgacgctcctcagcacaatggtgtcgtcctcctgcaggtcgagcgtcacctcgaccagctcctccccgtcgtcggagctccggtccgacccgcgcggcgacgaccccgtgctcagcgaccgcggcgtcgtcacaccagacccccatcgcggccgcaccggcgtagtgccgccgccgctgccgctgccgattcccgccctcatcactccccctcctcccctcctcgcacgcacgcaatgcgccgctcccttggctggctggctggctggctgcagctagcccaccaccaaactagtttgacgattcgggaggaagattagatatactcctagctcacagaacagtccaagcgaacgcgacctaatgcaacgcggttgcagtaggagtagtagtagcttgcagccaccaccaccactctcccgttctctctctctcctgcggagaaaagcacagcctcgtgtcgcggaaagcgagtccaagccggggccgcgccgcggagaaaagcggagacaagcacagcaatatatcgggagcaagccagccgcccccgagaa

SEQ ID NO: 6500 - DNA, 1501 bp, Oryza sativa
accctcctggatcaccgtagaacactcccgaaccgccgctttgatcgctggacccctctccctccccggcggcgttccgcccttccccgcaccgcgcctcgctgtcgccggcctctctcagagtctctccgccccatccgaccccgagaacaagttcccagagtcctagagatgctcccgccaccacgaattgaccccattctctcccggcgtgttttcccccttttgctcgccgccggtggcagccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtcttcctcctctcgccggcctgcgtggctgccacgtaggcgccacgtcggtgccaactcggctagaccgagtcaaaccggccagcctggctagccccctccgtgcgcacggaccacggtgcgccatgcggctgcacgtgggcccgtcgcgcctcggtccacccggcgcaccaatcgtgagccgcatccacccgaaaccctaaacgccgcccgcgtgctcccatccctccgtgaaccgtgtcgccgacatgcgggccccacccgggacctcgcatggtgggttcggtccacccggactgccccctttcccttccgcgcgcccctaatgggccgcctccttgcgcccgcgccggcccaatggctcggccgagcctccttctacccattgggccgcgcctcacgctcggcctaaaagtccatattcctccctccgtccaagtcagtgtccatctctcatgagctaaaagtccaaatttgctccctctcaattttattctctctcaccttcttgttgaccccacttgtcaatgagtcaaagatattcttgagaatgtcttttccaatattccacaaatatttctcttttctataaattcaataaatcatttttccctctttcagaaatcaattccttattccaaaattccatgaatcattttccttggtcagtgactgtcaataatattcttgagaatattatttccataaattccgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttcttttggtcctttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcg

SEQ ID NO: 6501 - DNA, 1501 bp, Oryza sativa
cagtggtgcgagtgtactacgatgcactcatcttctcctcggtctcctcgttttcgttctgttccgagagctgcagttggacgagagaacacaatgattcgcctcgatttccgcgcccattgggggtaggagccctctctttcaaaaacgtttcccggtgtattgtgatatgctgttttcaatttttggctggattgctggtgttgtgcaccgaaaataaaccctcagaattcgcgtgaattcatccgcacaaactacagtgctatctggctgatgaagaatgcaggaagatcagatcgaacggagtattttctgggcctagcaatttcactcgtaggcccgtttgattcaaagaaaattcatagtaattttaaaggattttattcctataggaatttttcctatatagccatttgaatcaaaagaatgaatcctatgtaatcccataaaattcctatggaatgcctcttcccatgtaagttttggaggaaatttagcatgaggttttacctcatgttaagaatcctctgagtctttatctctcctcaaatttcagtgttttttctgcggctcaatcaaacggttatttctatgtttttgctgtgttttataatcctctgttttacacttgtattcctgtcagaatctttttgctattccttcgtttttttcattcctatgattataaggggccgtagagtctactcgtagcccgggccgtgctgcccagtgctcgccactgccgcgtgggctgtacacccctccccaatccctgtcaccatcacaatttataaaacagtgcggctatcatgatattttcaatttttaaaattactatatatatcacgataattacgtggtttcgtgcaataatcaccaaaccataggatagcgataacttaaatggttagcacgtgtattaagaaaatactgtagatgagaatgattggagaaaatatgtgattggttgaaaagagaaagtagatgaagaagaatagttgtgattggttgagagaagataggcggagaaataactttatttcgagacaacgtaatatgttagaaatattactctacattttggatggatgtactagtgtatcactgtgaacaaaaaaaaaaacagataacacatgcaggcccacagctagagtaccgcagctactgctagattacggacccaccatggctataccgcggtactactctcatacgggtcgatgactctgtcgtgtacttggcacgataatttctcatgatttgacattaacattacctactggtacgttactccggttaacttgttaggtacagtaataagtaattaccgacgctgtcggccagtatcacatattcatatgcacgttcgtggtacggtgccaaagcatagaccaagtaggcaacgtgaagtcaacaaaaggaaaagctctgaaccaaaagataatcagcagcgtgtcgagtctcgtagagagattctcccaccgaatggcatcctagctca

SEQ ID NO: 6502 - DNA, 1501 bp, Oryza sativa
gccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaaaaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaa

SEQ ID NO: 6503 - DNA, 1501 bp, Oryza sativa
aaattgaactcaactcaaattatgtgaaataatgctgccaacaaatgggctcacaaacggataaatcctagaccaaagtgatgactgacgtaagatcaaactaaatcaagactaaaatcatcactcgatacaacaatgcaatctaaaattcaacaaatcataatctaataggaaaatataacaactcaaattggtttggtaatgaattcaatttgttcctggttataggtcgatacaacactagtataaaggagaaaagaattacctaaggggtaaactgtgctctaataccacctggtgtgaataggtgtttgatcttccgataggttcgatttggaggcttctggtcggccgatcgtcacctcgcaactattatatctgcatttagtcattattgaccactctctcaagtaattgaccttatcacgaaggttatgtttctgcaaatataattgaagaaattcacaaaaacaaggataatgaatgattggcacacaaaggtgaggttgtttaaatcgatctaccggtgaaactgcatgattgtaaaataataatataagtaaaactctcactctaagcgatgacgactactgaatgtatacgattagaggtgtcctagagttagccctagagcgcacacctctttggcttagcccacaacacggtcacaaggcccaaggcccaaatctaatttggactagatgatgtgcataacttatttggatgattacgtacatcttagaaaaaattttgaaatgagaccaaaatcaacaaaaagtagacttcataagcttttcaacaaatactcatgagcttcgcgagtctttattgataaacaactagatccgtttgaaatagtgttgccgaaaggcctaaatctgagtccaaaatatgtagaattttatcgcttgccttatgtggctcaataatgacgtggttgtgttgaaataggtttggggaaggccatagtttaatctccaatctttttttaaacaaccaatacaagcactcaagtaaataataatacgtaaaacctatgttttagtgtaatttgtttgaatatgtagaaggtaaatatgtaccctttagcttattattgatgtatagaagtatatatgatcatacctgagccgacaattccatatcagaatttaaagcatgtctcttaattaaaaaaaatgcaccaaatctgatgcaaaataaatcatctataaataagtataccagaaatcttagcccaaacgaactctatccaagtcaagagtgccaagtctcctccatagacaatcccgttccgttcgtcttgccttttggctgttgcaatctgttgagcacacaccaaaaaccgcctacgccgagccaaaacccccaaccccgatcagtccgatggcgtccgacgaggcctccccggcggcggcggcggcggcggcggagaggattcgcgtggtcggggcgtgggccggctccctggaggtggagctgggcggctggacggtgccga

SEQ ID NO: 6504 - DNA, 1210 bp, Oryza sativa
ttggattctgtttatgtgttttttctagaattggtatgttgcactcgtgttctgtaaagtgtgctaaagtggtatgtatgtgccttatgttctgtgcattgcgggctttaattgtgtgatagtttgtttctcggacagataactagtaaacagctttaaaaagatggaaacataggttgtttgtaactataaaagacagtacattatcagcagcattaggtaataatgtgtctctagtactaaatcacgcgtaccagcatgtacagatatatgctcaattggttgttataagtaccttcaaaacaaaagatgatcgaaatgccaaattgatcatagtagcaaacaaaagagattagggtcagaggagatagcaaacatggagattaatgcttcttcaggttctaattgcttttctgttgcactattgcttaactcctcctgtggatcttcctcatcctcaccaacctcttcttcttaacccaatagcatgtttagtttgattttacactaatgcaagctctgccaatttgtttttataatcagcgatatatcttcgataaagtgctaagaaaagaacaagtaaactattgcatggtcttgtgaagctgtctttcgggtccaacttaactatattggtaggtctgactatctgtctttacctgctatcgatgtaaaactgccctatgtggcagctctggtcctccctttacattaccagtaggtaatttgtctagtgcctgtaccctttcttttgatagaggagtcagtgtaagccaatgcttaggtcttcacctccagccaatcagaatctgaagtcagcggggtattccaatatagctacttctaaggaggttccctagcactcagaaaccctgggggccaggcagtgaaacgttccgcagactgctcacccggccacacctcggagccgatgaaggctggcaatacaagcatcatctgtccaacagcctacttctcatccgtaaacatcacagttcgttagtgcaagcgggaatgagaacaccactatcttagaagaaattagtagaacttagttcagaatgtacaaatgtatgctagatactctcactacgattccagattagaaccggaatagttaaccaatggaataggtgtaggcggtttgatcgtttccttttctccgatcataaataacctgatctctttctttgtctttcatcaaataagt

SEQ ID NO: 6505 - DNA, 360 bp, Oryza sativa
atacccccatcagtttaaacttaggcacccaagctaaatttgattcaaaccagagtaaagcaagcaagtggaacccccttcattttattctagctccgcccctgctggcgagacgggtgctaggcaagagcgtgcactggttctaattctttgcctcttttggttcaatctcccttattataacaaaccattcttattttacttctggcatagaaagcttatttgcacaaaaatagaggatacaacatttttgctactcaaggatgcggttaaagttgaaagattggttttatccgttattcctgggaacatgaaacgttcacattttatttatgtagcctaaaagaaagcaaatctgaa

SEQ ID NO: 6506 - DNA, 1501 bp, Oryza sativa
ggctcttcttgtgttcccttttttaggtgttagggtttttggagtactaattttctctaaagcctaattaaaccttgatacgcaagaccagccatactataaatatagatgtcaagcctattgtaggaaccaacaattaatcgacaaaatcgatttagtatctaacctctatcttctaccctacctatatcattcttcacttattccatccctattttccctccaatcccataattgctcacgtattttgtctcccctgcattagaggacatcctaactggcttttcaagcctagatcaaactggcccacactcattttgcgagttgcgttcctccattgacaatgaacatctacagtaccaccctttcgttgacttatttccgtgttcactactcttgaacccttcctctcgtatcgagaagcactgcatacagggaattttctatggcatatttcttgtactacgatatcaacgcggtcatggcgattcataactacgagtcatagatgacccctcattcttaacaggtgctacatcttagacgagccactctgtgacccgtaagagatgtaattatctgagacgagcatttttcacctatcatagattaatatgcccctgtttagcatcccaagtttaggctgtgcaagttttaacacagggccagagatatttaactacctatattttctccttcatgagcgtgtaagtaaaactaagaatagctttatttatttttatatttaacatctactgttttctccacttttcagatgttaatgagtgtgaaaacaattctatttgtggtgctgggtccacatgcaagaatacagaaggtagctatcgttgtgactgcaatttcggccaaagacgtgacaatagttctgataacatgggtaattgtgaacccatattttccagagctgccatagcagtcataggtgaggttcaatacatgaatgcaatgttgattgaaatttgcagcatgccatacattccacatataatatataatgctctaattacatgcagttctgcattccatgtatacaccatatttgcattgcactacattcaacttgaagctcaacattgaagtgtgaaaacataattatttccagatagaccatggctgtgcctaaatgttatcttttcgcatgagcatagaccatgtggttgtgcctaaattatcttttcacgtgagcaatatatatggactacgcaattgcatgaatatgtataagttacctttgcagtattgcatgttctatatattaactattttgtttcctatttgtccacagcaacagtttttatcatcgcacttctagtcgtgttactaatgttcattctattggagcgtaagaaaagaaagctgagagcttatttcaaccgaaatggtggacaattgctgaaaagtatcaagatagatatttacacaaaggagaaacttgaccaaattactaaaaattacagtactattattggaaagggtgggt

SEQ ID NO: 6507 - DNA, 1501 bp, Oryza sativa
acttggtccaccgtgcgcctgcctcccatgagtcaccgatgggtggggccctcttgtcggcgccacccttcctctcggctgacgccataaatggttaataattgcgtcataaatcgataattaattctagaaattcattaaaatggctcaaaacttataaaattcatatataattcatccgaactccaaattgagccattcaacttgcaaaattcatctaaaattgagctctacatgtttgtttactttttatgtactgtttccttggtttttattagagtttttcctcattttgcgtgccagcgtgtagattccgctgtttcggaagtccgcggtcacgaggaaaagagttcagaagattgttttgaagaagcaaggcaagtcacacattcccccttgagcatgttgatcctaatttataaatgttttaccgtttgcaaataaatatgcatgttttgctaattacatgggatcagggtttacctatctgctcgcttgtgccatgtttacttgatatcggtcctttgtcaaccttgggtgataaatcgactagctcgtgctacttatgtgacctagctagaactatatgcttagccatgcttaattaccactagctcagttgataggataattacagttttagacatctagtatcttgacgagctgcgtgctcgagacatctggccatggttcatggttgtaattatcaaactaaaatgcgactgaatggtgggctgtgggtgcatggttttgcgagtcgcacccatggcaattaaggaccggttcacgggaaaccctggaagactaacagtgcttaccataagcgggagtgggtaactgcttgatctgaagtatagctcgaccctttcctaggcaccggtggcgagggtggacgtgatggagttgggtcggctggggtgtccggttgtccagctgccggattcaccgcgccgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaa

SEQ ID NO: 6508 - DNA, 1267 bp, Oryza sativa
ggggcgcgtaggtggcgccggtgggggagaggcgccggtgggggaggggcgcgggaagacgacgccgatgagggagaggcgtggagaggcggcggtggggagagaccgagagaggcggcctgcggtgagggaatgaaggggaaaaggaaattagggttagggtttgtttggttcggggttttgatggattaagagccgatctgagccgtacatcaaaacgaacggctcagatcggtcacgtcgggccgcacgcttaatggcagtgagaggagaagtagggggaggctagacttcttgctggcgcagacaaatgtgcgggttgaggtggaggagagaagaagggaggaaagtgggtcggctcagctatgggctaaagaataaaatgtactgaaaatggcctagagagaaaggaagattgaaatgatgttcaaaattagcttatgcaaattccaataaaatttcaaagattgtatttaattatggagaatttaataaaattaattccacccagtagatctacccatatcttcagagtccatattgacttgcaccgtgtaaaggtggaaatcaagccggctttgtctttttttttatctccctttcttcgaaattatttgtgaaaaataatttaatatgagctactatatttctctctgtcatttgagactttttctagcaagctaaaagtaccaaagcagtgtgaaaataactttggttaaaaagaaatatttttagttttagtacaccgtagtaaatcacggctattttgctagtatgtactccctccatttcgaaatgtttgatgccgttgactttttagcacatgtttgaccgttcgtcttattaaaaaaattaagtaattattaattcttttcctgtcatttgattcattgttaaatatattttcatgtaggcatataattttacatatttcacaaaagtttttgaataagacgaacagtcaaacatgtgctaaaaaatcaacggtgtcaaatattttgaaacggagggagtattaaaaatataaaaagaaagccttaaacagcccaataggtaaacaaacttctcatttgggcctttcttcacccttctggtcccaaatttcctattcccctccccggctccccctctcctctctctcagcccattccagctcctttcttcgattcttccccttccccctccccaaacggcggctggcgattcgcgacgcgggggcgaggcgggcagcaggcggcggcggcagggcagtgcgctgtgcgctgac

SEQ ID NO: 6509 - DNA, 1501 bp, Oryza sativa
agaggtgaagtggagaccatcagatttattttggtcctttatatttttaatattgtcatgcatctgtgatcagtttccggggtttagattcattatgttctatatcatggttaattattctatgggtcttccgaaacatggcacattgccacacatcctatgttgtgttctatatgttatcaatgagcactgtggatatactattttggaaactgctttgtgattttcacttctatatatgtgtgatatctatactgattcgtttagttgtctcctacatacaagggacaaggtggacggggagctgaagctgtgtcaccttctctccagttgcatcggcggataaaattgtgagggcaagaaaaatatttgtactcttttcaaattagtaaattaatgcttgcaggaataattttgaaaatttaggagtactacttgtaaataaatggaatagcaaaaaaatggtagataacccttttaaatgatagaagagtattaccacgcaggtcgtcactacgacacaattagcaatataagatcattttcggcctcttctaatttgcagaagagatgacatttagcccattcacacctttgcatttgtgaccaaataattaagaggcctgaagcataggaagatttcaatagttgcattgcgtaaaactctcctgaaactaaaagtgatgtgttgctgatctcgctttatatgccgtgcagatcctactgaatccattgatttccaagagttctgcaataagaggtaaaaagaaaagttattatcagaggcatgagtataataaataaagctcctcaacaaaactggaatgaacaatctgtgctatttatctcgtaaatttctgaacttgctatgagtagtagctgtggatgccattcatttttacatctctctttgaatatgctgtgtattttcgtggaaacataatattatagacttttgtactcctcaacttcacttcgttagtgattcatggtaaaatcttggtatcattagagctgcttatggttacagcatcaagttatgattttctccgttgtcaaattgattgcacagtgattttgactacaaccatagctgatgcaattaatgggtataacaacgtagtataatctctgaggaaaagtaatgcagtttgttgtcagtatatgcactactgaatttgggattatgcagcacgtcaacagcaggtattcttattggtcgatttaatttgttatagcaaggcaaggagtcgcggacctgaccatgaccattttttaagtacatttgcacaaaattgagaagcacatgtacccattgatgtataaataagaggttcgtagctcaatccatatgaatatactttcttgaagaagtttcataagtataacgatttttcttccaccaaggagatttataatgtaaatctaatttgcatcttctgctagagagcttcctccagtagatgagatttacagaatgtccagcacagcgagcctgtca

SEQ ID NO: 6510 - DNA, 1501 bp, Oryza sativa
gcctgcaccaccatggagagaaagggaaagtagagcggaactgaaataatctgatccaattgggccagtgccatttctaacatttcaaattatttccataaacctaaataaatattttattagatgtggtgtctagcagcaaattgacaaattttgatagtgttttcctccaaaaattaacttttgtcgtgcccacgaactaagatcctcaggacaataaattttgccatttttctgatgtcttcatttgggttcatttggttagatttattgggctatttattaattagatcaggatcaacgatagttgacgtattcaccgtacattcaatttgatactaaccaaagatctagatcaaggagatgatatctgtaatttgtatttgcaactaattgttgttccaagctatttgcattttgttatgaccatattttcctctctttatctataaatataaccaaataattcagtactttgtcatcataaatttaagacttagttgttcgacaatatttgcagagctcctggtctcataataaatgcagctcagagcgctaatttgatttattagtcttgattatacttatattacttttcaataagttcaattcctcgctcaccaggatgcatgtgacttttaatgttatatttgttgagacttgagaaccctcctttatatctatcccttctctcttcttatctaacctagtagttatctctggcacctttgtaatatacctcattctatttagtctgttttgctccatgtgtgtttctgtttcaatttaaatccactagacactagtgtttgtttaatgggaatagtcccacatgaagagtttagattagtctggagctgcttgtatacccacctcactccaaccataatacatgcgggttaacccttttatatgaactgaggatgaaagtgtaagtggagtgctatatgaacatggacccacgtaacgtgtagagaagactaatgtaattattatttggggctaggatgtaccatggtgcttgggaagtacatataattttctcaagttatttgcatacatgtttaatcagggagactggaataagtgagatgtatatactccctccaatcccaaatgatacttcctccgtccttaaaaaaaactctacttctagagtttgaattttgtcccataaaaaccaacttctaccatcctacctaccctcacaaataaaacaagaacttttatcccctttacctacctatcattacttttttaaataatgagggacattttggtcatttttctctccattaattttaccttggcatgttaggaatgctctttttgtgggatagagggagtacttgtcacctgacatcatttataactaaatcacttctgtttcttttgaaaaaaaataagctgttgcattctataaataaacattaagattccgttaatcataatctaaccataccatttaaaatatattaatattcaaagattaaataaacaa

SEQ ID NO: 6511 - DNA, 1501 bp, Oryza sativa
cagattcatccttactagctagcatccacttttgttttagtgtgtaataggtccccacttcccaggatgcatgacatgcatgccttcattgaattgatggcattttctacattactataaatatctacatctatatattgcttaaaaaaccagtggggtgagttctgtcactaggggcggatcagaaaggactaacaggaggggctgaacaaactatacaaaactatagcctcatcttctaatggatgcatgacagaaaattttagtggtgacttcatggggactcccgtggttacaacgtacgccggtagtgggggctcaagaccccatagctcccgttgtagatcggctcctgtctgcactcctaccaccaactcccctaaactgaaatgtgagagtgagacctgattgaaaggcctttttcattcaaatatcttgtacctctaacctctacctttaatagtacaaaagtaatgctttttatgctggtggtagtgagtttgtcactcccaccataactttctctaaactgattttgtgggactgcttgaaaggcatttttcattcaaatattttataccttaacatctacctttaatggtccaaaagcaatggttgaaaactgaaaaaaaaagataaaacctaattaattttaaaaataagttctcgctctctcagtcagatctagatccgcccacctctctctctctctcccctcatcgtcgacgccgagtgccgcctccccgctgttgactactggttaccgtctccttgccctcgacaactaccgccgccttctccttggcctcgacgacgatggctgcctccttggtctccacgacaatggccgcctccccgatgctgagcacctcctgtccgccccctatgaccgccggctacctcctccttggcctccacgaggacggccgcctccccgccctccttgataccgagcgcctcctcccctccctcaacgacaactgccgccaactcctcggtctccacgacgacggccgcctccttgccctcctcgatgctgagcacctcctccttgccctctacgaccgttggccaccgccgacccgccatccactaccaccggccgccgcctccaccaggttttcggcgaaatttttcaataatgtcttaggaatttgtaggaaatgttttagaaatttatagataatgctttaggaatgtgtaggaattcgtaggaaatgttttagaaatttttaggaaatgctttagaaatgtgtaggaatttgtaggaaatgttttagtaatttttaggaaatgctttaggaatttgtaggaaatgttttaggaattttttatgaaattatttgggaaatttttggaacttttaggaaattatttgggaatttttaggattttgtaggaaatgctttaggaatgtgtaggaatttgtaggagatgcgtaggattgttttggaaaatgtttaggaaatgctataggaaattttaggacatgccataggaa

SEQ ID NO: 6512 - DNA, 1501 bp, Oryza sativa
taaaaaatgtctaataagtgtcttatggtgaattgtctctacaaacgaagagacattttataaaatgtctataagatggtagaggcattttttagagacactaaattgtaccgcaaacatataaaaccagtccaaaaaagagaataaaatagtttccttgcttttgataagtcttgaactcatgatcttttggttaaatcattttaatcttcgatacactaaccaactcaactccatgtcattacttgtatacttgttcctttaattacttatatttagtcgtttagtacacattatcattctaaaaagtgtctctacatagtttaaaatgtctcaacaaaatgcctttacatattagacgcatttcatagtgccgaaagaatgcctctacaagataaaatctaacaaactgatataaaaatgtctctagagtaaaagttttctaggcaatttttaaagtgtctctacactataaaacttctgattgtagaagcaatttacaaaatgcctctacaaaagtgcctctatacgaggtttttgttgtagtgagtataacaatgtatgccctaacatcatggaaacaaacgatactataacattaaccaatctgacctaatttcttaggctaattccctggtgcttagtatggcggatgagtataactagtagtgctacagtagctgatcttagacgtaagacccataggcccatagcaagtacaacttctttatacaattccttataaaaaatgcaactctagttgttgagacatccaagaaaatgaaaacccatttctaatttgcatcatttattccattgtttccacagcctgctagaaatgcaaaatagatagcctgcacgtcatctggcaaataaaataactttggaagcatactatcagtatctctaataacgtccttaggagtatcaaaagtccaatgtccaattgatttatcgaacatgcaggaaaataataaatttccaaacagatttaaagctttataacaaaagaaaaggtactggagaaagattgatctcctatgttactttgattggtgggaaaattgttgttttgtaaacataaagctgacaccttcattgcagttgggttctattggatttcaaatccaaaattattatttcatatttgtaatctaaatgttgtattaaagatattatctggcttgttaattagctttcattcgccgaaactgcaaatttggtctgtttcttgtctgaaacacaacaaattaccaaattgattttttttaattcgcattagatcggatattttcctttaatatatatatatatatatatatatatatatatatatatatatatatatatatatatttgatttgctatatgatggtttgattttctacttattgaaattaataattaggtaacgcaagaaggctggatggagttttactgagtcctgaatcttgttcctgcactgtgtaacatgaactttttttttcctcagcacaaatgg

SEQ ID NO: 6513 - DNA, 1501 bp, Oryza sativa
tacttacaacacccaactaagtaccacttatcagaacagctggtaatagcagtgtactgttagtttattaaccaattatttttctgcaaatggtagcacagtgcttaaaatactgaaaatttagcatattgtgtatataggattaattagaagcacattagatttaatagacaatactgaaacctgtagcaaaaaggagttaatttgacaaacccttttctttttatgtgcataaaagatatctgtgaaagacaatttgttctggtttgtcctcttactttatatcagattattactaatttgtctctgcaataatatagtagccagattttagagatatacaggcagggtgctgaaatggcacaaatctctaaatagagcaatcatattgtatacacctgataaatttgtcctcaatattctttacataaattttattcagtttcagggacatgttcaagttcagagaatcattaagagcttgttttcagccgtaaattcagatttcagacacatccaaaatgatctgattttattcttttacttaaaaattcactttggaagcatattttgtgctataaaaatcaattaaaaggttgaaggacaacgagcgaggacagctagcaaacctcagctcaattgaccctacttcatgcatcaacggccaagcaattaactctgtacatgaacctgcttgttctgatgaggagtaggctccatgaaagctgaacttgatgcccacctatctgagacctatccagcacatggatggtatcttgatcttcaccagatgacctgaaaaaacaataatacaaccaaagcaacaaaagatcaggacaaatatgtattaggtaaagatggttagcaaagaaaccatgaaggatttattaaccagctgttcaagcacaacttcatacaaaattgtaatataaaaagcatgaacttcctaaatactcttctttgtaccaagcagtcctgaaagttccaaattgactggtctctatctaagagatggaagggcagagcttttttatggttttcatcttttcataagatcagctaaaaaagctcagtgttgcatagatatataaagataacctaaagagatacaaataattcttggtcatgagggcacgagtctaccatcataggcagtagtccatagagatgatcatttagataaataattcattggaataaataaaaatacaaaatcataaatcaagcctgctctccagggacaaataatctggtaaatttataagacgtaaagaagcatgtgcattgcacaaacttattgtgccatgcaaaccatatacttcctccgtcccaaaatgtagctacctagtacaggatgtgacattatctagtactacgaatctagacagcccccaaaaataggaagtgcatttcatatcaaccaagaaaatagttcgcctataataatgactcaactcatatattctatttatatacaaatcaaaaagagaatttaaagaaa

SEQ ID NO: 6514 - DNA, 1501 bp, Oryza sativa
gacgaaaattcgactgtgattaagaagaaaatttatcgccataattatagcaaatccgattttcttaacggttagttaactttttacggtcaaaacaaattaagttactaatattactcgttttcttggccattttgatgtttttttagggcagtttttgcctgtcaagaaattctagtttcttgtagggaataaacatgtactacctccatttttaaacagtatatgatacggtttattggattgtatttgcctggcaagttcatgttaaaacaattcaatttggtctttaaacactgcttatcatagaaggttactagaactaaattgaattgttctatgacatggtttctctgcacgactatatatcaagagtagtattgtacacgcctatatatcaagagtagtgttgtacatgattactataaattgcaaaatataacatgtgatcaatacacatgtcttttacgattaactataaattgcaatatatacatgagctttacatgtaaggctaaaaaaaaaattgtggctgggtttcctgttaaatgatcttcctctatctaaaatgaaaggttcaaagcggtctctctactcccggatataaacctttcgcgcacggccaagttgtactaaaaaaatagccagagtactccctagttcttcacacagaccgaaaataaaaatcattttctcgccttccaggaaaaaaaaggcatgcatcagtggcacgataaaaacgtcattttcttatggtctcaccggtacagtgaagacaaatttagcccgttggcgattgcgatgctccaagttggttacaatgtaaattgagaaaatatctcgagaattccaaccttccaagtactccaactccaagatggagtaagatgtagtagtaacatgtaggtagaaaaaaactgcagtggatgcagatcggtactgctgaacagctgaccacacttgctcagttgatctgaattccatgcatgaatggtcacgacccatctagtttcaagcatagaaaaatcaacgcgcacaacatggaatcattccaaatgttttcacctatataagcgcaggaactcgagctaccacacatatatctctcttcagtcttcaccagttgattaattactacgacgccgcatcaaaagctccagcaatggcggcatctcctccgggcgccatcgtgatcaacatggcatcgaacaccaacggcgagtccacggcggtgacgaccaataacttagctccgtcgacgcctaaggccgtcgatgagtccacgacgtcgtcgaaaacagatgtggccacgaagacggtgaccgacaaggtgatggcaagcacggcgaacctggcgcagctgctgccgacggggacggtgctggcttaccaggcgctgtcgccgtccttcaccaaccacggcgagtgcaacgccgccaacaagtggctcaccgccgtgctggtcggcgtcctggccggcctctccctcttcttctccttc

SEQ ID NO: 6515 - DNA, 1501 bp, Oryza sativa
tgctggggtcggagcccgcggcggaggcggaggaggtcgccggcggggccttggagaggagctggcggtgctcctcgtggcgccgcttctggagctgcttctgctccagctccgaccgccgcacgaagctcttcccgccgaagtcggccgtcgccgccttccgcttcttctccagctccctcttcagaagatccatcgctccggcgacgcgacgggccaaccccgaactctctctctcctccgcgttctcgccgccgcttcccggagagaggcggcgccggcgaggctaagcggctcacttttttttttacacgaaccgattcgctatttgggacgccgccgatagggaaaggggaaacgtgaagtcgcgaatccgcaaccgtaaaatttgaccaaatattttggattggtacagtaactgtgatttacccctcctatccggactgagatgctctctgcagtcaaatgcacgatatttttatcacttacatgtgaatctagggattatcaaacccacatatcagtgataaagttaagtgacttcggctacagaggatcctggtccctcttgtccacgtttgtgttagagctatagccacgttttagtgttagagatatagccaattattagttatctataaacatataaccactattaatagatggtctcacctgtcataatatacatcgtgtcttggagtccgtgttacacctagctataaatagcttgttgttcatctctcttttcttttatcttctcgacatatgtttatagctggtttatactttgctatgctacctgctcttaaccaaatacgagtaaattctcgagaagtgaacaattttcttccttgtagtgaaacctattcacttgcatttaaattctaaacttcacacagatatttctatttatgtttaattattttgacaatgtttctgtcgaggcatccgaggtcaccataagttatacttcctccgtctcataatataagggattctgagtttttacttatactatttgaccattcgtcttattaaaaaaatagaattatttttttttgacttactttattatccaaagtactttaagcataattttttattttttatatttgcaaaaaaaattaaataagacgagtggttaaatattacaagtaaaaactcaaaatcccttatattatgagttggagggagcagggtttttttagatgtttacagggaaagagtgtacgctgaggtctactctctcctagattcgtcgtattacaagggctggagaggtcacatcctctcttagtagtatgtattttattttattttattgacagtgggagtagttttggatgcactgtttttactgtgtttaaaaaagtaaatcctgcgtcaaagaaaataaatcctcaaatttcaattttaatggaaggtacttttgatcaaatctcgggtccgtgtcgaagagaggagaacacgcgtctcacacttttccccaccttttcaccgt

SEQ ID NO: 6516 - DNA, 1501 bp, Oryza sativa
gcgagcgacgacggggagagcagcgcgaccgtgccgtcgagggacgccgtcgcgaggaggcgcccgcatggggagaacctcacgcacgagacggcgcggctgtgcggggtcgccgccctcacctgccggtacggccggtacggcggcgccggcgcctgctgctgctgcgacatcagcggcggcgcgccctcgccgacggtgaaaaggtggggaaaagtgtgagacgcgtgttctcctctcttcgacacggacccgagatttgatcaaaagtaccttccattaaaattgaaatttgaggatttattttctttgacgcaggatttacttttttaaacacagtaaaaacagtgcatccaaaactactcccactgtcaataaaataaaataaaatacatactactaagagaggatgtgacctctccagcccttgtaatacgacgaatctaggagagagtagacctcagcgtacactctttccctgtaaacatctaaaaaaaccctgctccctccaactcataatataagggattttgagtttttacttgtaatatttaaccactcgtcttatttaattttttttgcaaatataaaaaataaaaaattatgcttaaagtactttggataataaagtaagtcaaaaaaaaataattctatttttttaataagacgaatggtcaaatagtataagtaaaaactcagaatcccttatattatgagacggaggaagtataacttatggtgacctcggatgcctcgacagaaacattgtcaaaataattaaacataaatagaaatatctgtgtgaagtttagaatttaaatgcaagtgaataggtttcactacaaggaagaaaattgttcacttctcgagaatttactcgtatttggttaagagcaggtagcatagcaaagtataaaccagctataaacatatgtcgagaagataaaagaaaagagagatgaacaacaagctatttatagctaggtgtaacacggactccaagacacgatgtatattatgacaggtgagaccatctattaatagtggttatatgtttatagataactaataattggctatatctctaacactaaaacgtggctatagctctaacacaaacgtggacaagagggaccaggatcctctgtagccgaagtcacttaactttatcactgatatgtgggtttgataatccctagattcacatgtaagtgataaaaatatcgtgcatttgactgcagagagcatctcagtccggataggaggggtaaatcacagttactgtaccaatccaaaatatttggtcaaattttacggttgcggattcgcgacttcacgtttcccctttccctatcggcggcgtcccaaatagcgaatcggttcgtgtaaaaaaaaaagtgagccgcttagcctcgccggcgccgcctctctccgggaagcggcggcgagaacgcggaggagagagagagttcggggttggcccgtcgcgtcgccggagcga

SEQ ID NO: 6517 - DNA, 1501 bp, Oryza sativa
ctggtacgaggatctacgtaatacgacatcaagcaggcagaaaacaaagattatactggttcaggccccttgataggtcatagccctaatccagttgatatgggattatatgatggaaaccacagattacaaaaggaataatggaactcgacgataccgacgagatcgtagccgagttgattcgactagatcacccggcgacttggttcctgtaagctccggcttcgtaggctgtggtggatgtgttggcggtaagattcgatgccttagttcctcccggggggttccttttataccgcaggtcaactggtctccaagtaggactcggagacgtcggacccgacatgatacaatgacgacccagttctatccgagtaggactccttacatctgtggactccataatgtaattccttaacttatgccgaaaacgtccgtatacgcgcaagcataccatatcgatatgtgacgcatatcgaagggtagagggtatacctcacccataaccctaacatatgcctcatggctttggtgtaaggagaagtgcacaacgagggagatatgctgctagtgtaagtcaccacggttactgcaatataatcgccaccgctaccatcgttgtcatgcagctaggggtcatgaatgcttgtgtggaatatggtcgctattgtagacgaaaaattcgtcatcgtcagatgtggatgctgctgctgttgttggactcactaccaccagctttctgcataggtttggcaaggggaatgtgcaacacatcctaagggttcaggagagctagtattgatttattcgatcctaagagcattttagttatttgataaaaaatctttatccagaacaattgggaatgataaacagtgggtgtgtttttcaacataaaaaaccacattcgatctccagtttggggatggatttttgttgcatgtaaaacgagttttacaagaaacctcgttgcacatgattaaaaagcgtgctaatggaaaacgacaaagttaaagtttggagttgaggaatagggtgctgtttgggggttctgcagcttctcccacaattagaaactataattgtagttgtagttgtagtccagtttttatctagattatgaaaagctgtagttgtagaatccagaaaatgaactagaaactaaaagctggattccagattcttagaagctgactatttgccagctgtttctcataatcttaaactcatccaaacaggtgagctaggcctaatgctgtgttcatttgttcgattgggatgaaatcttcgtacgcaagcaaaacgagaaagatcattagcgcataattagctaagaattagctagtactatggaaaatgaggaatttgatccccattgcatagcgaaaacattaaaaaagaaaagaaaaacgtttggctctaaactccgctctttgattggagcgggtgtcactacgtgctttgatttgggggggaatggatgactccggcagcagctcgc

SEQ ID NO: 6518 - DNA, 1501 bp, Oryza sativa
tccgtgagaatggggaatatcggatctgaacagaatccagtggcacacccaattcctcaagctcctgcacgcaatcagtcccccaaaatcactatggcacatcctctccaagagctcatggagacacgactaatgcacaccaaatcggataccttacggagcgattcgccggccaagcgcgcctgctcgacgccctgcggcgccagcccaaactccggcttcgtgccgttctcctgcgaggattggagcagttagaaggaaagatccgaatcaaactaaactgctaactggacacgaagttcttggaggcaagaaattgaagaagggtgaagacagcgaggtgggatgcacggatcggtaccagggaggagacgatgatgccgcgctcgttggggacgctgcggccatggcggaggatccagtacctgttgcggaaggagggcgccggcgccggcggcgagctgctgccggagtcatccattcccccccaaatcaaagcacgtagtgacacccgctccaatcaaagagcggagtttagagccaaacgtttttcttttcttttttaatgttttcgctatgcaatggggatcaaattcctcattttccatagtactagctaattcttagctaattatgcgctaatgatctttctcgttttgcttgcgtacgaagatttcatcccaatcgaacaaatgaacacagcattaggcctagctcacctgtttggatgagtttaagattatgagaaacagctggcaaatagtcagcttctaagaatctggaatccagcttttagtttctagttcattttctggattctacaactacagcttttcataatctagataaaaactggactacaactacaactacaattatagtttctaattgtgggagaagctgcagaacccccaaacagcaccctattcctcaactccaaactttaactttgtcgttttccattagcacgctttttaatcatgtgcaacgaggtttcttgtaaaactcgttttacatgcaacaaaaatccatccccaaactggagatcgaatgtggttttttatgttgaaaaacacacccactgtttatcattcccaattgttctggataaagattttttatcaaataactaaaatgctcttaggatcgaataaatcaatactagctctcctgaacccttaggatgtgttgcacattccccttgccaaacctatgcagaaagctggtggtagtgagtccaacaacagcagcagcatccacatctgacgatgacgaatttttcgtctacaatagcgaccatattccacacaagcattcatgacccctagctgcatgacaacgatggtagcggtggcgattatattgcagtaaccgtggtgacttacactagcagcatatctccctcgttgtgcacttctccttacaccaaagccatgaggcatatgttagggttatgggtgaggtataccctctacccttcgatatgcgtcacatatcgata

SEQ ID NO: 6519 - DNA, 346 bp, Oryza sativa
gattctgagtttgtcgcaagtaaaacaccatcgtatctcttaagttttacgtactatatatttatagaaaacgagataattaatgtctaccacatctgaaaagtaaactatgaaaaatatttgataatgtatgtaatggtgtttatttgatatatcacaaatattatgttttctctataaattcaattaaatatagaatagtttgactagctatgcatgctgactagtcaccagtgaagcagtgacaagctgaaagctacagagcatcgcacagcaacaagagggacatcgagctactatagctctagctgcaggagccgttgactggtacgatcggttgaacagg

SEQ ID NO: 6520 - DNA, 1501 bp, Oryza sativa; identical to SEQ ID NO: 929

SEQ ID NO: 6521 - DNA, 1501 bp, Oryza sativa
aacatctaattcatagacatgcgtactcttgcattgggttgcatgggaatcattaacatctatataattttgtctaaaaagagatcgcgtcgcatgtgagcgagcaaacaattaatttcctatggttatttttttggtaataggccaatggcaaaataaggcataattgcgtggttccaaaatattgttgtggagctgtatgtgagcacgattttaaatatatgttgtttatagaagatgtatcgaaaaaaatatatttggtcagctttcattaagatgattgtgtggatttgatttcccaaagtttgagtacatatgtatgtccaaatcaacgtagtccatttctcctttttagcttgtcaaaaatgttgtttgcacttgttttttcattttgtggaaacaaattgttgaatcaatcatactgtgaccagactataagcataaagcatttttacatcatttagcttatttagaggtcagaaaactggaagtcacgttatcccatctctagcatgaatatcatatagaagcacacatgtattgaagcgaagccaactttgagaggagctaagcttcatatcatatagttggccaagaccccaagctatagtcaacaacaaagtttatatagtactacgagaatatcaatctattgcaaaggatctaaagtaaatacacaattggttccaaactttaaatagaagaaaaatctttacactgctagtgtgttagaaggaacaagaaaacataccattagttccaaactatatatatgtaaagaactaataaatccttaagacctaaaaaatgtagtggtggtttatggtcccttgtccaccgtaagcccatcctcactcccacgccctctcgagcgagtcccgcacgcatgatgtcccttctgctgcacgaatggaagaacaccctcgacccccaccacctgatcaaaatcaatcaaccatcattcctcggcgcttgcccatggacctcctttcacgtctagctctcaacttgcatggacgtaacagcatgtgcacttgccaataaaaaaaaaggaaaaagtacgaattacccccccccccccccgaactatcgaggtcgaacgaattacacccccgaactcgaaaactagacattctacacccttaactattgaaaccggacaaataacccccctactcattccggggtggttttgggtccacatggcagtccagtcagcatttttttaaaaaaaaaatcagtgggccccacctgtcagttctccacccctctctatctctctatactctatcccaatctctccctctctctctctcatctcaccagcacggcgccggccgtgcgagggcgggagcaggcggcgctgttggcggcggagggcgccgggcggctgagatggaggcggagcgggtggctggcagcgggaggcagagctcgcccgcgcaggttgccgtgcaggttgaggcggcggaggagcgctgtcgttgtgtgttgctgcctt

SEQ ID NO: 6522 - DNA, 1501 bp, Oryza sativa
cgtcaacgcaatattctcctacctgatggatggccggaaaatggcattggacggacaggatgcacaagagggcaactaattaatcgcattttattttgtcttccaagatgacattgtttgaccttgacatttgaattttcaaatttcaacgagacccaaacctaaacggcgatgataacgatgactgttaacttgaaattaagtgtcaatgttctataggtcatggtcatgtgagataacgtatacgatacatcatttatggtcgttgatttttctaccgtaagtacgaaaatgagtgaccaacattgattccatatataatgataaattatcagcaagagagtgatgaacaagtcaaactacaactgtagaagattaattaattaacgactaacggtgttcatcttctagaaaggctagagggtagaggcgcagcacaaaagcaccaatatcttattgccaggtgtcacatgcatgaccaaaaatgttccgtatattgagttcgtcataagggccagattagtctaaggtgaactttgagtacctttcatatttttgttgtgctgactaaaatcacatgtgcagatttgtttgaaatgatacttccgtatcactatttctgccatagtttgtaacacataatcttgctttgtcagagtacagactgtccttctatctcgttttctccataatacagggactatatgtgctattatggtaggtatagtctgttccaaaatataactatttctagcacttaaaatttgttttaaaatacaataacttctccaccaacattctcttctcaaccaataacaactcttccaccattcacttttttcacctaacttaacttcttaatcaatcacaatatctctctatttaattctacctaatttcttaacaatcgtgtcaaactctaaaacctcttttattctaagaggaggtattaacatattatcataaaactttttagcaactacgtaaatatgagtatagtagctacgaaaaatctcaaagattttttttaaaaaaaacccattagtactaaacatgggaagaaaagtgcttgaaaaggaacaaaatagatctaactgatagctgtgaaaaaatctctaaaaaaaagaaaaacaaactatatattagtattaggccttttattttctgattaagttgctctacaatatcaaatcaactcatcttctaaatttataataatcaaaactcaataatcatatgttattattttttttcgtttttgcgtatactttcttaatcctcatatttatcagttgcaaacagggcctaaacctttataagaaaagtccttaaaaaagaaaagaaaaaaatattctagaacaaagacagtgaaaataaaacctgttttgaccatatgaaaaaaaaattaatcccaactcccaattcccaagccaaccaccacagcaaagcctcccttcctttcctctcttcgtcttcctcctccctcccctctctccacagg

SEQ ID NO: 6523 - DNA, 1426 bp, Oryza sativa
ttcctatcccaggggcggcatcacactgaagtttaataaagagtaaatatcacattggaatttgaccaacattttcacttgacaccacatatctttacagttgcagtttggaatatcataggtgtttgtcagagaatgtcaaagaaatggttcaaaccatcattcttagtgttgtagtatcacgataaatatctttagaaactcagaaaatcccatcaaatggtcttttagaaaatcagaaaacaaccttttttttaaaaaaaatcacactaaaatggtgatgtgaatatgtttaaaagtgtcacaaattaatctatacggagggcaactgaataaaaatagaatagaaagtataacttaattagataccactcaaactaaatagaatgtaaaaacatagtacaatgctttgttttttatatgtatccctgtgtaaatctcatatgaagttccctcacatatttcgtcggtacccttacccttaatccaaacaaaatgatgcatagtgttaagtgaaaatgttagtttaactcttggtcaaaataaatgaccagatgtgaaatttaccctttaataaaagatgagccttggccccattcgtttctaataaaaatgaaagttaggatatggataaaacaaaccaataacacatgattaattaaattttaacacataattaattaaattttaatcattacaagcttaatttgaaacagatttatttgatgttttaaagaaatttacatacaaaaagttttttcgcacgcatagaatctgtatcctaatcagaagctaatggggcctttacttgggccgatatttgcacgactgaccctccaactattcgcattttgcatttcgatcctccttttgcctttcctctctcctctactccacacggcggcggacctccggcgaaccccgccgcgcgaggccggtccacgggaatcgatgcagccatgcagggttaacgagcgcactcttacctgctgcgcctcgcctgctcgtccgccggagaggcttccaggcgacgggggagcctccgcctgctgcgccggagtccgcggggcagctgggggatccgacggcggcgacaaaaaaaggtacagtggagtacaggtgcaacctaggattcagaatatccattcgaaattggtgttgcctgtgataatcatggttggttgattagcattctagagaattgaaatcgagaaggagcttttttatccaataattagaagaaattatgagtgtgtttagaattaaacacggaatcaccccccttaccgctacaatatcaagtgcatctcttctattgaactgatttacctttttgaaattcaggttacttgattggatctaggagctttttttttttgtttgacatggtgaacaaggttcatgcagagatagaacacacaggcga

SEQ ID NO: 6524 - DNA, 790 bp, Oryza sativa
ttcctatcccaggggcggcatcacactgaagtttaataaagagtaaatatcacattggaatttgaccaacattttcacttgacaccacatatctttacagttgcagtttggaatatcataggtgtttgtcagagaatgtcaaagaaatggttcaaaccatcattcttagtgttgtagtatcacgataaatatctttagaaactcagaaaatcccatcaaatggtcttttagaaaatcagaaaacaaccttttttttaaaaaaaatcacactaaaatggtgatgtgaatatgtttaaaagtgtcacaaattaatctatacggagggcaactgaataaaaatagaatagaaagtataacttaattagataccactcaaactaaatagaatgtaaaaacatagtacaatgctttgttttttatatgtatccctgtgtaaatctcatatgaagttccctcacatatttcgtcggtacccttacccttaatccaaacaaaatgatgcatagtgttaagtgaaaatgttagtttaactcttggtcaaaataaatgaccagatgtgaaatttaccctttaataaaagatgagccttggccccattcgtttctaataaaaatgaaagttaggatatggataaaacaaaccaataacacatgattaattaaattttaacacataattaattaaattttaatcattacaagcttaatttgaaacagatttatttgatgttttaaagaaatttacatacaaaaagttttttcgcacgcatagaatctgtatcctaatcaga

SEQ ID NO: 6525 - DNA, 1501 bp, Oryza sativa
ctcggccattggtctcctcgttggtgaatcattttgatacccctttcagccacaattgttttgtgcatacatttagcacaaaatccacaaggtaaggcaatggttttgactcgccattgagcatttccattgcgtttgctggtgtttttacatgatcccacatcttgccttaggttctgtggagaaattgatgggctaggatgaggtgttggtcgcagattacagagaggacgacttttatgctgcgcatctacagtcatactgagcaaatcctctcttaagcagggctgcgatatttagattatggtgagtttttcttgggttcagattatttcatatgaatttagctgtcagaagttccatggttattggttttgttgctgcattgtatggcaccccttgatagaatgacgtcaggaaggaaaaagaaaaccatgctaggtactacaaggctataagtataaggttatatgagagtattctgcaaacaggatatgcaatggaaggatattctttttattaactttgctaaatacctgccaatagcccaatactgacatcaaaaccccctagctctaatactgggagcataacacgccgatagacagtgtgcaaagcttttactgatgtctaatttgttgcaacaaaattattactacaccggatttatgtggtttgttgtgtttgtccagttcaacaaagaaagttggtaggatcatggaggaaatgaatcttatggttattttttcattgcttggtggtgtttcagacaactcagtctgctgccatatatccataaaacaaaacgttccgacaggtagttatttagtactatcctacaaacttacattctgccaaaaaaaaataactttcagcgtgcctgttatttttataatttaatgtgtaaatgatgaagagtgcaagcatctttctcctctgccttgacacaagagtttaggcctctagaatgtcctagcagcactgaaagtactctatgcatataagcatataaattttccatgttgcaagtcacagttatgccagtttgcttctggttatgtccacaacatattcaatgttgcaaaataaatataatgtagccatgcttcaggttacagcttccaatccactcttttaatattatgtagtgtggcatatgcttatgaaagtaatccataatactactatcttctgttaggctttcacatttaactattttattttgttgacatcgtttaacctggttttttttccccttttcctaagtggttggttgatactattccaatagtataggtgcataccgcttattggtttattttgggtaatcacatacgcgatgtgcctacttctacatttgactattagaccatggtttaaaatgctatttacttgcttacttctacatttaaattatcaggaattgtgttcatcttttagaaataacattctgtcaggtcagagatttcggatggtagtttgcagtttgctcatgaatttg

SEQ ID NO: 6526 - DNA, 1501 bp, Oryza sativa
cttgcgaaaagctaaggtttcttttgttttctttatttccaatagtttgtttctaaaatggttactaatattttctccctctttcaaaattgtagatggcagtgaacgcaagcgtcagctcccacggttttggtgagggtcaccacgtcgctcagcttcgtgacctcgcccgtttccttggcttctcgtgtcccgagtacacggggtactccgtggaccgtgttccccctcgctgtgagctctctgtgtacctttacccccgtggaggtatacacggagctggccttcgcccacaccacttcactgtggccaggcccactctccagatcgcgtaccaggacctctcctggactgcgcttcgtcgcctggcccacgactacagccaccgtctcgggggctccgccttccggcagcttccacgccttccttctggccacgcagacgccaggtacccttgtccgtacagcgagtctcagccagtgctgactcgcatggttgagctttcggaggctcaggccactcagcacgacctactccttgaggcttaccgctcccttgcccgccgctacgccgctctggaggcccatatggccgaggagggtgtcacctcagttgacactgtctcttgggactcaggccgcctctgtcacgccagccacctgtcctcccacagctcccgcggctctgcccgcactcccagtggcccgcgctcccctagctcgcgtgcgccgtactcaccagtgtactccccctacccacacccagttagcccctcctacacccccggacacaccccagttgcttcctcccgccgtggcccacgctttatccgcaccgcgcggaagcgtgttgttggttcttccaccgtgttccgtttccactacccagctcccccaccgccagcggcctgtgctgctgccggccctcgacaggttccgccggtcccttcgcgtcagccgatcgacgtttcttcgactgaggagccgactacaggaggcagccaggctgacgaggagtagaggaggcagtcttcaacagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctgtctgagttgctatttactttgctccttgccctcctaagtgcttacctgattcttacctcgccctcttctgggagtttagatggctagccccccccccccccccccccgtgcagcccgtgcgccagcccgcttcggttttgaagaaggtagagttgtgacagaagcaaatcatgagtcagctaatgagcagtctcaccacagcaaccgttcgcaccgcactgcttcccgcaacgcagaagttgagc

SEQ ID NO: 6527 - DNA, 909 bp, Oryza sativa
gaggaggagcctaagaggggtgtgtgtgatttgtgaaagagatgggaaagttaaagaaaatattttttttttgtgtctcgcaaacttttacattagggtccttgcaagattggaaatagagcataagaaaagtatattggagggaagttattatacgtttattgtgatatggaattactctcccttaattttgtttaattctcttcaaatcaaacaaactgacctatcttttttcgtttatgtttatacttatcagccaaaatttaaatttttaaccttaaatttaaacctggttttgaggttttcttatcaaagtttagttttcagtctttacttttatgcccctgagaacacgtatataaaagttttattaataaattacttctagtttacaaatatttccacgaataagccaaacaatgaagccaaaagacatgctaggttcactgaccggtttaattttcttggtttaatactttaatcgccatcgggtctggaccgcaaggaatggttcctttggtgtctcttgtggaacacaatttttaaacatgtggtagtagtacggacatgatcattatagaagagctgtgcacgccttacgatgtccatgttgattagaaaaccagctgcaaatctggatctttttcaaagcttcatcagatccttggtttacaaggagagattagccaataatcacatgctaatgctcaatgagaacaacaaaagaaaccagtactagtacgagcactacaattttcgagaaagtgtagggtggtatgtgcaaatatggtcctttaatcggagccccggcccatcagcacgggcagggggggacgggcccggtcggcggaagcccccccctttaattcgaaagacacggtcacgggcggagcgaggccgaccgtccga

SEQ ID NO: 6528 - DNA, 153 bp, Oryza sativa
gtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattcc

SEQ ID NO: 6529 - DNA, 342 bp, Oryza sativa
tacaaattggctatatatatgagcatcagaaaagtcacagcgagtaagcggcaccaaaaactctgttcgtgttcatcgttcttccgagaccagtgaattcgcgtgagagagagatagtgagtttacacaaatcttgggcttggctttcatttggtatcaaagccatgtccgctcccaccggcggcacgtctcgtactccccggcgaacaggccatcggctctcgccgtctcctccacggccacgcaggcgacagctcgtcgtgcagcggatcgttaaggaaggcggctcggtctcctatccaacgctcacacgctcaaattactctgattgggcggtgttga

SEQ ID NO: 6530 - DNA, 342 bp, Oryza sativa
  unsure (1)..(342): unsure at all n locations
accacaggagccggagatcaggatcccattctttaaaggggctttcaaggggcttgggggggcctttggcggttgctccggcttgtgggggggggcccctttttcttctgaagccttttgcggggaaagagggccgcccggctgacacaacctagcattcncccgggggggggggggggggggtgggcccccggggacccccttttgggtccaaagtcccaaaaggttaggtttaccccggggcactccccaccacaattttaggtttcagtccggaggaacgcccgccccttagggtttgggtgctgcgggttttagcgtcggggggccccgcgaagctgg

SEQ ID NO: 6531 - DNA, 1501 bp, Oryza sativa
cttgttgaggtggtcgatgtcaggcgcggcgccgaagtcggcgccggtgtccgggttgccggtgccgtcgccgtaggggtcgccgcggcagatcatgtgcgggccccagtcgaggcgggagtcgggcgtcccgccctcgaagaggcagtagatgccgcggccgtccttgtgctccgccgtgcggtggttgatgacgatgtcggcgatcacctggacgcccttgccgtggaacgcctcgatcagcgacttgagctgcgcctcgttgccgtacttggaagcgtccagatcgtacagccgccccggcatgtagcctgcagatcagcaatcaagccaattggatatattttgccggcaatatggatcgacgacgacgacgaaggtgctcgagagagcaccggaccttgttcggcgacagattgagacggcggagggagccagacgtgggtgatgccggcggcggcgatgtcgtccaccttgcccatcagcatgttgtaccacccgccattctccttccacgactcccagttgaagccctgcatcatcatcaaacacaagagcaccattctctcaggctcagaacaaaacacgatcagttcactgcagcctgcaacccaactcatggcgacctcttacctgaaacaggacttgcccggctgccaagctggaggagaagccgaggaggaggatgagcagggacagggacaagaagcgtttgctcgccattgtcctcagtacagtacgtgcaggctgcagctatacttggaatgagacaaggcgagatggagtgatgaagctgggtgtgtttctggtcgggtatttatagtcgagaatgccggggattgcacgctcaacttgctactcttggaggcctggttgttgggctagcttgaatgttgctttgggacactggattggatggataacagcagtttgttattggccggtgagcccataggcactttaatggccttgagagatggagccctcaaaaaggtgccggttagtaggaaatccggctttcttgcatgtgcttgtgcgagctgaagctaaaacacctgatcgcattgcaggtgcgtttggttctcgattatattttatcatcatttatcaataaatatttttttagaccggtcacgcgggaaagcttcccaatctgaatttctttaaaagagagaaacagtacatatgattaattcgttacattggagtgcagcaaggaggaaagaatttctttccaggattctagcctttccacccagaggttcacatcttctaggcattttgatataagccgagcggtggaggggttctgattcctgaagacgatgtcatgccgatgattccacagcccccagaaacaaagaaggtagaagagttcgtagtgtttggtcgggatccggctgggcctgtccaggttgtgaagctcctgcatagaggtgatgtgcaggtggatttccaaggagttccagaatgcaaccgcgaaggagcattgtatgcagaa

SEQ ID NO: 6532 - DNA, 1366 bp, Oryza sativa
atattttaggacggagggagtatgtaaatatttcataaaaaaaatgttaagatagataaagaagatataaaccactatgcaaacatgcacatcaaaaatttattttccagtaaagaaacagaaatacacatattctatttgtgctggagatgtactgttcacaatattgtttttttattttttatttatctgattatatatctgtttcagccttgcatggttgtgtatgtttgtgtatagacttatgccattgtgattgatgctaccaattattttcaaactatttttttatagaggaattttatagttcttgagaaaataccttgaagtatctaaattttacactaaaattgttggtaccttgaggtataaagtacctagaggtaccaaattttactagaaaattgtggcacctttaggtaccttctcaaaaatagtacaattatgggccgttttggatttagtgccaaaacgtgctctacaaatattttgatagtttgaacagtgcataagacgggtttggtttgaagccaaatcattggcattgccaatgtccaatttgatattttctatattatgctaaaagcttggttctaaattggcctccaaccaaatacaactctactctaccaaaaaatttgtagtgccaaaacttgcctaggttttgtcactaccaacattttggtaagtattaaaccaaacaagccctacatttttttatgtacatttaagttgtatgtaaatgatgggtgcggttgcacctaggtgaaaaaaaatacatattcgccacaactcgcaacatgtaccaattcagcagcaagtgtaagagagaagatttctctcgttttacacgcgcaccgttcaattcctgaactactaaacggtatgattttttgcaaaaattttctataggaaagttacttaaaaattatattaatctatttttaaaatttaaaatagttaatactcaattaattatacgttaatggctcagctcgttttgcgtacattctcaatcgattcttttcctctgctctcaaatgctctgtgtgcgatcaggtattcatgttcagctcgcacaagcacaagcaagacagatggaattcctactgacctgcgccttttgagtgctccaactctcaaagtctcaaggccattaaattgcctatgggctcaccagccaataacaaactccggctgttatccatccaatccagtgtcccaaagcaacattcaagcccagccaggcctccaaaagttgcaagttgagcatggcaaaatccccggcaattctcgactataaatacctgaccagacacacccaggagcttcatcaatcatccatctccgaagtgtgtctgcagca

SEQ ID NO: 6533 - DNA, 893 bp, Oryza sativa
  unsure (1)..(893): unsure at all n locations
ccttccacgcgttcgttgggngtttagctcgttccatttcttctcccccaaacccccctcctctcgtgcgcctttgtctcctctgttgctcctccccccccccccgggcgccttgattgcagtacnactaggccagnacntcatcacaccaagccctagcaccgcccctcccgtgagcccttccttcggtgaacccggtcactaacaaggtgcacctggtgcaccggaccgcgccccctttcttccgcgcgccctaatgggccgccttccccgcgcccgcgccggcccaaatggctcggccgagcctccttcaaccctcgggccgcgcccttgccgcccgagaaaatctaatatacatcaatcatccatttccttttccataaatcaattctttattattccaaaattccataaatcaattcctttggtcccgcacgtcagtgattgtcaataatattcttgagaatattatttctataaattccataaaccattcctcgtattccaaaaaattccgataaatcatttcctagtccggaaaatcccatttgagcttccaaaattcatatatctcgatccgtaacttcgatcgactccgttcagcttccagtatttccgtaaagttgagatctttttaatggcactattaattagtctaattaggatctttcttttggtcttttgtctagattttcgattgtttgcgtatagttgcggttaccggattttcgtcactcgtggttttctcgaagattcgtgaagctccatgaagaccttgagcaaggcaagtcaccctttgaccaattgctcctataattggaaaatcattattattttgtttgcaacttgaattattagaatcacacacttaacttgcttggccttggtttgcg

SEQ ID NO: 6534 - DNA, 1501 bp, Oryza sativa
gctgcaattaactactccctctgtcccaatatattacaacttagatggatctgactacgaatctggacatatggtatgtctggtatgtccagattcggtatatctggtatgtccagattcgtagtcctaggatgggtaggttgtaatatattgggatggagggagtacaaatatgtagtctgctttttttctctctcctccacataaatagaaatatgacgtggcaagatgtacggactgtttacgtcaccctattataggtgtgatcaagaatttaagacatatcaacttaaacaaatactccctccatttcgaaatgtttgacaccgttaactttttagcacatgtttgaccgttcgtcttattcaaaaattttttatgaaatatgtaaaattatatgcctacataaaaatatatttaacaatgaatcaaatgataggaaaagaattaataattacttaaattttttaaataagacgagcggtcaaacatatgctaaaaagtcaacggcgtcaaacatttcgaaacggagggagtactataatactagtacatgaacagaggtcgcaatgccacgattgggttttcatctggaagaaccgggctccaccgaaagtgtaattcttcgcctgggtgctctcaaaagaacgactaccgactagcaaaatctgttgaagaaaaaggttgtccaatcggcaacatgcgacctctgcaatggagcgactgaaactgccttccatttctgcatacaatgctccttcgcggttgcattctggaactccttggaaatccacctgcacatcacctctatgcaggagcttcacaacctggacaggcccagccggatcccgaccaaacactacgaactcttctaccttctttgtttctgggggctgtggaatcatcggcatgacatcgtcttcaggaatcagaacccctccaccgctcggcttatatcaaaatgcctagaagatgtgaacctctgggtggaaaggctagaatcctggaaagaaattctttcctccttgctgcactccaatgtaacgaattaatcatatgtactgtttctctcttttaaagaaattcagattgggaagctttcccgcgtgaccggtctaaaaaaatatttattgataaatgatgataaaatataatcgagaaccaaacgcacctgcaatgcgatcaggtgttttagcttcagctcgcacaagcacatgcaagaaagccggatttcctactaaccggcacctttttgagggctccatctctcaaggccattaaagtgcctatgggctcaccggccaataacaaactgctgttatccatccaatccagtgtcccaaagcaacattcaagctagcccaacaaccaggcctccaagagtagcaagttgagcgtgcaatccccggcattctcgactataaatacccgaccagaaacacacccagcttcatcactccatctcgccttgtctcattccaagtatagctgcagcctgcac

SEQ ID NO: 6535 - DNA, 851 bp, Oryza sativa
aaaatcttggtacattagaaaaatctcagaagctaatattattggaatattgccttgctgatctggacagtggtaatatcggcaaatgcatgaatggcctcccattgattccattagcaaataaacagtttgggattttttctggtatttcacaggagaatcaatattatgtctgtgatagcatagagtatgagcttctttctgctgttagcgatagaataattgaccgaagcattccccctgtaatactagacaagttgtatcagatagccagtagttctcaggttaacatttcacttattgaaggccgaatatttcttcagttctttccctggctatttcctcctggatggaaatgccgaaaccaagttccctgggatccagaatcgggtggatcatctcctacagcagcctggtttaaacttttctggcaatacattggggattgttcatatgaccttgatttgtttagtgattggcctatattaccttctacctcagggcacctttatagagcatctacagtctcaaaattaattaatacaggctcactgtctaatttgatgaaggaactcctgaccaaattaggttgcaagatactagacacaaagtatttgagtacgtgccagcatttgtctaattatgtgtatgatggtgatgcatctggagtactccattcaatctttggggttgcctcattggagggtgttgatttgcaagctttgtttcagcgcatcactcctgctgaaaaaaatgaactatatcagtttgttcttgatgcaaaatggtacttaggaccccacctttctgatatgagcataaatctatgcaaaaagttacccatttttagg

SEQ ID NO: 6536 - DNA, 532 bp, Oryza sativa
cactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcagg

SEQ ID NO: 6537 - DNA, 1501 bp, Oryza sativa
gataggatttgaatttcggaatttcatttggagacttgaatcggaattggaatcttgaggtgggcgattttgatggcgacgagagggaacaacgatggagattgaattgagatccatggcacgacttagactcgcacacaaagaacgaaaattttcgcaatttaggattttgccgaattagtttttaacgtttcgcgaaaagcggagcgttacaacatcacatcacattaaaaactttcctacacgcataaactttcaattttttttccaaactaccaactttccccaaacttccaacttttttcaggaactaaacacagccataacccagagtgaggcatgacagcatgatccatacggtgctcaacacatgaccattcttttttcctctcctctcccacaccctgcactcaaaagtgaagagaccgtgaggccaactgcaggactgtttaacgaccactccagggcatgatcagattcagtttcctctgcaaacttttgttggaattaatgaatgggccttagcccactcgaagattaattctttggaaaatcacaaaagcccacctcatgggatggcatgcatgtggagtttagtaccaccttgcttattctaggagagtgggacctccttaaaagggaggatgtcctcctagccacttgaagcatgtgtggtggagagaagaggggaaacacacgcgcgcgctcgcttgcctggcctggcagggcagggcaggcggcgcgcgtgcacaacgtacgcgtcgaatggtccgaaaaattggctcctcacccttgcgcagatgcagcctccttttgcagttttgttttgctgcaaattcagattcgtttttgttttggaaacgttccgaaaaatccgatgcgtgcaaatggcgtggagtccggataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactctgtactgcgccgtcgctcgtagactactccatcccgctcgccggcgtgcaccagcgatcgggagagcaggtctccggaacctctgcctttgacattctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 6538 - DNA, 336 bp, Oryza sativa
cagagggatggcaatggcgcgggggcggcgagcgaaacgggagggggaatggatgggagggcgccttggtttataggacgacgatgtcggtttgaaaaccgaccttgggcggtcaaggcgcgagctggcactcggcgctcgcggccaagacggtgacagagggagggaggatgacgccggcgggaggaaaaggggaaaaaggagggggagaaaggggcttgcccccttgccgatttaggaaaaaggaggaggggagcgggggcgtcgcggcagagggaggagggctcggcctccgtcccttggcggcttgcgtgcggagtggcggggccgaggcga

SEQ ID NO: 6539 - DNA, 444 bp, Oryza sativa
ttccgtccattccgtgccgttaagtcctataggatgaacaatgtatttaacggcacgaaccctaacagcgatggcatttttgagacaaaatcatttatacgatggcatttcttgaaactcacacttgtcaatggcatttttagaacttagatgcttgtcaatggcatttcatggattatctctaacaatattggtgcatgagaatgtgaaaggtatcaagcctacatgttttttaagcatggaaacgtggatcagtattggtttttgaatacgtatggcatctctcctctttgtttttcctatgcaaaaacttcataacatttaatgcttatatataaatcaccttcagttcctttcccagataagttcatcaacaacaattttatattaattcatgagaaatttgttcctggcttcctgcgaatctatatattcccttctagg

SEQ ID NO: 6540 - DNA, 1270 bp, Oryza sativa
aggattatcattgatcactatatctttgaacgtgtgttagaagatatatttgttggtatatatgtgtgtacatgtgtagggttatgcatcttatgtgaaatttaaaaacaaataatggctcttatcggaagcacgcagctaattaggaagaagagcaatgctcggaagctctctacttgcaatattataaactactaagtagaattaagggtaaattagtaatttactaatacaatgattaggggtaactttgttatttacggtttttttatcaatctgtgatcattcaatccactgacatcgctcatatttcatcgaaaaagcaaaaagaaaaagaaaaaaatatttaagtcactgctaagacgattatacccctcaacacttttttttacaataatacatctccacatttctactatcactaagtagggtggtaatataaatagatcttaacccatcgatgaaatgagatcaatggttcatattattttccagtggaggaccagagtggggctcaaaaatgtgacttggcaccttgtggaagctggctgtagtagactagtagtgtggcagtaatccaggcaatgctgcaaccatatctttgaacggaggagggtgcacgcgcaaagtttgaaattttctcgcttcctcaattaggaagaacaaactacacagagagaagagaagatgcaagtgcatcctaagcatgcatgaaatttacttttcaaggtcattatgtgaccagagtaggaatattttcattgtatatataccccggcccttcatgtcttcgatatacgctccatcattcacagcacgcatctattcaatcaatccgtccatctcatttgtcaccatgggcaaaaacttcctgattgtgttaagcttgctaaatgccgcattggtggcgacatccgtaggcgcggagcaatcagacgaagtatccacctacatcgtgcacgtcgtgcacgcccatgcagcaaacacggcacaccttgctcatgcccactatacgtccttccttcaaaggattcttccttcccacatgcatagcgggtcatgtcacacctagaaattctcaaaccagaatttctaagctgaatgtgcattaaatccctgtccaggaccagccagggtacacaaacgacaattgttgacatacagacccacgtcttagaaaaatataaaagattacaaatgcagcgggaaagattaaagcgagctaaaccgggaagcttgacttcagcagcgggcgactccactccacagg

SEQ ID NO: 6541 - DNA, 1501 bp, Oryza sativa
tttgttttttacctcttgcatattgattttcccaaatcaagttgctccctacatcccccaatcacatataagataacatcgtagatcaaatacatcataaattctaaaaaaaatacatcacaaatatatcacagataacatcatagattcacatcacagatcaaacacatcacaaattctaaaaaaaaaaaatcctccgcctaccgcacggctgcgccgacgccgtcgagccaccgtagctccaccgctgcgtggcctctcctctcgctggatctaacggaggggagggcgaggccgccgccgccgcttccgccgcccggctgccattgccgcttctcgagaaagcgagcaagacagagagaggcagcagacagagagagcaagcgagcgtgggagagagataataaataaaaggtcgtgtgggcagatcgagagagacgaggcaagagaggataagaaagtgggagagagaaatttagtctcggttggtgatatcaactggatctttagtcccggttggtgataccaactaggagtaaagatcgtttggggcctgacacggcctaacagctattgaaccgggactaaaaatgatgactaaagatcataaagtaccattggacttttgaactggggctaaagatattctttagtccctgttcctatttgaaaaggcactaatgtgatttttgtcattcgggcaaagatcacttctcctgatcggtgatgttggcccatgggtcccaccatcatatattattaaacttaaacgtggccgtacatcaaataaatcgattgacgttggatatgctccattgtactattgggggatgggctctgaaggaccctctgggtccatcggctcacccaaacgggcatttatcatgctcactttctctttgtcagaggggttccaccccacccccgaagggatgtggagccttcaggccacccctaaccaagccaggaccgtctacctcgtctttagaggagcaagtggatctggacccggggctgtggccttggagaggtagagataggaagatgaatgggagcattgaattttcccacctatgtggtcaaactctggttgcccgcattgcttgctgtagtcgaggccggtaatctcagtcttattatggatggtccagacccaagattcccaggattactgtcggcttgcgagccggcatgggctgctcggcggccctccaagaaatccctctatagtacccctctagaggggcccaccggtcagccagtaggcctagaaatgcctatatgctgcccatagccatagggctatggttgtaatcttccatgtacttagccctctataaaatacagtaaccgccatgttgaggaaggggcagatatttgattctttggcagacatatctgttggactttgttccaataggtactttcatgactcacgtacatctaaccttgcacaatcgtccttatctcttcatgcattgacaaatttgaggacaattta

SEQ ID NO: 6542 - DNA, 1501 bp, Oryza sativa
cactaacacgaaatcgttaacgttgtcgctatcattgatgagttaccccttttctctcccttctcctcctcatccggaacttggttccctggccattggattgaaatccaatggaaatggatgaggtgacggagattgagagaaatctcagtcacatgaaaactagcaattccctctataaatatcaagtttgactaattacttttttaagactcattgtgccatgcttcaattcatagacaaattgcattcataatatcttaaaatttaatccaaataaaatattaaagctaagtcaggggcgtagctaggggtagtccctgtgggctcgggactaccccaaaatctggcccagagacccccacccccccccccaaaaaaaaaatttaggcccaaatagcccagaaacatctagggttggaggattcccctccctcagcgtctcagccaccagccagcgcccagcagcgccagttcgcccgagaccctgagcccgacgccgctagccgccagcctcctcgagacctcgactccgcgccggcgcccggtgccgtcctcagctggccggctccctgctgtccgcgccggcgccgccaccgccgtccgcgccgagtcaccgacgctgcgccatgccgccgtcccctcccctccgtggctcagccctggtaagaaatagctgcctaaatggctagatttgtgaattgtgattagagaattaatgagtctgtgaagtgtgaataactaagaaagtgagaatgcaatttataaattgttagattaatgaatgtgtgctaaatgctaattgctattgtttgtaggatttataatttgttatattagtggctttttaattttttatttatgtgtaagatctatgttgattgttgaactctctatgttgtaatatttgcacattttgaacttgcttgttaagtaagccgcttatggatcttggaagacattatttctatagtattttcactaaatttgtatttgtatatcagttttatggtgcaataaaattttaccatgtgacatgaatgtgtgaactaggactacccaaggaaaaattcctggctacgccactgatagctaagtattcattcactcatatgattaattttattcttatcaatatgttgatgactaaaaattcaattgactgtgtgaatcataggttaaagactctaacaaaaggcaaaattttgaaaaacttttccacctaaaatgatcaagtatctatattacggagagtgcacatgcaaagtttgaaaattttccctccctcgttaggaagtacaaaatacaaacagatgaaagtccatctaatctatctatgaagtgttctcaaagtcattatgtagctagaatagtactattttgcttgtatatataccccttgatgcctttatcataagattcaccaattcacaacacacaccatgcatctcaaacaaatttctatggtccatccggacatctcatttgtctccatggggct

SEQ ID NO: 6543 - DNA, 1118 bp, Oryza sativa
tccatccctccttttttgggctgacatatgtatagctaaataagtctacttttcgtcccacctctttaggctagcatatgtatagataaaataagtctattttacatccctattctttcgtccatggcatataatatgtctatttttactcccctattttttttatatcgggcctggctgccggcccatcgtgccgtgctggcctggtcgtgctgggccggcccaacgtgccggtggaggggcccagacacggccggtattcaggccgggccggcacgggcctgacctccgtcaggccatgccgtgcttgggccggaccaaaatgccgtgccatgggccggaccgttgggcctcgggccttttggccattataaaaggctcctccccggaaaacgctgccccgccctgcccccattcccagatatagaaaacccacgcgaccgccgcgagcgcgaagcaacaaaggcgcgcgcgataagacgacgcgctgaggagagagaggaagaggaggagcgcccttccctttcccctccacccgttcgtccgatcggtcgccccggatcgcgagccagctagccgatcgccatcctgcaggtatggtcggattccttgcgatcgcggtgattttagatttttccttttcttttctgcatgtcgcgtcgccgctgatcgggggcggctttttcttgtttttgtttttgggtgcgggggatagagggatcgattaattcatcatcattcatgagctgctgcgtgtggcccaaattgatggcattttgaatttccttagcagagtattagtgcgtgtgtgtgatgcttttgccttttgctaaaattgggagaatgcgggggatatgcctctgccgtgttcggcggaattaccattcggtgtgagcgattgtgctgtggtggtagattcgatcgtttccttggtagccgcgtgggaggtttgccttgatttggttaattttcaggtgattcgctccgatgcatgtgagatgtaactgatgcgaaaaatgtttggccaatgctcttacgatgttcagaacccggcttggatttggagcgatggtgcatcgtattcgctttgtggatgagtaatggtggagcctaagaaa

SEQ ID NO: 6544 - DNA, 1501 bp, Oryza sativa
gaacagaaaatgaggcatgccctgcagcttcctctgatgattaataagcactcgataataattcactttctaaaattattagatgaatcatggcagtgaaataatatataaaagagatgagaaagagaatcacacctttggaacacgcaaaggattcctcgaaatatattcgcacaatttgccgatctttcggtcattgggttcttcatcctaaaagaacaagacaacatttatagccttttccaaaaaaagaaagaaaaagaaaacatttataggtgtgttactctcgcttccccagataggtttatatggggatgtattttaacttttaactgtgcacatatactgatatacaacagtagaacttgccgaacatagattttcttctttttgtaattgcgttattagtaccaatctgtactacaacgagagatactaaaataagcaactactgttggagtatgatacagaaggaacctaaggaaccaacaaatcgatcaggatgaaataagcaaacctcaaactacacaatatgatccataatgtgcaaatgtaggatacagaacaaagcctaatttatccatgaacatctacagcgggtttcacctgtgacttagggaagatttctgagagcaacttcttgtatcgcttgaccggatgccgagacctcgtgcgcaatgacgggcaaaggaagcaaagcctctcgcatgcaggcaatacctcccttgacaccacacccatcgtcatcgggatttcttaggctccaccattactcatccacaaagcgaatacgatgcaccatcgctccaaatccaagccgggttctgaacatcgtaagagcattggccaaacatttttcgcatcagttacatctcacatgcatcggagcgaatcacctgaaaattaaccaaatcaaggcaaacctcccacgcggctaccaaggaaacgatcgaatctaccaccacagcacaatcgctcacaccgaatggtaattccgccgaacacggcagaggcatatcccccgcattctcccaattttagcaaaaggcaaaagcatcacacacacgcactaatactctgctaaggaaattcaaaatgccatcaatttgggccacacgcagcagctcatgaatgatgatgaattaatcgatccctctatcccccgcacccaaaaacaaaaacaagaaaaagccgcccccgatcagcggcgacgcgacatgcagaaaagaaaaggaaaaatctaaaatcaccgcgatcgcaaggaatccgaccatacctgcaggatggcgatcggctagctggctcgcgatccggggcgaccgatcggacgaacgggtggaggggaaagggaagggcgctcctcctcttcctctctctcctcagcgcgtcgtcttatcgcgcgcgcctttgttgcttcgcgctcgcggcggtcgcgtgggttttctatatctgggaatgggggcagggcggggcagcgttttccggggaggagccttttata

SEQ ID NO: 6545 - DNA, 1501 bp, Oryza sativa
tcctcctcgtgcatgatcctctactcgtttcttcttgcttcgtatttctactagtctagctagttattggctcgatcgaaacaatcgtattactattggcagttatttaattagtttggataattggatttcagcactttcatatcagtagtcgatttgaagttttgaactattatgtttatgattatgattttgtattcggtagtattgtctcgtcgttaaggaattggatcatcagatttacgattatatatggttcatctttccgtatatgctttattacttgtgctaatagcaaaatgcatattcaatttttttttcatgcgcttacgatggtgtgagtctttcctcgatcaaatcaggggcttcttaattgtttcaaatgtagataccgtgatgttataacttagtatcaaatcagggtgattgactttatcgtgatatcaacaatataaagtactaccgtcctataaaagttaaatttctaccttccttcgtcctaaaagttaatttctacctttgaatctttatctcataaaaattgtatttttattaatgtagcacctggcaaattgattacattaaatatgtttccttgtaatttccctttcttccatctcatctctaatacgttgtctcaaccttccttttaattaagtttatatatgaaatgtgtgcatgtattgttttcattaaataaagttattgtggttatttgtctatcctcctaatatatgtccttaatatcctaaaaaattatttttcatgggatggaggtaatttttttaaccttataatgaacagaaaaaagaaagataaaaacacaaccgcaaaacgtccattaatgtaaaaaacacatatccgtagaaagtcatacaccgtactttaagtagaaagtcatacacctaacttcttttaaaattaacttatctattgtattattaatatagcacgcaccatgtttttgtggaggctataaattccacattaattggggaaaaataaaaaaaggtcttaaccattgaactattgtaatttgagattataacggtataaattgattgatatagttgtataaaatacaattatatttatagaaatataaattgagagttgtatatgaaatctcggtattataggaatagaaactaagagttgtatataaaatccaaggattatagaaatataatttaagagttatacatgaaatccacaaggtggttttccggccacgggtcttttggttagctccacaaggtggtgggctagacgatatgggttcgaagtcttaccccttttaattatttgatattaggtctttccctaatattcgcatctttttaaattcaaagttaggttattccttaatatttgcgtctttttaaatctaaagtctcaaaaaataggagctaagagaaactgcgcgggggcaatcctctagtttctctaacaaaatagtaagtaatcttgatcttctcctaattttcattaatagaaagaa

SEQ ID NO: 6546 - DNA, 1280 bp, Oryza sativa
cttcccctggaatatgcattgccacaagagaaatatattttaggtaagccacatgattgacaaacgtccatatgaattaccacatagaacaatcaaacatgcaaggaaaatttcaatgcaaccataacatgcttaaaaagctttgtatgcttcaagggatataaaagtacagcaaagcttaccagcataattggcttcatcagttccattaggcgcccatgctgcccatataagattgccaggagcgagtatatcaggctttagaacatcagcatcttgaaagctaaaatcttttacatccggtcctcgagaagagaacaaggcaacctggggggcagagttgtatagagttggtgccaaaccatctgcaatagctgctgttgcttggaaggtcgtggcccttcctgcccaatctcttattgtagaagagttgtagtagtctataagatcctacagaaccaaaactaatgtcacctgactatatcaaaaaaaaaacgtattatctaactaacatgcataggttttccctactattcaattatcatgtcatcctacaatagcaggcatatacaattcatgtcactgctcttgaagcatgtacattctaggggactgactttctgagagtagctcgactaaaaaagaagacaactatacgagaatagtttgtgggcactgaacagacaccaaaactagatggatggttacacaagagctatacaatccactacgctacataaatagttttttctagttcatgtttacataagacgtagccagataaaagaaaaacattccagataaaagaaaaaacattagaatctgcagcttttcaatactccactcatggtgttctgcctacagatggcatccatgatatctacacactgacacttttggggatgcaatacttcctccgtcccaaaatgtaagcattttttaggttggcacgggtattaagaaagtatgtgagaatgattgaagaaggtgtgtgattggttgaaaagagaaagtaggtgaaaaagaatggttgtgattggttgagaggagaaggtaggtagaaaaatagcttcattttgggacaaagtactgtgctagaaatagctacattttgggacggaggtagtacctttgttctgctgacatctgtgatgagaataccaggcatgctgacaggtacaggatcaaattttgttcctgggtaactattctccacagcaacaataaaaccagctgcaccaagactcctagcagtctctgacactttcttgatagaagct

SEQ ID NO: 6547 - DNA, 921 bp, Oryza sativa
ttacctggtgtaaagtgcaaaatactctatgaatttttaccgttttcttttggagcaaaactttatgaattttactaagcaataagcaccaaacaaaaagaaagatgcacttggagaacgattttgctatatctcactcgaaagattttttcttatctctcactcgattttcttactcaaatttacagtgcattttctggtaagttacagtgtaatttatgaaacttacactgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgattataaaaatctttcgaaagatgtataggtactccccttggagaaacacataagcctaatgaatttagatctagtctaatttggacccatctatagcccatgcgtgggaagaaccaggcccatagttgatgatttttcttttattttctagcagatctgaaggatttatcttttattttctagcagatctggaggatttatcttttttactttctagaagacctgaaggatttatcttttattttctagcatatctggaggatttttcttttatttcctagcagatatggaggatacactataaatggcaccactataacagaacattgatatccatgcctaaatgcattatcacttagtaccaataaaataataaaaatatgaattaattaatgtgctagctagcctatccaaacctctctctatatatacacacactatatataacaaataccatttcacaatcacagtgactacatacatacatataccattgcagtca

SEQ ID NO: 6548 - DNA, 1501 bp, Oryza sativa; identical to SEQ ID NO: 6009

SEQ ID NO: 6549 - DNA, 1501 bp, Oryza sativa
gagctaagccaatttcaaaagcctatataagcccaagcattacacccaacaacagcccgtatagacctaagcactataccaaataatagctcatatatcagataggttatataagcccaattaacatccaatattgcataagctctgtcggcgatatgggcccgggggccgggggtaccaaacccaggagggagaggctacccccacaggacacgtgcaataaatcccccatgggagcacgtccttgtgtggggggcggccatcccccctcgggctcgggaccacccccgcacccctcgggcccgagggtttgggttatcccgagcccctcgggcaggtgccgcatggcaaccatgcatgcatgttaagtggaacgactgctacccacctaaccgcatttatggcaagcggggcaggcgcgctccgtcgcaccgaatgcgacgggaagcgtgcgtcgtgcgcctgcgacccgtctgtgacccacctgtgaccggtctgcgaccgggtgatgaatggatgggatagcggcaagccccccacgccccgagctcatgtcaggcggcatgagggcaggtatgccctgtctcgtcatgatgatgaggagctctgtgcccctcatccaatcaacagccggcttgaccagccgggacgtggccgacattgtgctctcggtacatgcatacttccaaaggtcctcatgcattaaataccgaatgacagcgttgtcccctgtgtcagccagcaggatttgatgggacttgcccagcagccgacgtgcggatgacttctggatcaaggctcaagacatgcattaaatgtagagaatattttcctcttcccgatggtggctcttgcggcacatgtggtatccccttagagtataaaaggaggaccgcgcctagcggaggaggggggatcgaaccttcgaggccagcggctaaaggattgatctgccttagcttgcccaccagggattcagagactttggaagcacaaaagaatcatcccctagtcctcatcgtcacttagaaattaaccccctctaatccacttcacatacgtcctaaaaactcctcaagaattcacccgtgcccccggccgaactcacaaaggggggcctcacagcctcccgctggaggggaccactctctgacaagctcaattaaaatccaatatttcacaagcccaattaacaaccaatataacacatacaagcccaataatatacatacaggttcactgtcaagaactcagtgatcacaaccatctcacgtcgagagagaaggggagaagagaagagaggggagggtggtgaagatgggactgacatgtaggtcccacatgacagagttgacagatttcgtgacggggtggcatgttctaattttgaaacattatagtggcatccacctgatttcataaatagtaatgatatattttcaattgggtaaatttgcaatggcatggatccacttaacccccgaatcaaaggatttatgaa

SEQ ID NO: 6550 - DNA, 1501 bp, Oryza sativa
actctagactcgtctttcaatatttatttttttttaaatttctaatttttgttatctgtaaattgtatttttatatagactctagtcacttcttccaatattttttttaattttgaatttttattatttctaattgcatttctatgtggactctaaactcattttttaatattctttaatttttaatttcgaatttcagattcgtataaattgtattcctatatcgactttagactattcttctcatgtttttttttaatttcaaattttagttatttgtaaattgtatttttatatgaactctaaactctacttttaattttattacgtttattctgaattttagttagttttaaattcctatatggactctatactatacttctaacattccttatttttaattccgaatttctattatttcttaattgtatttctatatgtactctatactctacttctaatattccttatttttaattccgaatttctattatttcttaattgtatttttatatggactttatactcttcttctaatattctttattttctaatttcgaatttcagttatttataaattgtatttctttatggactctagtctcctcttccaatattctttattttttaattccgaatttcaactatttttaaattatatttctatatggactctgttcttctttttctccgagtaatatgagaatttctaggccgtgagagtgaacgtgtaggctcctttttcttttcctttaataagttaataagttaatagatagatttggttgccttgagtatgtcctgcactgatgatccagaaagagattgcagctactaccaatcgatagcactggagcatgtttagctgttacaaaattcatggctaggaagcattctgatgccatgcttcaaaggacatgcacagaaatcactggacagaaatcaatcctctatcagccactgctctattcagttccttgctgaccatggtacaccataaatgcaagcatgctgttacaaccggactcatccagacaaagtacgattgttcgagtggacaagcatttctggactgaaactggaggtaaactcgtgatcgttactaattgttttaagatgtccttgaattcagcaaattttgtaaaagacaccggagaaggtttattaagaccactcactgggaattagcacctactaggtacatacatcacgtggactgatgactccatgtgttagttgcattgataatttgatggcgactggcttaatacaagtacaaaaaaaaagacttggggtgtgtttagttcacgtcaaaattagaagtttggttgaaattggaacgatgtgacggaaaagttgaaagtctgtatgtatagaaaagttttaatgcgataaaaaaatttgaagtttgaagaaaaattttagaactaaactcggccttggttggagaacaacagttctatattgcaattgcaacatattgggtgttctttttttc

SEQ ID NO: 6551 - DNA, 1501 bp, Oryza sativa
ttcaaatttgctagtctaaacttagttataaaagacaaataattgtgaagaaatccacgaagaaaatctcatcccgacaggtactaatcagcccgggcttatgtagaggtcatccatggcccatggttactgattacatttctgttaatccacagaacacttaatttttagaatacaacatataataggttcatgattgcactgctcacgtttacaaaagaattacaccaacttcttcatggctcacatagagttcttctctaagtgagagcatttctggagttctcttttcttttgtcctcaccaattgctggtgaggaggtattgtacctacagaaagagacaatgtttcttacttcagaagaggaaagaaactctcttggtactcagaataatctcttataatagtcttctccaatgattgattttaaaacaaccagatgcttcaaagccaatgcttcattgccctatatataacaccagctgcagaccggtcttcgcaaaaaggcactccatttgctttgttatactcatagctcctttgcttcaaaatgacgagcatttaccaagaattcattcataccaagtgtcagagcttcagaagcatttgtagatatgttcttcattcaattgtcctcatctatagattcgtttccttgcatgttcacccattctggatccaactgtcctacttcttcttaattaacctcctaggttcagttttattaatgtttctgaagccaagcagcccaaagttcaagccaggttacattgacatgttgttcttgtcaacctctgctatgaaaacggagcggatacgaacggataatgcttataccatattcgttttcatattttttaccggataggaaaacgaatatggatagctcgaatacggaaacaaatacggattatctcgaatacgaataagaatcgaatatgatcggacacgaatacggaaacatttttttctcggaacacgaaaaccaactcaacttctaatagaaacaaatatcaacatatataattagctcattttatataaaatgaggtataatttataaatattttttaaaatttaaataatattaatagtatggactagtgttaagagataaactactattaaaaatctataaaggtatattgaaggttatagagttagaaagaaatggggtatgtctcatgggtcctgcggatatccgaatagcactgttcaccggatatccgaattattatccgtatccgacggaaaccctgataccatatttgtattcgtatccgggagaaaatattcgtattcgtatccgtatctgaactatccgagaattatccgatccgaaaggtatccgtatccgtttttgtccggatcggacagaaactatccgctccgttttcatccctacaactaacccatagatttgtcacaattgggggatttactgttaccatataagttggcccaataggcacaatatagattacatgactagaggaaatg

SEQ ID NO: 6552 - DNA, 1501 bp, Oryza sativa
gctgcaatctctttctggatcatcagtgcaggacatactcaaggcaaccaaatctatctattaacttattaacttattaaaggaaaagaaaaaggagcctacacgttcactctcacggcctagaaattctcatattactcggagaaaaagaagaacagagtccatatagaaatataatttaaaaatagttgaaattcggaattaaaaaataaagaatattggaagaggagactagagtccataaagaaatacaatttataaataactgaaattcgaaattagaaaataaagaatattagaagaagagtataaagtccatataaaaatacaattaagaaataatagaaattcggaattaaaaataaggaatattagaagtagagtatagagtacatatagaaatacaattaagaaataatagaaattcggaattaaaaataaggaatgttagaagtatagtatagagtccatataggaatttaaaactaactaaaattcagaataaacgtaataaaattaaaagtagagtttagagttcatataaaaatacaatttacaaataactaaaatttgaaattaaaaaaaaacatgagaagaatagtctaaagtcgatataggaatacaatttatacgaatctgaaattcgaaattaaaaattaaagaatattaaaaaatgagtttagagtccacatagaaatgcaattagaaataataaaaattcaaaattaaaaaaaatattggaagaagtgactagagtctatataaaaatacaatttacagataacaaaaattagaaatttaaaaaaaaataaatattgaaagacgagtctagagtccatataggaatataatttacaaataactaaaatttgatattaaaaataattaatagctaacacatatataaaatacaatatgaatactacacattagtagtttcgtaaagttaattcaaaatttaaaattatgttgtcattttaatatatttgaataatacattgagaaaacatatatgttattatatgagagaaaatataatgatgttagccgcgtaatctgcgcgggccgtcatgctagttcaaataacttgcacgaaagagatgagttgaatatacttacctaaatgatactaagtggtggtaccgtaataattctattaaccttcttgttcaaatacaaaatttcagagatgctttggcatccataaaaaaatcaccatatcattccagatgtactgtaatcattttcgggttttccataaaaattcagagatgatatcaaacagaggcactgtaataactctattaaccttcggatgtcggcaatgttataccaattgccaagaatttcagtcaattggttgaggagcatgcctgcctgctctttcaataacatgtcatcttgctcaaacagttgctattctcacccattacacttgcttatccacagtcatagttgccttaccagtatggcaaatagaggaacaaaaattcagcacgca

SEQ ID NO: 6553 - DNA, 1501 bp, Oryza sativa
catttatttttaattttgtaattcaactattacgtctaaacgtacatatatttacttctaacgcacgtactactggcagacgctcgtatcttaaaatccagttaagctagcgtgtatggattcgagttcaacgctcccggacgatgtgctgctcgagatcttcgtgcgctccgacgctgcatccatagtccgctccgccgccacctgcaagtcgctccgccgccgcatccttcaccagcaattccgccaccggcaccgcgccggcaacggcaacgccagcctcctcctcggcgtctcctacaggctccgcaccgatcttaataccttcgtgggcgttacgtcgtcgtcctcgccgctccgcttcaatgccagcctcctggagtcgttcgagcccatggcctcgcgcgacggcctcctcgtcctcaagcagcgcgtcgccaacaatgccggcgacggcggcgagcaccgcagcaacggcttctttttcaaggggaggagctacagtttcaatgtgtgcgtctgcagcatcttcaccggcggcggcgacgtcaccacgttcctccctcccatggatcctgccatgcatgtcaacatggagagccacaagaacatctacccgccggcgttgctcgccgtgggcgccgccggcggcggcggcggccggtcgtcgttcgagctgcttgtcatggactgcaacctgcgaacccagacgttctcgtcggagaaaggaggatggaacgccgtccgcgcggctcacctggcacccggccaccaccagcggcggccgcggatgccggtgcccaactcgctccccgccatcgtcgggcgcgccgtgcactggctcggtgtcgcgagcgactactggcaagacggcgcctactgttgagtttgttatttcagctgtggccccaacgtgttcctggtgattgcagttgcaacggttgaaggaataagtctgtgtttgttagcagatgcaaatgatgcggtgatcgagtcagaagaagaccgcgtcggtagcgttcgtgtgcgtgagtttagcgcgggtgcgtgagtcgtcgaattcagagaaaagcggatcgtgggatggcacgatttgagcctcggattctttcttttgtgtggaatttaagtaggagttttttgtactgttattctagttgcatgttactctgttcagtgaatgaaaaccacagaaaattagccccacaaatttcctatctgctattgttttctgaaacttctcaatttcctgtgttcttgttctgctctgtattcctctgaatctcgttcgttgccgtgctggattgctgcagtacgcacgcaaggtgttcgatcgagggtctagcgctaacaagtggtatcagagcaatcaggtttgagggctaatttgacaccatggcgttggttctggcaacatcggatccggcgagggggagctcggggagcgctttcctgtatccacaactcacagccaccaactacactagttgggtgatccgtg

SEQ ID NO: 6554 - DNA, 1501 bp, Oryza sativa
agtggccggtttaaatcctaaaaatgacacagtgtttttttatataatcatattgatcaatttagaccatatccactttattctttatcaatatggcaatttctagacactcaaagctaacagagtgactctttttagccttctcttgataatcagactctaacaatcatgcgttgcatcaggcaaattaattcccatcctttccttgtctttatagtgacaggtgataagtacctgtagcaaaggccaaaagtttgcctctcaatatgttcaccaaggtatttcactactacatagtagctgttttctttattaaaaaaatcactttctactgcttattggtttctgcacgtttctttctgaaatataacaaagcaaacgtatttgaaatattaacaaagaaatcatagtagttccatgtaccaatcgtctcatcatgatctaagccaaatctaaacaacttcgtgtctaccgctcctgttttctcgtacatggtttgcaatagaacaatattaatattaacaagtagccaaacatctttcctagacagcaaccgggtgaatttgctttatatataaaaaaagggtataatagtagcattcaaatcattgatgcacactagcactaaccacagccagaaatggcctggttagagcccccaaaatattaccagaaatgcttggtgggcttttttgagggaccttaactctctccttgcttcccaaacatggttaaattaaataaaaaaaatgtgctgacagggagagcaaacatggacaaaattaagatacaatcagaaaatgaaaaagaaatgcttcaagaaagggtagacaatattaactcctccaatgaccaaagcaaaacagccagccaaccaacctctgagtagtagtcacaccatgacaccaaaggaaggagtagtcactggccaccaatgatttgcagtagtaacagatataggtcttaggcctccctgagaggctgagagagagagagagagagagagagagagagagagatttggtgttggataggagaagagagtggagacagtgggggtgagaggattggaagcatccagattctgaatctcctgcaagcctacttcctgttatcttctttgggctttcaggtgaggctgagatttcaaagatccatccttttatctgcactgctgctgttctctctgttctttggatttcttggcatcgttcttgcgagattcaactgctttcattcataatttctgctggtcttactaatttgtcagggattcagacctcatttcttgctttaatcctctcccatttctgattctgttcactctatctcatttcatatgctttcatgggaatttcttcggttgttgtactagatatgagagatatccatgtgtgattcacttgaactgttccaagaatttcatgctgatttttagttgttttttttcttctgcctctgaatatctgatgctgtgaatctgggcttcagagtttgtata

SEQ ID NO: 6555 - DNA, 1501 bp, Oryza sativa
ccgccgccgctcgcgggaggaggggcgccgtcgccgccgctcgcggggcgcctccccacccgctagatccgccgccggtggtgggggagggtgctgccgccgccgctcgcgggaggaggggcgccatcgccgtcgccgccgctcgcggggcgcctcccctcccgctagatccgccgccggtggtgggggaggatgccgccgacgccgccgtgggtggtgggggtgccgccgccgccgccatcggtggtgggggaggggcgccgtcgtcgccgccgccgctcgggggcgcggaggagagggtggcgaagtgagatgggagggagggaaatgggctagggttccgcggctgagagggagtgggttttgtttccccactattgacgctcggccgtccgatcaaaaccctagagatcggacggccggtgtcgtccgggccgaaatcggcccaagagggatcgagagtgaggcctcttttccgacccaagcccaggttgcggcctgggggaggaaaagtgcgcccgcgcatgcgcaaaaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataagaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatggagaattttacttgtaaatttatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtttttattagaagtggaaacccctgattaagtcgtatgtgatggtttgctgtgctttgtacggaccacttacaatactactacttccgtactaaaataaactaatctcgtactaagatgtgataacgaatctaatagaacgttgtattaagacgtgtcacattttaatacgaggttgacttattttgaaagtgcgggagttttggagtagtatggaacgacgacttggatacactgtgtgccagactggcatatttattccgatagggaagtgtaaaaacctcttattatcgcaagatacacgtacgtattgctgcatatatacggtccctcgcggcctcatgtcgtggtatttgtctgcaccacacaaccgcgctctaattgcttcgatttgggagtaagctttaccaggagcaggcgatggattcca

SEQ ID NO: 6556 - DNA, 1036 bp, Oryza sativa
tcccctccgtttcaaatccccccaacccagaccgccgcgcacacagatcgaacaaagagcagaagagcaggagtgggtggagcggagagaagagaggagaggaggcgaggtgaggcggagaggcctcttataactaccgtgcaggaggacagagggaagccggtgaggtgaccaagctccgcgtgcgtcccccgcgccgcgccgacctgtgtggctcgtctcgtctcgcgcccggttccggtggtacagtagcagtagtagggtattgggggcgcgtctcgcgggggtactcgcgacgtgacgcgacgcgaacgcgacccggcgggtgtttcgcgcttcgcggagcggaggtgtatggctggtccgtccgatcctggagcgttttggtgggtggggggaggtggggggagccacgagttccggatctgagacggggaggggaggggtcgcgcggcgtcgcggggtgcaggagtggtggtggtgcgtacgagctttgggcacgtgccgagcggggcggccgctttttcctggctggctgggaccgaccggggacgagatcgtagtagacgggacgggccgggggcgcgcgagacgccgcggcggggccaagcggatgggtggattgggcgaattggcggcttgcggccggtttggcgcgcgagggtggatggcggtttggacgtgtgtgcgcgcgcgcgagagagcgggcggcgtgaacggcacggcgcgagggcgcgaccagggttgggaacaactggttttgctggtaccgcgcgcgcgcggtggggtttgttcgtgcacgggcgggctcaggttcttcgagaaaatcatgcagaggattgttgaacttgaaccatgtcgttgcttgccttcaagcaaaagaaacgcgggggtgctcattcacgggagaaccattccacggtcaattaaacagcttccgttttggtacgttttggtactagtattttggtacgttgttatggaggagtagtattttaaagagcaccctgttttgaattggaagggaggtccttga

SEQ ID NO: 6557 - DNA, 594 bp, Oryza sativa
agatctcagggtgagatggaggaaagtgggacccaatgacatgtgtctcactatttttattttctttgtttaactgacatttgggtcccgcatatttgtttaatcttttagttttcaattttttttccagatcaaactgccacgtgagcaccacatcaatgtcacatgagatgaagacctagttaaaagatccatgtaggcgccacatcagccaaaaccggggacaatactaccgagggacgttgtttgcatggttttataagttgagggatgagtggtatccggttttgcagtctagggatgtatttcgaactcggtgacaaattgagggatctagagtgaacttattccaatgaagaaccgcccaagcccagtgcgtcggccatctgaaagaatgaaggcccgtgtacgggacgacgggtccgatgccgcctccccaagcaaagcgaggcgaagacgagaggtcaaaaggccggcgtcccgtccacgggggtccacgtcgcatcgcaggcggtggggcccatggcgtcgtcgtcgccgccgtggctgctgctcccctccttcccctggcctcccccgccccctcccggctcc

SEQ ID NO: 6558 - DNA, 1501 bp, Oryza sativa
atgagtggtatccggttttgcagtctagggatgtatttcgaactcggtgacaaattgagggatctagagtgaacttattccaatgaagaaccgcccaagcccagtgcgtcggccatctgaaagaatgaaggcccgtgtacgggacgacgggtccgatgccgcctccccaagcaaagcgaggcgaagacgagaggtcaaaaggccggcgtcccgtccacgggggtccacgtcgcatcgcaggcggtggggcccatggcgtcgtcgtcgccgccgtggctgctgctcccctccttcccctggcctcccccgccccctcccggctcctcctccggccgcggcggcggaggaggcggcggcggggaccccggcgactggaagccgaacgtcgtcgcggcgttcgccggcgcccaactcggccgcgccctccgccgtcgcctcgccggcctcctccgctcgccggtgctgcttcttacccctgcccgctgtttcactccgattttgggatgtagactcttgggtttccaccgttgcgatatccagcccatccgcagctattaaccgatttcagactcttggtgatatgctagttttattagctgtgatattatcatgatgtgttagtggtttgttaccgtagagcatttccactacttccgtttattaaatggatcgataaattgcgtgcttaatcacacaatttattctgaactgaattgcacgatgtgtaggaggcgcgacatcttggtgccttgccgagaataggtgacatttggtttgaaggatcagactcattcgccacacactcgattcttggagtgttggagaatgcgctctccgcaccatatgcttgcagctctgttttgttcaatggaaatggatcggacaggaggtacatcggtagggggaagttgccatccagaaggccaagtggaatcaattcgaagaagaggctttggactaatattcttcttgctgttaatattctgtaagtcattgctcaattcatgttattggttcctcctttgttgatagtaagcttccttctacatttgtggattaacattgttctactttcaccgaagggcttatgtcgctcagataactacacaaggacgattacttatatggggggctaaggttggtctgttggttttaattttcatttcattttattctgataacttttagtctaactcaattacaaaccatgattttagatcaacagtatgattgatagaggagaactctggcgtctggctacatcatctcttcttcatgcaaatcttgctcatcttgctgtatgtatttgtgtcagtttgtgtttataatctaagaaataacattgctaattttccttctgatcataataatgatgcagttcaactgtttttctttaaattcaattggacctatggtggaaatgcttactggtcctagaagatatcttgccgtgtatttcacttcggctctggcaggtattttgttattacctatgtttgag

SEQ ID NO: 6559 - DNA, 1229 bp, Oryza sativa
attagtgtttttaatgcaaagtgtacgtgatgtccaacaaggtcatttggctatctgatcgacattgacgccattcagcacattcacggagaaaaacagtttgcaggggctgcagtggaacgcgaagttctagacgtgtcgccatgcttataaaatcgtttcagatgttaatgtctgatgtcagtctcctcagtgaatttgctgtggcctgtaaccgacgtactagtacgtttggaaaagctggatgacaggaggtggagttgtcattcgtacgacccatcgtttcgtttattcacgaacgagaaataattttcatataaaaattttaatgttatatacatgtttttaatgatctataaaaacaaagtctgaataataaattttgtggaaaaaaaaactaaaaatcaactctaaatttagagttgaaaattcatatttatcgagttgataaatgtctcataaattttaatcgccccatctaatataatataacaatttaaaacctgattgtgacttatcctagtactctgtgtttgaaggtgggtgttgggaacccatctcctatgcacgaaaaacggagcggtccattagcgtataattaattgagtattagctttttttttcaaaaatggatcaatatgatttttttaaacaacttttgtatagaaactttttgtaaaaaatctaccgtttagcagtttgaaaagcgtgcgcacgaaaaaaaagagagagaagtgttgagaacttgctcttgcaaacacacccattaatgtggatagacttgctattcagattcataattttaggatatatcccatctagggatggcaatttaacccatttgcccgtttacccatgggtaaaaactctaatagagttgggtttgttctctatttagtaccccatgagtttttattgggtcaaaacctatacccaacgggcatacgggctcgggcatgggtagtcactacatatgcccgcttcgcctgtttacccgcaaaaatcaactgacaatgtggtccctcaatcaaattagtataaatgccaccatcaagtattgatgtacttgtaacgcttgtattgttgaacttagtacaactgtacactttctttaaactatgataatgtctctttgcttgtggagatttatggttgaaatgttgaactatgagtttgtgacgggtaaacgggcatacccacgggtacatggcgcccacgagcaacgggca

SEQ ID NO: 6560 - DNA, 442 bp, Oryza sativa
accatgggcacatggtgattgggagggttcacacgactgatgtgtgggaaaaatacataggggtgtaccgattggtcatagagcaggagctatgctaggtaccattttcggatagaatgatgtccaatgaatggtccttattaatagtactcccaaaaaaaaaaacctttcatcaagcatttcatagaaaatgagaaatgatgaaagcaccatgcatccttctagccccattttatcatgtaattgtttggacacattatgataaggacatcactccttcgaatacacacaacaacaacaatcctccatcagtcattcaaggaccaataacaagagttcgtgcgtgacaattgaatttagagctgagctcgttcctatattctcctttatatgattttgagaatagattgctacctaatgattatattgtgattaggaacaa

SEQ ID NO: 6561 - DNA, 993 bp, Oryza sativa
attacactcatcctaaaactacgaatctggacataaactatgaatctggacataacctatgtccagattcgtagtgtaatatattcggacggagggagtatttgctctaaacttcggaagaaacgttgtcttttaaaaaccttcaaaaaatacgttgtttaaccacttatttttgttaaatcaaagtgtttttattattattctgtgatgaacaattggcatcggagattattggttttgatatttggaatttatttttgaagtggttttggagatgattggatttcacaggtgaatctacaggtactgttggatgtggtccggtcagaccaggcatgtgctgccggtcagaccggcgtgtatcgcgcggtcagaccggcgcagcccgcggtctgatcggctgactctgtgtcgatttcggtttcgggttgtttgtttggatatccgtgattgtttcatgattatggcttctagatggatactatgagtatgtaatactgttgtttgctactaatgagtcaagttggagatagcttggtctcggaatatggtttctttgtttatttcatgtgtaggtgactagatgcctcgagagagtatttgctgtgatggaccgggagtcggcttggggataagacgacgttcgtggtgctcagagatcatgcgggatacttaggctagagttgatacacgtggttcgtgaagattccatatggcatacgatggaggtattgtgtgcgtatgggatgcggagtcgaatttggaaggagtttaaatttgatatgattggttatataaagtttgtttcttgtactagagggtttcctaaggtgtttaggacttctagtatgagtttggttcgtggctttaggctgcctacctcgggtatataaatagagggggagcgtgaggcttccctgtatcgcttttgagagcaattgagttgagagttgagttagggtttcgagtttagtcgaaatttttgtaaggaat

SEQ ID NO: 6562 - DNA, 197 bp, Oryza sativa
cgctggttgtaactgatcttgtttccttggtcgtaaatggaaaattgttatgccttggtttgggacgaaaaatcttgttatagttttaatagctgctcttcgtctataattgaagtgatatgatatttatatatcttgttttctttctttgaattttatctgtcaaaattgattgactgcttcttttattactcagg

SEQ ID NO: 6563 - DNA, 271 bp, Oryza sativa
acatagcgtttttatttttgaaagtattactaaatgggaatttctcccttggccaacttagaaaaggggtggggcgccttttggtcttttcttacagtcgtatggctctgataccagctctgtggacccccgtttttataacaggaatcaattgtgtaaacagtaccatttccctggatcaagtagtctggtacacacgaattcatagctgaaataccaagtgcacatacacgagtgtctaatacgaattattacatcataaccccgcagg

SEQ ID NO: 6564 - DNA, 1501 bp, Oryza sativa
attttggcttgaatgtctataaaatattttggcttgagtgtatctattttgtaatttatcttaactatttatgcccatgagaggggttcactagctaatactactttggtatatgaccaacaactaaatagaattttatatcaacttttattactactatgcaatacattatacctatctttggaggagaaaagaaaacattgatcctataattttgaaaaaggttaaatgtatatgttataccttatatctagagggttatttgtgtatatatagtaatcttaataaaagaactcaaaggctaaattgcacttgttgatattgtcaacaagatattcgagcatgagggtttatatctttaagttctattcatcgagaaataaatcaataaaatcgtgtacatattattggcttgcatgcgatatattccatgtggcttaaggtcaaaattgatcaatttttttggtacgatgtacaatatcttgtatgatgtgtgatatattttgcgtggctcaaggtcaaatttgatcgatcctcaagattttttgttatgatgcacaatatctcgtatgacacgttttttccccaataaaaatataaacttgtaagtattatgttggcatccttggaatagtttcatagtatgacaaaaattcgggcaactttgctagtctagtctacttatgaagtgtgaactaacctatcattattctcttttgccacttatgttcctttttctcataaaagaattgcccccatattttctaaattactagtagttttttttgggacattgcacccatctttagtattactacctccgtctaaaaatataagaaattaagataagatgagacacattgtattactacgaatctaatcagggaaaccgtctagattcatagtagtaaaatatgtcccatcatttttgaaaaagagggagcagaagaaaaggggcatagtgtccatcgtgtaccctccattggacgcatgtccagattcatacttagaattattattattattttttaaaaaagagagtatataccaaacaaaacaagaaaaaaaaagctatttctaagagataacaatgtcatcacctctcatgtcttggggcccatccatccatcaattcagaagtcacaagccaaataataatatccaaggaaaaaagagaggagggaccaatctacaatttcaagaacctcacagggctgtatccgaaaaactcccccgatcgaataacaaccaccaccacaccctgagcccgcggcctcactgccatcgataggtcgtcgtcgtcgtcgtcgatcacctcgtcgtcgacgcaccaccaaagccagaggcaaaccaaaactcctctcctcctcctggtcttcgccgcctgcgcgcgtcgctgtcgcgtccattgccggggcggagggagggggggttcttgaggatggtggaggtgggaggaggagcggcggagacggcggcggggaggaggtggcggctggcg

SEQ ID NO: 6565 - DNA, 271 bp, Oryza sativa
atcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccttaaccatccacaccacgctaaggtttcacccccacccctcaaaaggcagtgggcggtcccctcttgcgccgcggtgaatccggcagc

SEQ ID NO: 6566 - DNA, 1501 bp, Oryza sativa
cttttgcaaatgagccatatattatgccattctttggtatccttgtgcacttgcatatttgctgcgtggcttgctgagtatgtcgtatactcaccttgcaatcattcatcagaggaagagttcttcagtgatgctgatggtgtggaggattaggtgtagccctggtcaagctgcctgcggagtggagtcgtctgcgccgtttatcttatttttttccgctgcttagatctttattgattgagaggaactatctacctctgtaatgacattttattcgcttattaattagagtaataattgtactctattatcaatttgttattgtgtgtctcggctgattcctggacgagggttcacacacatgtaagcgtttggaattttggataaaaattccgagcgtgacaagatatcccacagtatactcgtagccactacctctaccacaatggcctcccgaatgaacaattaataacttagttagctaaggttatctcataactagcacatgtggttgcacggtaaacaatagttaatggcatagagttcggttcttaattgacccaagcaaacactctctctatagatatgtcactagcaccatatgtaactaacactctctctaaaattcacattttctctcattttagctcacaaatacactgaaaatcacctctgtccataatgtttaaaatggttcaaatagcatatataagtgatccataaccatggtaagtttattttaagctgggtaagcattaggtatttataaaagcataaatatactcatttgagcacaaggaaagtgctctgaatattcctatgattacaaatagcagggtatcaaagatttgagggtgtttatgcagcaaataggatatagctactattttcccaatttaaaagtaatagatagttagaattacacgtgcaagtttcataaaacaacacgtttccaaaaacatgggtttcaatatgttcaaaggaagaggggcacatgccttaattaagatccttacttggatcagtaatatattcaatttccgaattaaatttaaaaatatactgttgatttgctttttttcttaaaaatattcgggatgtaaaagttttgacagaaatataccgtcggtctcgcgtaaccgttgcgcgagaataacgtgggcgtgacgacgtggacgggtctcgcacaataacgttgcgagactacgcggtatcatgggacaaaagcggacggtctcgcacaaggaatgagcgagagcgccggcgctcagttagggactaattacttaattaggaattaattaataataattaataattaattatctgattcgtgattaattagtaattaattaatctttactcattcatcatttatcatatcacacatccaacgctccaaatcctacttatgacttaagatccgacggctccctcccatccctctctcgccgaaaacagcgcatcccctcccctccccgctcctatcctctctcgcaga

SEQ ID NO: 6567 - DNA, 1501 bp, Oryza sativa
caatcacaactaggaccgcacatgatcccagtcctttccaatatcctctcagctcttacactcagctcccactactctctccctccatctaaaacttaccagcctgtggctgtcccaggagtatttaatagtttaccctccaaattttggtgttcttgcgattaatacatcaaacaggctcatgtgtatacgtcattggatcactgctgctatgtcaactgtcaagcaccagaaagtcagaaagtactttgaccatttatggtcgacgtgcgtatagctaataattctggtttctgtcttgcccacaatatgtgtcaaactgtcaatcagtcatttctatgaacaatatagcaaaacactactctcccaacattgttcttttaactaaaagaaaataaagcaagcctctaattaccctacctctaaagaaccaacagttaattatacgatcacatcagttagatcccaattcagagtcgatgtattttgaggagagatggagccaaaagtaccttgcctacgaggaagagcgggatgacgaaggcaggcactgtggacaccaacccaacaactaggtactccagctccgtgaacctctgcacatagcaacaaaaaatatatattatttttatcacccgacctaatatccattttgaaatcgccgagatccgatctcccctcaaagaaccggatgcggaagatccaacaaggcgtccccaaactcgcccaagattcagacgtatcgagcgagaagagaaggaaagaacggatggatggatgggtggctacctcgtagagcttgaaggggacgacgacgccgaggcagagcgtgagccagaagggcgtgtagagcaggaagaacgtctccccccaccgcttgctcccgtcagccgccatccaccggctcgtcctccccgcccctcctccattcctcgccttcgccgccgccggccgccgcggggctgcagacaaaaaaaaaaaagaagaaatgaaaagaaagctccggtgagggagggtaaacgcgccggctgaggtgccgccattggtggcggctcacctgccattcgccgttccggcggtgagtaatcggagtgaaggcgcgtgcgtggggtggtgagtggtgttgtgtggtgggtgggtgccagcgagtgctcgtggtggtatcgtcacctctccaaccagaacgatcttgaccgccacatcttgaaaaacttccatggccgagggggtgcttgatatacaggtataaagtttcgggcgtgtcacatcggatattatatatggtgttcgggtactaataaaaaaactaattacagaatccatccataaaccgcgagataaatttattaagcctaattaattcgtcattagcaaatgcttaacgtagcaccacattgtcaaatcatggagcaattaggcttaaaagattcatctcgtaaattagtcacaatttgtgcaattagttattttatagcctatatttaatactttatgcatgtgt

SEQ ID NO: 6568 - DNA, 837 bp, Oryza sativa
agggctagggtaccacatcgaacacctatgccgtaatgtacagtgacttttcctatttatcccgattttagcccattttctatttaaatatagccctatagattctaatttttgcataaatgaagtttactccatatttgtgttattctaactaaaaattcaccctaaattaatactactcgtattttatttatataatttatttgaatttttaattagggttaattcttattccatcgtactaaaatttaattattgctaatatggtcgtgataatattttatttatttctaacctcacctaatctttattttaatttatattttaattatttatttagccaacttgatttttagggtttattcctaattatttattctttatttgcgatcaacaaactccgaattcaaaatccaatgaaataggcgaataaagttggcatgatgcaatttattgaaaaagtttttgaaaatccttatttttagggttttgtttttattggccgaattttcagggtgttacagtagcctagctatgtgtttaagattggttgcatctatttgcatgtgtcctatgccatgcacggattagaccagacaaataattacctagattatatatggatacaatggattctaattagatatgtcatgttgggctcttggttataccacatcttagaaactctagtatgtgatacatagatgctagattatcatatctgatatccatgtactgggtcaaatacctaggtaccaagtatgaaacctataaatacaagatctgatgccgagctatcggctctgatacctataagtactggatccgataactagg

SEQ ID NO: 6569 - DNA, 1501 bp, Oryza sativa
tcggcggttgtcttgtgtgcgaacgatcttccggcggaaatatcgagatcttcagcagacgccttgtctaacccataccgaaaatattgtaacaacacatggtcgtgtaaagacaagtctgtgccatactgagttaacaatgaaaacctggtccaggttgcaccgagagattccttctcgttctgtcagaaagaaaggatgtctaatcgaagattaatcacacggattaatggaaagaaagtaaggcagaacttacacttaagcccctcccattcaccgtggaatttcttgactgaaagaatgtaccattgcttcgcttcatctctaaaagaaaaaggaaacaactttcactttaaagtttgtaggcatgaacgcactagctcaaagtcccgaagacagaggtatgggttttcactaataccaccatagaaggtttgctctcaaaccatggctataaaggcatgactgatttcgtagccatccgaaaggattggttttgaagaacagtacggctcacaaagatcaacccgaggagctgaaaggttttgaattgtgggttgctccatcaaggaaatgaatgaaagaagatgaaataaaaataaagatacaagaataacctagattcggataaattagcaaccgtccacagcaatggcgccataaatgcttgttggtatttcttacgaccatacataaatctgcaagcgcacggaataccgcggtaacactttaccttcgagtgaccagaaaaggatatcgaacttagggaacatgtgtatgctacctaaggagactatccaaggacaacaattattggtaggctacctaggctagagaggattttctatgcgttttaattatctaaactaagtaaaggtaatttttgttttgggcaccgacccctgttggtctgccaacgtgtttaaacacatgcataaagtattaaatataggctataaaataactaattgcacaaattgtgactaatttacgagatgaatcttttaagcctaattgctccatgatttgacaatgtggtgctacgttaagcatttgctaatgacgaattaattaggcttaataaatttatctcgcggtttatggatggattctgtaattagtttttttattagtacccgaacaccatatataatatccgatgtgacacgcccgaaactttatacctgtatatcaagcaccccctcggccatggaagtttttcaagatgtggcggtcaagatcgttctggttggagaggtgacgataccaccacgagcactcgctggcacccacccaccacacaacaccactcaccaccccacgcacgcgccttcactccgattactcaccgccggaacggcgaatggcaggtgagccgccaccaatggcggcacctcagccggcgcgtttaccctccctcaccggagctttcttttcatttcttcttttttttttttgtctgcagccccgcggcggccggcggcggcgaaggcgaggaatg

SEQ ID NO: 6570 - DNA, 1501 bp, Oryza sativa
ttcttcaagttgtgccaagagctcaatcttgcgagtttcgggccgatcaatattggacttaatcggaccctcagatagctgatcaagtttggccttctcttcatgaaaaagctgccgattggcttagattgtggcttcaatatccttgcgctcccgacgttcggctagtcttagcttggccttctccagcttgaattgatgttattcaagatagactgttggagttagaatatcggctagctcatctgggattagagcttggatctcatgtagccgagtcctaattggcccacagtttaccaccaagttgttcagtgacgatgcttccagccgatgagatatgtcttcaagtgttttctttacgtcatcggacaagggaacctattaacgaccaaatttggtaatatcagtatcggagatgaagattagattgaagcgggatcgaagatgaagattgtcgcggaaacagagtaagaatcggctgaagtccggatcggctacgattggatcggccgagttggagttagacttggttaggtgatgcagccgattccaataatacgacttggtgtacgacatcgggttggattgaggtgcttcaagatgattgccacgcatggatagagtcctgggaaggcaattgtatctattaattaggacattttatgtaatatccttagagatatgcttgagcaaaagtctgccgtaaagacttgtggtatcttagagtttgttagagaaaatagtcgtgtccggtatggacatatcttgtaattctcgggtataaatagaccccaagccctatgtaattaaaaaacaacacacacgttcaatacaattttggcgcatcgccacctttttgctttagttttatttcgacgagttctcgctatcgggttgagctgcatcggtttcgatcttcaacaagaggtaaaacttgttatgatggcttgtgttctcgggattagtgcttccatctttatgatactctaatcttgtttacgtaattcgtcgagttatcatatatcgtacataatctctggcaatatcactatctaacctacaatcggctaacatctgttagtagagggcagctgattaggttagattttgatgttgatttagattatataagatatccaccactatatgaaacttccaacggcttgattgtctagatattgttcttcttttcatacttaatgctgcatcagttgagtttgatatattaagtcgtgcttagaatatcaatctctagcatgccttctgattaccgattagggtagtatcggagtttcagccgatcttatctgatttaaccatattcgctctatatgctttagtgacagggtaatatctacagccgatcgagtagtttagttctttattatctatttatagtcaccgatcgattcacatatgacatcggctcaaagataaatgatatatcatcggcacttagccgatcgactatcatttatagatttaaccgcgatctctt

SEQ ID NO: 6571 - DNA, 1501 bp, Oryza sativa
cttccccgcgcgcgccgttgagctccgtgttgacggtccttacatcataaatatctgaccgttaatgcttgcatataatgaaataaaatatggtatctaacttagtggtagggattattactaatcatttccactagtgttggtgaaatatgtgtatgcaggtattttaaggataaaatacacccgtcatgcgaggaaacacactttcggccaatcaggcgcaagtacacggattgaagggcccacaagtcaggtgacaccgccatggaatgggtcataatcgccatcagggcccaccggtcagcctcctggccaaaggagagggcaggaggtggggcccagggttcatccgaaccaccaccggcgcctctgatcttggccttccacgtgtgcgttcttgatgacttctcaatgatggttggagggcagtttggacatttcccatagccataaccatcatatggagcctaaaaggaggtctccatccacacttcaacacacacaactttgagctgaattacaagaggctctattgtatcttttgtacattagaaaataagtagagagtgaggggaaactgtggagtagtgcccagaaggttggcctctatccgacttctacctcgatgagtgtagttttctaggaggaattctagaggagtaccagatctgtcggtacactctactctgggttcggagaaacttgttctgtaatataagcattcggaatccttttttttacataaaacagcaggggaggcttctactgcgcatattaaataatataatatagaatatttataggttacaaggatttacaaaaggcaaattaattaaaaatgtctagccatgattgccagctaggtttgtccatctcttttgctctgtccatatgcatgttaaactccctcagaaaatgagtcttccatttatcaaaactgagagcaacattgttaaaaatgaggtcattccttcgtaccagatgtgccagcagctgattaccaaaacttcaaagaagaaagtgtgctgaaaagagatctgagctaaagtgatcatgttcataaattccaaggccaaattccagtaataccaatgtgttgccagcattgttgagcaaatggacgggagaaaaacaaatgtgccatgctttctgtggtcatggagttgcacatcaaacagtttgtgccaccttgtatgttgaattgctttttatgtaacatttcctttgtgttgagtcgattcattagcatgagccaaagaaaaactttaagcttcattgtgcatttgcttttccagagtattgatagaggcctggcaacttgaagatgttcaaaaaacaatgagtaaactttcttgggttggtattgatctgagttccataaatactagttaggtgcccatgcgttgcaatgggaaatatttatataaattcatatatactctatcacttgtctctctctcgccccctctctctcgggccgacggcgcaggtcgagcggcgg

SEQ ID NO: 6572 - DNA, 1110 bp, Oryza sativa
  unsure (1)..(1110): unsure at all n locations
aaacataattacatatttgccaccaaaaacgattggaacccagcatacctaccatcaaactcacagcatagactaacaccgttagagtttggttttcatgaaagtgaggacaaggatgcccctccccaggaaattgcaattctaccactggagcatacaacctagtaaaatcatgcagcataagaaaataaagaacagtggaacatatcaacatacctcacaggaagatcgatcgtgacctcacaggaagatcgatcgggacctagtcctcatcattttgtataatctattcatcaaatggaatctttagtagaatataaacaacctgttgaaatgaaaattggacggtgcgacggttcgtgtaaaccccgacacggacaggccatcacaaatgcggaaatgccagcgatcagatgatccgatccccctccccactcctccacgtgggttctttttttttgttgtacacctcaagttttcacatctaaagtttatacacctaaagtttagagacccaaagtttataagtcaaaagtttatatatccgattcaaatttgaatttgaattcaaatattttttatatatagtatttatatacatctaaagtttatacacctaaagtttatagacccaaagtttataattcaaaagtttatataccagattcaaatttgaatttaaattatatcaattcaaatttatagacccaaatattttttgtcaaaagtttacatacccgattcaaatttgaatttgaattcaaatattagtttatagacccgtttacatacccgtttgaaatttaaatttaaattcaaatatttttatatatagtattttctatgcataaaatttttcaactttgtttttttatttttttttaaaatttatggtgtactgggaagagaaaaaagtgaggaggaangaaagagtagagtatagaggggagagggggagcgatcacccgcccattagcaccccctcacaaatgagcagttctctgtgtcctagtgaccgtgcacagctcatggtttgcatcgatcaaaatgagctgtggtatattatctctcgtagctagctaactagctatagctacatatatctacagt

SEQ ID NO: 6573 - DNA, 921 bp, Oryza sativa
tggtgttctaagtcatccttgtagtttttttcttttaattggtggaatcacggtggctgcctgtggggaatctgagatcggtggacagaaggcgaagcgccatgcgtgcagagcgtggtggtatggagattttcccttattttcaagcatggcatggtgctcctgaaaatagctgctcttgccttgacacgcttccggtggtaatggttttctggggctcctgaaagacaaccaccaggatatgtcacctgagatatctttagcggtaaacacaaagcaaacaacaacaaatttgtttgaaactagagagatgttcatcatgccgaaagtaaaaaaatgttatgtgacgcagaccattgtgttgttttttttctcccttcgtttggtggggctatgatacggtaaatacggaaacgatcggtataacagcaaaaccatttccattttcatttccatattttttaccatttttatttttgtttcggtcgattaccatttccatatagctcggccggtagaaagtcgaaaacgaacgccggtcggccggtaattatcgttaccgttttcacccctagggctatcactatgtctattggaatccactatctctactacttaaaaaaataagaggtgcttccatcgtccgtcaaaaaaaccgggcgaaaaaaccaaatttgtccgatcaaaaaaactaggtgaaaaaacgtgcggaagaaaagaaaagaaaaaccaaatctgcccaatccagaaaaaagaggcgaaaaaaccggcaaaaaaacccaaaattgtccgatctaaaaaaaccggtgaaagaaaacgtccagaaaaaataggcgaaaaaaaaccaaaattgtctggtccataaaaaccgggcgaaaaaaacgtgcgaataaaagaaaagaaaaaccaaatctgcaaata

SEQ ID NO: 6574 - DNA, 1501 bp, Oryza sativa
tctctcgagttcaaatggcaagattggcccccgcaaatctggccgggacaattaatggcggccgacctcccgcgccggttttcttcctcccaggcggttctttcccctttcaaaccttatttaaaccctcccggcactcttcggtcgggttcggcttttagcggcctttcttcttcgcggaattgaagttggccaggtggttctttttccgcagtcgccgccgagttccggtcggccgccgcggtcgcccgggaccgcttcccacttaggcgccgcctccttcggcttcgccgcatcctcgccgacttcgtccacctctccgtttcggtcgccgaccgccggagcgccgtcgtccccgtcgacccgagccgcgccaccgcctccctccgcttcggccgcctcctccgtcgccgccgtcgccccggggtgagccgtggaccgtcgcctcctttcccccttccctcccctctctcggccgctgctccgccgcgccggtggtcgccggcggcgaccatcggggcgcgggcgcgccgtctcccgccgaccgtgccggcatggccgccctcgggcgcgccgagtggctgccgcgtggggcccggccgtcagccgcccgtgccctcgggtgcggctgacgcgtgggacccacggcgccggccggtgtgagcccgggtgcacccggtccaccgtggaccgtgaggctgccgcgtgggccccactcccgtggacccggtccgcgcgcccctccccctcgactgacgcaataaacccgttttaaattaaaatttaaatgaagaaattcgcaaatatttatttaaagagcatataaacttcaaatggccataacttggccatttgaactcggaattggaccgttcaagtctctaattttttcttaagaagtcaagaacccatttttgtgctttgttcctgctttttatatggagtttattagagtaaaagccttttcttttccgttggtcgtgtagacgctgcagctttggaagatccgctcttcgtggaggttgaagccgacgtttgggaaagcgagcaaggcaagtcacatcatccttgaacatattgaatcccagtttataaaattattttgatttaaattattgcattatcgctttacttaaattcccgcgttatcactgttttatctagccatgcctatttacctttgttatgaccttatgattgttactgttaatattaccttgttcaccctagattaaacaaaaccccaactagtggacactctactcatggtaccactagtatgaatttaggtagatgcttcgctggttaattaggtaacattaggtggttttacaactctagaatttgggaatattcatatcacctggacactatggaatggatggattattgtggaattggattcacacctccccctctattcaaaatcctcaaaatggttttaggctgggctcggggtgtatggttttgatagtagcatctcggccatataaggaccggt

SEQ ID NO: 6575 - DNA, 857 bp, Oryza sativa
aaatatacaatattacctatgagcacttaaaataatgattaaccaatcttttatcatgtttttagatggatttataataaattttcatacatattttataatatgggatatatgagcagatacatgtcttcctgtatcctaacctatattttttaacgaatttagattcgaactcggataatcgggtatctaattttttctctcatattcctctcgcgagcctcgggaagtacccatcccatttttactcctacatacatccaataagcccacgtatttttcctcctttcttagctagcaacgtatttactaggatgacaatggaccggatcgggcacgggcagagcgaatccatgctcggccccagacccacgcacccgtgtctaacccatgtccgcaaagtctattaggcaaaacctcgtgcccatgcccatgcccgttgggtactaattaactagtactactggagaaatgatctttgctaggtcacattatggagattatgggtaccccatacccacacggcatggttatccaactagttataggggataacttatatctatggaatatgtatggatcatgacttgggtattacgtttccttgtatataacagaacggcctaaagtcctgatttgataatattgtaaagtagatttaagaaaccgatacctattggttaaggtttttatcttataatcctgccctctattgtgggcaggaggccctctagggcaaaggattcacaactagatcgtcagatcaatactacatccggcggattcaaatccccaaacagttttgacagttagcgtgctaggtaggagtgcgtcgagtttcctatccagaagtgcga

SEQ ID NO: 6576 - DNA, 1501 bp, Oryza sativa
ttcttctcccgcgcggatcccgcccgcccctacacccgatgatgaggaggaggatgaggacaaggatggtgacaacaacggcagcggcttcagcaatgatggcgatgacgaggacgacaacaatcactactagaaaaaacgtttttctaggcggccaaaaatagtttttccaggcaggggaaagaaccgcctgtacgcaaaggcttgcgaaaatatatgactttcgcaggcggccaagcggtccgcctacgaaaatcattttggccggcggtagatacacccgcctgcaaaaatatttttagcgaaatccgcgccaccaccccaaccccccggcggcaccgccggcctccccctccggccgatggtggcctcccttcccaccctggatccaggcggcggtggcatcgtcgtcgtcgttgttgttgttgcggccggccgcggagggagagtaaagctgagggagaggagagggaggggagccacacctcctgttcggcagcgccgccgccgacaccccctccggctgcgctgccgcctcccctccctgaatccaggcggcggcggatccagacagcgtcgtcgtcgcagtcggcttcgtcgtcatcgtggccggcggcggaggagagtagagttgagggagaggagagggaggggagccacacctcccatccggccgcgccaacgccgacgctaccgccaccgccccctcttcctgcgccactgccgacgcccctcccctccgccagatctgggaggggaggggaggtagccagagggaaatgagagagagagagaggagagtgagggcaatgagtggtggagaggataagatgctggaggagaagataaggataggacttaaatttttttttcagtaggcatgttttttgcaggtggacctcttaattaagtggtccacctagaaaaaaaatgattttttaggcgaacgacgagcttcaccccggtttatattttcataggcagccatttgactccaaaagtcatcccgcctgtggaaaaaaacctcacgtctgtgaaaatgttttttctaagttgtgagtggtgaaaatgttttttctagtagtaagtggcttttagggctagggtttgtgatttgttttttcataattttatttttgcgtgcggacgtcatcagaacccgcacgcgaaaatccgatttttatgtgcgggtgcacccgcatgcaaaaatagcaatttttgctgaccatttggtgcttgcggatagccctaccgcaagcaaaatccccttttgggccgtatgcaaaaaaacgttttttacaagtgagtcagttctcagctgtactgtaacgctttaatatttcgaagaaacttcttaggtccttagtacgtccagtaactggtccaccagggcgttgaacagattagatcacggagaaaaacatcacatattatacatggaaggtagctggcgtttgaaaattttgttcggtgatgacttcgtgctatatgagttcttcac

SEQ ID NO: 6577 - DNA, 1501 bp, Oryza sativa
aacgcccattgcaggggcaatctcgtcatttggaaaaaaaatgtcacctttttgatccaaaaattataaaatattgcctccggtgtcctatagccaattacacaatttttaaagtgcccatcaaccgtgtcacatttttgcagtgtctcccaaccaattacatattttttgagtgtcctgtagcaaattttgctatgaaaaaaaaacctaaccaactagactaattgcgctaccatatttagtcccggttgataacaccaacctgggactaaaaagggttacaaatacggtaaaaaagaaagggttataaatcgggagtaaagagtctttccctagtagtgtgggtattatagtaaatatctcaatccatagataattttaacagaactacagaagcacaacttgcacaacaagccagttgcgaggatggaatgggcaggcttgcctgcctgcgccacctccgacgcccgtgcatcgccgcttgcgcccatgcgctgtcgcgtcgctagcggtcgccgctgttgacgtaaaatttcattgtgacatacaaagtcctgggagatttgtttactctagtgcaggtcctaaaataatgggcacggacatgccagttaatttgatcctataactaacaagatagatgaactgttgatcgaagagccaataagataataagccaatgtcaatagggttttaaacaatcgactatatatccgatgtagattctgacaatggaagaacttggaacaaacaatccaatcgactgataataatatgagaaagtagatgtccaatgaaccagtcgaccgatatcaatatagaatatgaaatgtaggctcgttggttaaaacatacatcggctaaaagtccaatgtaaatataacttattggttaacactccgattaaacatagaacaaatatataaacttagcaagacttagattatcagtagtaatacagaatatcggacccaaccaagatagttctaggttacttctgatcagataagctagataagccgatagatatatgctaacgtgatggatatggcaaatctatttaaaataatattgtgattgtagagatatatttactaagacagaagattggacctaaccgagacaatcccaactaaaccgacgcgtctctaaacacaatgcaactaaagatagaattggaatattgggtaggcaaacatatcaaccgaactagagcaatccaagagattgaagcgatgcagccttaaacaacgccaatatagccgatacaattgccatggcgcgaggaacttagggatttctccttcgcggagatcgaaaagatgcagccccgtatcaggtgtcaagtcctaccggtgataaaacctcagaaaagagggtggtgatgtgctgaaaattatattgatctagagatagatacagtgacctcggttgtacttatttatatccatgggtagatagtagcacaattaccccagttgtatatatttatattcacagg

SEQ ID NO: 6578 - DNA, 1501 bp, Oryza sativa
aaaaaaagcatcttataattaaagaaaaagaggacttctataaatagtatgaaccaaggataaaattaccacattaattttaaagaatatctaaaatggtaatagttgcgtagttaattatatagatttaaataggatattacgtacgcaagagagaatatatattgacaaattaatacgtatcggagtactgaaacgatgattagaactaggaaaaaagtccaaatacaaatttagatgaaagcccgtctaggaccctaaactttaaaaccggatatttaaccccctaaactttacaataccgtctatataaccccttaggatggttttgaatattttggaagcttaaacgaacaattttgaataactaatataatatatttgcatacatcagttataattcatcaatttattcttatacaacaatatcatactttatcatgttggtacttatttgtaagtgagagctaataaggagcaaaaagaagattaagtcaaaactttaataactaataaggacccggcgcaacggcgcgagttgggaaggccgaaggcgggtaggcccaagccggggcgcggggcggagcgccgctgtgccgtcggccatcgtgggatgctgccgcgcaggagcggcggttcggcggagcggcggagcgctgatggcgctgctgccgtcggccttcgcgtgcgtgcggcgtgggaggtgggactggcatagtgggagaccagaagttaggggttttttttttgttgcctgttgggtcaggctttttggatggtccaagaaaactgaatacctactcttttctgagctaaattctagggtagtcctgggtctacttggactaccctttagacccgccactggtttggtggcctgtttgtgttttcttattacgttgtctaaacctttgctcgacgtccgcgcgcgtatgtgagtccgattgccgagcgtcactgggaaagggaggtggaggatgtcgcgggctcaaatggtataatcgtataaatattcttaaacaaaaacagtttgatatgatttgtcatctttgatagttcttatctgaccctgaagagcccagtagaaaaaaaaaatctgtgacgatttacagaaccgccgaatataaggtgtgaaggacgactctgtgtactcacccgatgaacctgacgccgcgcttctgacaataagcataacgatctccatcgtcacaaatataagaaacaggcggtatctaaaagccatgatcaaataggggcagaaatgaatatctccgccttcaccgctagcttaatctttcttcgttgttctacatcctgctagtttccgttcaatataaagggtgtgaagaactcatatagcacgaagtcatcaccgaacaaaattttcaaacgccagctaccttccatgtataatatgtgatgtttttctccgtgatctaatctgttcaacgccctggtggaccagttactggacgtactaaggacctaagaagtttcttcg

SEQ ID NO: 6579 - DNA, 1501 bp, Oryza sativa
  unsure (1)..(1501): unsure at all n locations
gattttggagtagtcacgtgtgttcagcgattttagttcgttcatgaatatatgttcaattattatcgattattatgtattggttaatgtataagaagtttataatttattttatgaactcttagtttgatagtctaaaaaaattttatcgatatcagttatagtgttaataataataagtacacgatacagttggtttcgctgcataaaatttaaatgtatggaactagaaaagcgactggcttaccaagcaaacaccggagtggctagacggaacgggggaacggctggttgcgaagcgagaccgtctcacgataggcaaggtcgagctggagtccacctcccgtcccctccctacggcgtacggcaatcaccgccaccacccgcatcatgcggcgccagcattgaactccgcctctcctctcctctctctctctctctctctctctctctcctctcccctcgcgtctcgcggccttctccgccgccgcttcctcgtagcagcagcttgcagtagcctctctctctctctctctctctctgctctcccctcgcgtctctcggccttttccgccgcctgttcctcgtagcagcagcttgcagtagcctctccaccaccaccacctcctccgccgccgtgccagcgccctgcgcccctccggtaagcttttgctcctcctccttcttccctccctccctccctccctccaccgtggggatagctccngnttagccccccccccccccccccccgatctacttcgtctgctcgccgcttctcgctcagatcttaatcagtcggggtaggtttcgcggattttggttaggtgggaagctaggctccagcatctcaggatttgggaatgatccccatcgtccctgcgcgattcactagtggaattggtggccctggtggcccgtagtgtgaatatccatgaactgattcggattcagggcaccgggttctcgtcatgtactagttactgttctctgctccgcgagagttctttgttttggctgtttcttcccaacaagcgcacaaaccggttatgttttcggtagttgttgaagctgagcaggaaattgcagctccactttcagctcacttgtaaccgaattgttgaatgctaacgttaccactcgatctatactttatgtggccattacttgttttggtggagtaacttatcttatcgctgttgcctaattacaagctgcacagctgtcatttcacttgtgactgataatttttctattgaaactagcgatttatctacattttgtcgcgttattggacttgatatttctttccttggtctttgggccacacaatttttgtccagtttattgtacttgctatctttgcattttgagggatgctactgatttatggttggtgaccgtcagggagttgatactgcaatgcgacattgaagatttgatccctttctgctgccttgttggtctcgttttgcatgctggtgtttggtggaatccatgg

SEQ ID NO: 6580 - DNA, 1083 bp, Oryza sativa
tggtaaatgcaatcaaaatgtaagatagccacatatgcagttaccgaataagcattaaaatgtaatgagtaaactgcgctcacggtacatcaacttggggcggtgggtgcaaataggtaaattgctcgtttcggtacaataatttgagtagtccgtgcgaacccaggcaaaaacaatccacacaagcaaaattgattaaacgtggtgcaccctgatgacacctttgcaagctagcagttgttttgttttgaaaaataaaatgcttgttttgaaaaatcaaatcggtattccagtagtgcaagcagcctacaagaggttgcaacatagtaattattattgctgactgctatattctgcaaatacgaaattgagctagtgtgtgcaggcctgcacaactacaagcaactgctagcatgcataggtgccgtcctggtactacacatcagatcaattttgcatgtgtggattgttttggactaggttaacacaggccgggcaagttattgtaccggaatgagcattgttgtggtatctatttgcacccacctcacaagttcatgcaccatgagtgtaatttactcaaatgtaatgttcacacttcaaaatgaaggtgtccacctaccttactctgtgatagaaatgaataatgcgctaaacagaacctcgctatttcttgacatattttacggtttctagagaaatttcaaagagttttggaccgaacagaggcttcacttaacattctgccaattccccacttccacaatgaaataaacaagaccatttgaatgctattattgtcctccggtatcatactatgcatacagaacactaataatttagaaccctataaaactaatattattacatgaggcgtaatttaataccaagtagaaaaaaaataacagctccaacttttggaaaacaaagatcaaagagtagcagttgagactgtatgagatgaaccaatgaaataataagagccatacttcatgaagaagataaatgtgttaccaggcgtttatgttattcattactatgttatacataataaaagaaaactagtgaagttttcatataagc

SEQ ID NO: 6581 - DNA, 1501 bp, Oryza sativa
  unsure (1)..(1501): unsure at all n locations
gggggggggggggctaancnggagctatccccacggtggagggagggagggagggagggaagaaggaggaggagcaaaagcttaccggaggggcgcagggcgctggcacggcggcggaggaggtggtggtggtggagaggctactgcaagctgctgctacgaggaacaggcggcggaaaaggccgagagacgcgaggggagagcagagagagagagagagagagagaggctactgcaagctgctgctacgaggaagcggcggcggagaaggccgcgagacgcgaggggagaggagagagagagagagagagagagagagaggagaggagaggcggagttcaatgctggcgccgcatgatgcgggtggtggcggtgattgccgtacgccgtagggaggggacgggaggtggactccagctcgaccttgcctatcgtgagacggtctcgcttcgcaaccagccgttcccccgttccgtctagccactccggtgtttgcttggtaagccagtcgcttttctagttccatacatttaaattttatgcagcgaaaccaactgtatcgtgtacttattattattaacactataactgatatcgataaaatttttttagactatcaaactaagagttcataaaataaattataaacttcttatacattaaccaatacataataatcgataataattgaacatatattcatgaacgaactaaaatcgctgaacacacgtgactactccaaaatccacaggctattgtctctttttccatcgcttctctcccttatctttctctatctatctaaactgcatcatgttctcaaaagaagagaagacgaaggtgtgtcttggatctggattagtgtggcttaactacacatttacgaggaagcgttggtaaaggtgggtaggcgaaaaacaccatgacacaaagaggcggaattcaatgctaacttatgacgtggaatgacgcattaatcgtcatacaatataaggagaggggaggtgaacccagctcaaccaaatcatcaggagccctaatacgatcatgcaaccaaacaaccaaaatattccatattgctcgattcacaccattggtatgcttgtcacgagctcatctctagatatgtcactgtaccatcttccatcttccagtatacgtctttattacgacaacctccaaccatttcaaatacatgccactacatctggttaatcgctaaaaaatcatattagaactagatagtgatagatttgtgagccatatcatttaatttacgagacaacgttttcagttatcactactactttttctaagtattataactaccgtgaataaagttttattttacatatcttctatggtgcataaaattttttcaataataaaaaaaatatttgtgtggcaaccaattgtcgacgtttgatatcgcgactatggtattttgcatagtatggagatcattggtacaagggtatatgcgagattgaggtaaaacaga

SEQ ID NO: 6582 - DNA, 1501 bp, Oryza sativa
taactttggaccattttgttttaaaagtggctccaacagatataatacattgtgacaaaaatcttatattgggatcatggttgttaagtcgtaaagttgagatcgagatacccctagactgacctgtcaaattggttgactagtcaattacttggtcatgcaaaaacagggatgcaatatatagtctttaccactgttatactatgctaagcaatacatgtagtattactgtagagtagaatgcaagatgataagttgataagaaataaaactgaagtactaaacacaataagccaattggtgaattggtgattttctacgactaatctatgactaaccatgactaatcgcatgacttgttatttggtcgagtcgtggttctctagtcgacttgcttgatcgactttactattaatcgcaactagctgggtgacttgataacaatggttgggatgtatggagatttctctatttgacccaatcaaaccaagttcagcttataatggaagatactatggtatgtgtgatggagccaacgacacaccattgagcccagttaactaatatcatttcccataattgattacttttttcatacatcaataataaacaatagagaaccggtagcaaaaaaaatgtaaggatgtaatccgagcggccatccgacctagcaggaggtggctccgccactagtattagaaaaacagaagagtttatttttattttttgtgcacattgaattcaattttattccatatccctgcatagttaagggtgtgtttggatggatattatggcggcttgtattttgtgggtgatggtgggtgggagtgggatagggcggcccagagagaaatattccccttagataccgtatggagggatccggacgatttgcccagacgcagccaactgagcgccctaacggatggagggatctttctgtttttctccctttcccccttttatgtgcgtgtgatttttttatttctctttagaattttgtttgtttgtaatagattggtacttttgtcggccttgtgaatttgaagggggtatactcaccacctgtattcaattgcaaccattcatctatcatactctctctaaccaaaacaaatggatcaccgaaccgaccttcattcttacaagtaaaaaaaaaatcttagatagccatcttcactcaactaaaaaaataaggccgccatattccttttcagttaaatgcatgttacatttgtcggtaatatgtgagccgaagtcacgtaacttcgactgcagatgatcctgattcgaaccagacgtgccctaaactcctgaataatcattattataagaaaagaaaaaaaagaattcctagaaaccggggccatttctagcggagaggaggcagggtccccggggtccacccatacgccacaggggaatctgcccacacccacaccaccgtccccttcctccttcaccccgcccccgccgcttcctcctcccctccaccgcc

SEQ ID NO: 6583 - DNA, 1501 bp, Oryza sativa
cacattggatatacggacacacatttgaagtattaaacatagatagactaataattccgtctgtaaactgcgagatgaatttattaagcataattaatccaccattagcaaatatttactgtagcgccacattatcagatcatggagcaattaggattaaaagattcgtctcgcaatttacatgtaatttgtgtaattagtttttctttcttttttttttgtctataattaatattctatgcatgtatccaaacattcgatgtgatatggtaaaaaaatttgtgggatctaaacatgccctttgtctctattatctgttcatcaggctatccggttgcccatggtagcgttggcttgtgtaggcggcagctagcttagcttgggttggcttcacccaaaaagagaacaagaacaaaattgttcagaagaaagcagctctaccacttcgactcgttcagtcctcttcagatcaacccccttttcttctgaaaagcttcttcaagtcagagcatttacaacgctctagagtggctgagagggcagggaacctctcctgcccacatcaatgggcgaagctgccatggacgatattgaaatgtcatgaaattgccctatcacagaacgagcaaactctccatctaaacttaattgatcttagatatccataccaaatcacataaagctggagtatttgatgacagaatctagataacatctatttctctagaacactgtttacgattcagactcagacgatgatgccgttgacgccagaaaccgccgctgcaagaagcgcagtagagacgagtccaagctcaacctctcccgccccgtagggtaaatgccgccacgcttgcccgcaccttcccctactccaccgccacctccaccgcttttgcaccgtataccattcgcccaagtctgctcctcctgacgggatcctctcctcctcgtcggcgtcggcgtcggtgtccccctcgtccccaccggatcccactgtggcgcgatggctgtcatcctggtagctcgacggccgccgccctcctcctcccaccaccatgctcgcttccggccctgtgtcacgccgcgccgttcctcgtcgtcgacgcctctcccgcaaccacgacggcgtgccaccgcggcgtcaaggcagacgggcagctgggccttcccattctcccgtcgccgccgccctccccttatcccgcgtctccgccgccggatgcagcacctcctctcctgcctcgccccgcctcctccccacctgccgccgccctgcccgaatgagatgaagagtgtgagagagaggtggaggtgagaaaacagtggaaagaaagaggtgatgacgtggacagtctgacaggtgggccccacatggatttcatgctgactcagccgccacgtcggacaaaacggggtcaaaaccaccaaaggacctaaaatgaacagttctgtaagttgatggatgccctatatctggttttgtggatggagaacgatt

SEQ ID NO: 6584 - DNA, 1501 bp, Oryza sativa
cgggagactgaagccgccgttgccggccgccttcgtcgacgagccgccgggccggcgcggcgcctgcagccgtcttcaccgggagccgccgttgacgcgccgctagcctgcagcagccgtcgtcgccgcgcctgcagcaaccgtcgtcgctgcgccaccgggagccgctgtcgccgccaccatctaccgaccatggctgtgaatatgctgtttaaccggggacgggttcaccacggagaaaaattcaccgcgtggtgatcggggctggagaaattatagctccgtcgtggttgacgggggcggggacggtgaaatattttcaccgcggtgacggggacgcaggcatgatctctgacggtgaattcaccattgccatctctagttgcaatccttgggctcgcctcctttggaaaggataggttttagaggatttttgtaaaaacgaacaaaatcttatgttccaaaggaaccaagatccacgtttgttgtgttcatttgtgttatctattgatccatataacaggtacctactactgttagtattagaacatatggtatcgtgttataattactattacgagttaccaagaagttccggcctcgactcctctaaaaagggtgaactttaattagatgattttttttaaaaaaaaaactcaacaaaaccttgtgttccaaaggagctgagatccactattgatagacaaatttgtcttacctatcgatagatatatcaagtttctactagtattagtattagatcatatggtaccgtgttatatttacttgtcgacggaagaaaaaacccttctatttttattagtagaaaaatggtttactcaaccacttgaatcactgaattagttgtcaattactgaaaacggtaatcaaccacatgaaatatcaagacggcatggttgggtaaatccccgtatgatactgtaacgatttatatgaacaacaccatggaaataatattgtatataagactcttctcttgtattttcttctgtccatgggatctcatcgagcaaagatagacccaggggttccgggtgtgcaccggcatatcaaaaagtttcgcaaaaagattaggatgtggccgtatgcattgataaattggttattttgttggctatttaattgatttcctatacctcaacaaagtaaaacccgtaaaacccacttatccactcttgcacaatcacataattaacccaccaacaaagcgacatgaagtcatgcacaaagcgtcaaggccagcgaggcagaggtcgttgccatgtccacatgacgcttgacccttgagacaaagttgtgattctctctaactgaagtcagttaacaactactactaagttaattgcattttacttctctctcaatctcgtatcctctttatatggatagttgaaaaatcaaaattaattcttcaatgattttgtcgtcatcaccaatgcggatcatatggttggcaaagctgcctccaaacctatcgcat

SEQ ID NO: 6585 - DNA, 1501 bp, Oryza sativa
taaatagtgtcaaaacgaaatacccgaaatttcagttgtatcggtacccaacagaaatagcctaactgaaatagtatcaaaccctgtattcaaccggtgacgacgaattaaagctagaagaaagaaaacggacggatacctccggccaacaaggcccagccatggtgatgaaggtgatgagcatgtcggcgacggccatcttgccggccctggcggcgaggtgcagcggcgtgtccccctggtcgttcctggcgacgaggaggtcgccgtgctcggcggcggcggcctcggcgaacgcgacgcgcccgagcccggcggcgatgtgcagcgccgtgttcccctgcggcgtcgtcgagttgaggatcttgccgccgccctgctcctcccccagcagcgccgccaggctcgccgtgttcccctgcaccgccgccttgtgcagccgtggatccatatatgcttcttatttcctctaccttctacctaccttagctacctagctagagctagcctctgtacagtacagtgatcactcctctctctgaatgtctgaatgtctcgtgtattcttctgtcagtgtgtgtatgatgagatcgatcatggaggtgatggtgatgcagcaatggcgatgctgatcgagtagttgtaacttgtatgtactccatgtactatgtaggagtagtgtggatggattctttgcttgtttgtggtgggcttgtgcagttgtgccctaccctgccatggaagctaggttcatggtgctttacttgctaaaccgaatgtgctaaatgctccattagaaaatatatatgcagtctgatgtgctctgtctccagctcctgccacagcatgctttactggccgtcatgcatgtagcacaaggaatcaaagctttaagatggatgtggatatatattacaatgtttgattactctaatttcctcctgaaattataaagccatgcgataggtttggaggcagctttgccaaccatatgatccgcattggtgatgacgacaaaatcattgaagaattaattttgatttttcaactatccatataaagaggatacgagattgagagagaagtaaaatgcaattaacttagtagtagttgttaactgacttcagttagagagaatcacaactttgtctcaagggtcaagcgtcatgtggacatggcaacgacctctgcctcgctggccttgacgctttgtgcatgacttcatgtcgctttgttggtgggttaattatgtgattgtgcaagagtggataagtgggttttacgggttttactttgttgaggtataggaaatcaattaaatagccaacaaaataaccaatttatcaatgcatacggccacatcctaatctttttgcgaaactttttgatatgccggtgcacacccggaacccctgggtctatctttgctcgatgagatcccatggacagaagaaaatacaagagaagagtcttatatacaatattatttccatggtgttgt

SEQ ID NO: 6586 - DNA, 1501 bp, Oryza sativa
tttggaacacaaggttttgttgagttttttttttaaaaaaaatcatctaattaaagttcaccctttttagaggagtcgaggccggaacttcttggtaactcgtaatagtaattataacacgataccatatgttctaatactaacagtagtaggtacctgttatatggatcaatagataacacaaatgaacacaacaaacgtggatcttggttcctttggaacataagattttgttcgtttttacaaaaatcctctaaaacctatcctttccaaaggaggcgagcccaaggattgcaactagagatggcaatggtgaattcaccgtcagagatcatgcctgcgtccccgtcaccgcggtgaaaatatttcaccgtccccgcccccgtcaaccacgacggagctataatttctccagccccgatcaccacgcggtgaatttttctccgtggtgaacccgtccccggttaaacagcatattcacagccatggtcggtagatggtggcggcgacagcggctcccggtggcgcagcgacgacggttgctgcaggcgcggcgacgacggctgctgcaggctagcggcgcgtcaacggcggctcccggtgaagacggctgcaggcgccgcgccggcccggcggctcgtcgacgaaggcggccggcaacggcggcttcagtctcccggcgaacggcggtgcggcgaacggtggctcccgggctgccggcggactggcgaatggcggcggcgcggcatgcgtgactcgggtggagggctggaggctgctgtggatctagatgggtggaggatttggctttgacctgttgacttagggttagattatatatatatgcctactaaatgggcttcaatattatgggccaatacatctaaaaagtctagaattcctcccttgtacattacagtcgggtcaccgtgggggccggggacggggaatggttcaccgtccccgcccccgtcatccccgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattg

SEQ ID NO: 6587 - DNA, 1501 bp, Oryza sativa
ctatgtctgcctgtcagccctgagggtaatctggtccttttgaattgtttctctctccattcagcccaaaaataataaaataatggtgaaagtgtccaacagctaattacacattttttagagtgtctcttagccgtttcacgatcttacgatatccctcggctaattacatgtttttttggatgtctgtaacaaattttgcctagaagtaactatattgctgtaaggaagtaactcttcacattattggaagtaactatgcttttagagttaaaaaataaataacttaaatatatttgatattagacttattttatcacatattttaagtagagtatgatggttcaagtggatctttaaaataatatagagtctaaaaaatataggtcatcatagattctataagaaaaaagaaaatatagtagtgtaacgacatcttagcctcagcaacatgcacttgacgtgaatcacatgataactaacagataatatgttatccttttttcctggtaagtggtctcatttctctgtctcttggtcagtacaacatacacgttttcgtatctcagctatcatcaactaatcggtcagttgttaacgccaaaatttggtaagcccgaagttattatcggcctaaagtcagtatcggctttagagtcctggaatcggccaatgagaattatcaagtcgccaatagccggattcttgttatattcgattaagaaaattaatctattaaagaaagtttatccagaagtgaccgagttcaaggaggatgcggcatggcagtttatctattaattaggcagtatttgttagtttccttttatctttaggaaaatgtatttagtgtccaataaggactttatgttttccttttatctttagaaaagtttctttcttgttcgacaaggactagtatctccctatgggtataaatatgtacacctggggtcactgtaaaatatctctcgatcaatacaactactctcggagcatcgccaccctcttttctgtggttttacttatcaaccggcgtaatttggcacctgacatggggctgcatcggttcagttctgttgatggttcgatctccagcgaagggataaatcctacgttccgccggccctggtgaatctatcggctacgttagtgttgttcaaggctacatcgcttcgatctcttggatcgctctggtttggttgatatatttgcctacctgatatctcaattctatctataattgcattgtgtttagagaagcatcggtttagttggaactgtctcggttagatccgatcttctgtcttagccgatatatctctacaatcacaatgttgttgtaaatagatttgttatatccatcacattagacagatctattggctcatcgagtattagattatcatatacaatctcatgctgcatcggttaagttcgacctactagatttttgttgataatataaatcttgttaagccgataggttcatgctaatgtt

SEQ ID NO: 6588 - DNA, 1501 bp, Oryza sativa
aagccgatgcaacgtccagataacttatcggctagcaccccgataaaacattagcatgaacctatcggcttaacaagatttatattatcaacaaaaatctagtaggtcgaacttaaccgatgcagcatgagattgtatatgataatctaatactcgatgagccaatagatctgtctaatgtgatggatataacaaatctatttacaacaacattgtgattgtagagatatatcggctaagacagaagatcggatctaaccgagacagttccaactaaaccgatgcttctctaaacacaatgcaattatagatagaattgagatatcaggtaggcaaatatatcaaccaaaccagagcgatccaagagatcgaagcgatgtagccttgaacaacactaacgtagccgatagattcaccagggccggcggaacgtaggatttatcccttcgctggagatcgaaccatcaacagaactgaaccgatgcagccccatgtcaggtgccaaattacgccggttgataagtaaaaccacagaaaagagggtggcgatgctccgagagtagttgtattgatcgagagatattttacagtgaccccaggtgtacatatttatacccatagggagatactagtccttgtcgaacaagaaagaaacttttctaaagataaaaggaaaacataaagtccttattggacactaaatacattttcctaaagataaaaggaaactaacaaatactgcctaattaatagataaactgccatgccgcatcctccttgaactcggtcacttctggataaactttctttaatagattaattttcttaatcgaatataacaagaatccggctattggcgacttgataattctcattggccgattccaggactctaaagccgatactgactttaggccgataataacttcgggcttaccaaattttggcgttaacaactgaccgattagttgatgatagctgagatacgaaaacgtgtatgttgtactgaccaagagacagagaaatgagaccacttaccaggaaaaaaggataacatattatctgttagttatcatgtgattcacgtcaagtgcatgttgctgaggctaagatgtcgttacactactatattttcttttttcttatagaatctatgatgacctatattttttagactctatattattttaaagatccacttgaaccatcatactctacttaaaatatgtgataaaataagtctaatatcaaatatatttaagttatttattttttaactctaaaagcatagttacttccaataatgtgaagagttacttccttacagcaatatagttacttctaggcaaaatttgttacagacatccaaaaaaacatgtaattagccgagggatatcgtaagatcgtgaaacggctaagagacactctaaaaaatgtgtaattagctgttggacactttcaccattattttattatttttgggctgaatggagagagaaac

SEQ ID NO: 6589 - DNA, 1501 bp, Oryza sativa
gatgaattggatgctcttgagttcccaagttctttccaataccatcagcactttgtgaatgtacattagaagcaatcacttgacgaggaggtgagtggctaaagcagtctacttttccattgttgattgaaactggtgtagaactcactctggttccagagtcctgcttcaagatacatcaatagaattaggaaatgcatttgcattatatacagacctaaaagcaccaagggctccatgcatatgaggaatgctgccgtgaatgccagaggaaaataaactagagtaatttttttatataaatactagaatggaaaactgacccctgtaggatttctaaccaagcaacccgactacagcagtatatttgtcatggagagcgtaaaagagaggattttgagtggcaccatttgatcaggtgaaatacaacatgtcatgaatgtggcaatttatacaaattaagaataccatcgccagctggtctatactgaaggaattccttatattattaaaaactaaagagcttatatccagcagcctggaattagagaaatactagggaaaaatcacagattcttacattttttttcaatgtttcatctgttggtgtttgaggtcctttgtgatgttttacatgcagaagaggtctatcaccatcatctctttcactttgcggacctcttttatggctaccttggcaacctgcagttgtttcggtttcattagatacacacaccatatattcatgtcacgtctctgtgagagccataaaccattgagtaaaaattggcaatcttagaaactatgccaatatcagaaagttcctatacatacgggtggatacttctttggcatttgataacaaggagggcaaggcaacaagggatgctgctgctttcttttcaggcgatggatttattcttcccttctgagaaacaaagatggtacagattattaatttatcctctgaagagaaatgtaatgatacactcttccgaccaaattagatgcagataccaaacttaaaacagacaatatagcttacctcaagaaacaaggcaagcgagcttgctagctgagagtgactcttgtttgcaggaagattatactgtttgcacaaagattggagctcatggtaattaaggccaaggagatgcttttggctttcctccaaccccatcagattgactgtggaagcacatcaaagacaacaacaacattagtccctcgtcagccatagacaagaaggaagtgaacacgccatatatatgtatatatcataaacgaagcgaggcaggcctatcgaaacatgacaatcagaggaagctgagctcaccgcataactcaaactaaaataaagggaaagcactagtcactactactactcgctagtacacatgcgaacgaaaatggcatccgccatttgtccaccggtatctgctcatcgcgtccgctagcgcacaaacaagcctgggcccatatgccaccccctcgtcgaaca

SEQ ID NO: 6590 - DNA, 1501 bp, Oryza sativa
atttccaggatgtgcatttttccgatgcaaataactcgtctttgatagttagcttgatagattatcatccacacatccaaaacttaaattcccagacgttactttattttagagagttatttttggtgtttactcattgtatgttattttctggattgacttttaaatcactactgatattaagttttctggtaacttttctggattgacttttaaatcattactgatattaaatttttagaaaaaaatatttatttataagtgtttaggtggtatggatggaaggaacgagaccctaaccaaatgcaatactgtacagtttgttgttgggagatcctcgtgagttctaggatccacttttccgtcgtatttttcttcttcctgacgcgaattataacaacacgagagtacagtcgcccatattcatcccatcgctaccgtccgagagctttctcgctcggctgacggcgaccgccggcgccggtgtcgccacgcgccggcgcctccgcccgcttgctcgcacgcgggccggtcaagaggcccacgccgcgtaggcctagctagctagctgtatcccgccgccagcgcgcgcgcgagagagagaatagctaatacctcgctccccaatactattttgatcaacgatatctataaaactaagatgttttaaataaaaaagagctatatattatgatatattatttaataataaatctggtagcattaattttatattattgatctttttattttcttatgctattaatagtcaaagttacaaatatttgacttgacactatactaaaaatatatattttttttggacggaggggtagtaattaagaacatactccctccatcatataaaaaacgaatctagaaccgaatgtgacgtattctttagtatgtctagattcgtagtatatgtcaaatctaacagtgaagcaagcaaaaaaaaatgtgtataaacatgacctgtgttacaactagagaaacaaaaattaaatgaaaatcatgcagcacctgtgcagtgaaaaaaattgttatttttttcttcataaatagattgaatttagacttatatacaacacacacacatactcgccatagatatacaaaatactttccgggttggaaaacactcccctagaccacggaagcttcaaccccacccccacctcgcgcgagacgtcagcgacgacgtccgccgcgcgccgctaccgctacgtcctagcgctagcgcggcagctcgtgtcgcggtggaaaacgcccacttcgccaccgctcgcgcgcgcacgcccacgccgctcctcccctcccctcccccgcctccgtataaagccgcgcccgcgccgcgcacgccggccggccaccgaggacgagctagagcgcgcgcgccgccgcgaaacattagctatagctagctagatatagccggccggcgatcgaggagatcgatcgatcgaacgccgccgcgcgcgcgcggtcatgacgccggcga

SEQ ID NO: 6591 - DNA, 415 bp, Oryza sativa
ctttccccatttaatttctccacctatttcctcttctcaaccaatcataaccttcccctatttcattccaactaattccttaacacctgtgtccaaccttgaaagttcttatattttgggacagaggtagtagttaatagttacttcctctgtcccataaaacaattcattttggctattcatttgcatagccaaaatccctcgtatcataggtcggaaagagtatgttcatgaaagatgaaattcatctgttttagtggtttagctgaatatctaaagtttagtatattagttggaataaacaggccttgtatattgttcattatgtttttcatttgttccttggttgacaacaaatataaaaaaattcatggatgcttggtgcgatatataaatgatctgaatctttgttact

SEQ ID NO: 6592 - DNA, 207 bp, Oryza sativa
ttccgctccgcccgcagttctagtcgtagtcgttgtcccggggtgagccgaggaccgccgttcgccttcccccttcccctcctctctgtcgggtgccgctcccccgcgccggtggtcgccggcggtgaccatcggggcgcgggcgcgtccccctcccttcggccgcgccggcgaggccgccttcgggcgcgccccgcggctgccagg

SEQ ID NO: 6593 - DNA, 534 bp, Oryza sativa
cccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccacctcctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcagg

SEQ ID NO: 6594 - DNA, 1501 bp, Oryza sativa
gcctacttgccttgaaaaaaaaacccacgtctagaaaaaatggtttttctagtagtgatcacatgcgggcagaaccatctccagagaagcgattttgtagtattgtttgtcagcttaaccattattgcattttggtttttcggtccgttacaacacatcgacacactttgctagtaattacaatattgaaaaaaatattttcaaatattgataacaatgttacaaatgcagcatgcatgcgatatccatgcgcatcacgcacttattacatatatatcatgggaattatccaaaatataaataaaaaaaatttagtggaaggtatatatagctaagattgaagggatgatcgatcgatcaatcatggctttatggcattgaggaggcggatggctgtggtcgtgagcaggtctatgacccaaacggtgggaaccttcttgtcaccgtacttgaacagatcacctaacttgcacttgctcgcggtctcatcgtattgggtctccaaattcttggtccacttgtgcacagtttccaggtcctccttactgcgtttaccttctccggcggcagtgaggcgctcgagcgcgtatagcgtcgagttggtggtgtccgaaaaggtttcgccaatggcaaagaaagacccgcagttattgatgttttcgtccctgatgcccatgtctcttatcgcgtacgcctcactagtgagggcttggatcttggtgactaagatgatggtggccacctgggtgtaggataatacaagtgagcaatctccgtatccgcataaaaacttgattactgctagtttcatttctcacatggtaattaatgtaatccttgaaagaaaaaagaatatgaacgagaagtggaataagcgggcaaaagaatatcccgcttaccatatagagacacacacacctatatacctacctgagtggccttcacttggttgcccttgaatgactcgccatacgggatgagtacatcgtagcagcgggcaccgatcatctgttccgtgaaggtgctagttccaaaatcgcagacttgttgggtgaaccggtacgcctccgttgagggttccttcccaggcggcaacggcggtggcagctcaaggttgagtttatgaagttccccctctggcgctgcagttgcaccttgtggggataagcagacgacgttgatggctatcaacaccaccaggaagacagcggccatgctcgacctgctcattgtatttatatgcgctctctctgatctctctccctctcagtttgattagaagctacaggatggattagtgcatctatatgatcaatcgatgaggtacaaattaatttatactagctagctaggctagctcgatcgattggtcagtactaattgtcaacctttctaatttcttcaatggctgtgatagcatcacggcatgcttgcattcattttgatacaactagctggtgatccgtgatcctctatgcgtttctaatggcatacatcagct

SEQ ID NO: 6595 - DNA, 391 bp, Oryza sativa
gtccctggtttcgtttgacgtggcaaaaaaaaaaaaactaggacccacgtgtaagtgactgttcgactaaaaataaactatttatagtgggacccacgtctcctccccaatctcgctgtctcttgccgtctcctccttctcccaatgcggcgacccagcggcgggatccatgcggcggcggccaacctggcggcgggacgatgagcagtggccggcggggaaaaggggcagagcgcgccgacttggagacgcttcggcgacatcgtccacctcgacacgagcggtggacgcggcggatactcctcttcctcctcccctctcttggtcactggccagtggtcaccgctcgccggagaggaagacaaacttgtggtggtcgtcggccgattgg

SEQ ID NO: 6596 - DNA, 1501 bp, Oryza sativa
gagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacatgtcgtacccggttttgcggttcagggacgaaaatcagactggacgacaaatagagggacctaagtgaacttattccaacaaagaaaggggagaatctatataaattggcaaaatttgctacaggacatctaaaaaaacgtgtaattagttagaagacaccgcaagaacgcgtttttgctgtaggcaccaaaaaaatagtaattagctaatggatacccgtgtgattattttattatatcgggaagaattgaagagagaaataactgtgtaattatgtttctaccctttgatttttttcttttccttttttttcttcattatctttttctccctctctcattctttctctttttctctctctacacccaaccaccactacgttctctccttccgctccttccgggaggacgaggtcaggcgcctcatccgctccatctccgccgagagcagcggcggcaccgccgccttcaaccttgcccgtcgtcgccgccgcttcgcccgttgtcgcggggctccaaatccacctgtgtagctcaaaaccaaagctggtcctggggttttgggggcctagggcaaaaacttatatggagtcccctatatatacataaactaatatatatatatatatatatatatatatatatatatatatatatatatatatatatatatatatatttatttatttatatagtcttattaagagaaaaaaagatagagaaattcatcagataagatgaattggacttggaggagtgtaggaccttgaaatctgatgaattggaggagtgtagtccaggcagcaggtggcaggggcagcgagcaatgagcagtagcgagcaaagaaggcgatcggtggacgatcgacacaaacgagcatggctactggtgagccgcgatttgccgacttgccgttttcgtttgcgagacgctaagaagtcgccgagagcgcaggagcagcgagcgacgtgagtagcatgcatgatgtgatcgaggcgaagcgacgggagtaagatgaagatcgcttcggcttcgctgaaacaaacttggcgatggactaaaattcattttctgtgttgggctatttagctgtctaacttaatataggcccatgtcccaagaactaaaattatacaatacataatatatatactatatgtgtacgtataaaggcccctagattttgagggactcgagcggccgcacagcctgaccccccctagggtcgccctgctcaaaacgacgcacaggcagagcagctagcaaccaaaagcaaagcaaacaa

SEQ ID NO: 6597 - DNA, 958 bp, Oryza sativa
gagcgcgagggggcgcggcagtggcgcgcgcgacagcggcgacgtgacggcgcgcggcggctcgaggcgcgaggcgcgcgcgggagggaagatgggacgggcgcgcggcggggcaggggcgcggggcaggaggcgacgatgtgacggcgacgacgatggcgcgcggggctcaaggcggcgacggcgacggcgcggcggcgacggcgacggctcgacggcgacggcgatggcgcgcggcgcggggcgcgagctggcgcgcggcagcggcgcgggcgacgacgatggcgacacgagcggcatcgggcaggagaaggaggagggctaggacggctaggaactaaatcgaacacctagggggctaatgaacagtgctagccggctatttaaccctattttagcctatttcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggttaagtttagttgtatagcaatatattttacacggataggttcaatctatttattctataaatagtaaattgagactcggcacaatattaatctaattatttaattaaaacctcacaaaattttataaagcttaatttaattatacgaccattatttcatgtgaattggtttagctttatatagaccattagagtttagtaatatcccattaattactcctagtgaaactatgtcatagatagagttccattataaatggtcatcatttcatgtgtatttagacgtcatgacacgcaacaca

SEQ ID NO: 6598 - DNA, 1501 bp, Oryza sativa
ccaccctcgccgccaacgccgccgacgaggcccgcgtcctcatccctcgcgcccggagccgccgccgatgacaaggccgggtggcgcggacttgtcggcgccgcctctccccatccgcagccgcgctcgcccgccgccgccgccgccgccgccgccgcaccgccaccgctctctcccgccgacgccacaccgctctcgcccgccgacgccgcctctccgcagccgtgctcgcccagtcgcccagagaagataagagaggagtgagagagagagaggagaaagggagaggaggggagagggtggtgacgtggccagctgacatgtggggcccacgtgggtcccacgttgactcagccgccacgtagaccaaaaccggggtcaaaaacacccaaggatctcaggtgacctgttttgtatagttaagggaccccgtatatctggttttgcggttcgaggatgtttttggtatcccgatgacaagttgagagaccttcagtgtactttttcccacctacgtaagctgcctagcccatttgcaagttgcgatgggcttggcccacttaagaaaacctaagccccccccattgctaccttctcactccctgtcctcccaagtcccaatccccagccgccacccacacacaagcgcgccgttggccgtcgccgctgcacgccggcgccacgccacctcgtggccttcgccgccgcacgcctccctgacccggattccggagtccagccgctgctcgccgtcgccagctcatcttcgcgggctcgcttttgctctcggcgcagcggcgcggcgcgggcggtggccggtggccggtgccctcgccgactcggctttgagtcgcctcgcctctccacctctgatcctactccggctctccggcgacaccgctcctcaaaaaaaaaaaaaaacgtcgcctcgccgaccacgatgaggaggtttgttcgttttttttttctcattttctgacgcagtgtaggcgtgtagcagtatcgtgcttattttgagatgaaccatggcacttcattgattaagtaagtagcatctgtacagaggacatcccggatacactccaagaattacatctcgaatgacgttgatgaggaaaattgcctgggcagcagcgttttaaatagcaggctaagacatttagcggttagtcttctcggacagatcgtcaccttgtagcagtgctgcacaatcatgttgacatatgccactgtcttctgtcccactttacgcagatgcaaggaggaggacttgttccttgaatcattcctcgcctcccaaatgtcccaaagggtgactgctaacactgtgttttggaggcactaactcctcttcatgaaatctgaaatccactgtctcatacttgttagttcgtccctgcataaactaatcgggaaagttgatctcacttcgtcccacacagcagttgcgaaggggcacaataggagaacgtgtttgatagtcaaagccacatctgaataa

SEQ ID NO: 6599 - DNA, 1501 bp, Oryza sativa
ttcctaaaaaaacagaccataaactgagaagcaaaacccagcagtacataccatcattttagctcttttgaaaatatagagctattcgctagtaatgttgacgattttacatgaaaattcatgtgagaattaggatatactgtaggaaatatgtgtctataacaacttgctatatatatatatatactacataaaaataataaccattattttattattattatcattatcaaattaatttcagtgaggaagtcgaaatccccagccatcttccgcacccctgcccatcccactgacgttgggggccacgctggggtgaagggcgccagcgtggcacgcgcgggccactgccacgtcatagccatgcagcgccatgaagagcctctccttctcgagctcctcctcctctctccccgtcctcctccccctccgcttccttccgccgccgccggcgatcaccgaggccagcggcggtgccccgctcgccttcctcctcccgccggcggtggcggcggcgccgcccctccgttgccctcctcccctgaccggcaccggcacagcgtccaggcccatgagcttggccaccacaccgggcttgcaccacaccacgctctcgccggccaccgtcggcggcatcccgcggcacggcggcggcgatctccggtggccggaggaggaggaggcgagggcggcgtcgtggtagtagtagtggtggtggtcgctgaaggaggcgcggtacatggcgtcgcggccgccgtcgagggagaagcgcgggtactggctgagcgcgtccctcgccgaccggagcacgcgcccgtccgagctgttcacgcacgacgcgcgccgcggctgctgctgctgctgggccttcctcgccgccgcctcctcgaggtcaagctgcaggatcatctgctccagcgtcaccgccgccgccgcctcgctctcagcgacgcccacggacgacgccgtcgacgtcggcacggtgaggaaagacgacgacgccgcgtcggcgccgaccagccggcgctgcatcgtggtcgacgtggagtcgacgccgtggcagaagctgcgtatgccgctgcggcgccgcatggtgtagacactaatcgagatagaagaggggatcgatcgacgccatgtcaggtttggttggagaaaagtatataagcttaattaggcgtgtacgcgtgtacgtggatcggaggaggttggcgcgggcgctcgtgatagggtttaaaacgggatggggatcgtgcggcgtcgacgcatgagtcgagtgaatgtgatgtggaggtggaggtggcgcagcaattgggatcacatgagaggaacgtacgtctcatgtgcctacgtatgatatattcggtcgaatgtcatccaccggtcgttagcacccaagctactgaattcaaatctttataaaagcgaattttagattgggttgtttgagagctaagttcatgatttaaaaatactacatatatttagttggatgtagagg

SEQ ID NO: 6600 - DNA, 1501 bp, Oryza sativa
ataaccaaattaatgcgccattgcgtgcgcactatgggaataattttgttacatatatatataaatagatgtggtattctaagataaaccaaaatctttttaaattttctgcagaagatgctagcttgagcttgtcaatcaatatagctagagctataaaaattaaagaaaaaaattatgtcctgccgtacacaaaatatatacttgacaatgagctaggagaatcggttttgttcctgataaaaggtgatcttagctctgtcgatcggccagaattcactttcactagaaaaaaaaaattgttcgaaaagagatgggcatgcacgtacagctgaaattctcttgtgtgatggctaagtaaagtagtaaactatgggaagtgaatcatattcccttctttgataaatagaccccttttgttttcgagaaaagaaagtaggtaggattcctcgcacagcatcacaagttattttcgttaccatatgaaaattcttatctatctatatatcaatccattgtgaaatcaattagctttatgggatatataacactaatttatcattgtggtccaagtaagatgcatggatattaggatttaaccgattaatcatgcattttatatacacaacccatatggtttttatctctctttttctacgcgtcatggtcacacgataacatgtgttgataatcgagaacccttgatgtcatgcatgcatgtatatatttcaatcgactttggtttgtcccaaaaattagagaataaatactagtttatttttcttctttttagagattgtacgatcactagctagctaggtatagctagctgacggatttttccaattaggtatatatccatgcacacacaccgatcttttcattcattcttttctttcttttcacagatatattccaggtagcttatcaagcacataatgttggaaaattaaacaaggaatccttaactaacaaatgaaacacggggagggaggaagagagggggcagagctagagagctagctagctattgctacagcacatcttcgatatcatgacctaacctaactacgaccccacgtatactcgatactaaactactatagacgaacgaacgatcgttcgttcgtttcgcatatatctataaatcctttatgatatcgatatctctatttcttagtatatctaatagcatagtagtaggttagtatatctgctatagctagctagcagtacatgcatgcatgcacacatgtacatactaccatatctctgtcttgtctccctttcacatgtcacctctgacccacaaacaaaccctttccaagctcctaacactagctttaccttcttcttcctcctcctctgtatatatacaccccctcacctccctatcttgcacccatccatccacccatagctatctctagctagcttgcacattcttcattcttcttgcaatcagagctagagaaaaagagtttgagagagatctaagaga

SEQ ID NO: 6601 - DNA, 1501 bp, Oryza sativa
catacatgcaatgccaaatttaacttttacatgttacaacagaaaaataaatttgactatgaatatgtgttagttgtagtttaatttgttttttattgcaatttgtgaaagttaaattttaattcatatatttgtggagtgatatattaaagaaaattataactatttgagtgatatgcaaataatgaggggatatcttctcaagagtttaaaatccagtctcttaaagacatagcataggaacattttgaggaacaacagtgacagaaaaggagagaggaaacgaccatttggggaggtgtggccaacaggtggggtaggacttacgatagcaaaggtgttgcataaatattgaagcaagatctctaagtatttttttaagaatgataaaattgccttaaagcaatctacaccacctaaaaacgatggataggtaattaacaaaattgaaaagaaaaacgatggttcacatctagacaattctgtaattggagcattgcaatgatattgtcaaggggcataacacaaccatagaaatctcattaccacgtctatcgagaaccaaaactagtaaaatgaaaatctgatcgagaaagataactatttgccatggcattggcatggccacatagaaaccatataaagttactgcatccaacgaggtgcaatgtctgatgcccaattctgggtagcgaacactctgcacggtgtcacgtctgacggctccgcttcctgcgtcgtcaccttgcaccacatccacgtcggcatctcgctctcgcggtcgaacaacttcacgtcgacctcgagctccacggagcaggcgcgctgctccgccgccatgcgatcgtgtacctcattgggcagcgtcacgccgtccgcccacgccacgaccggcacgtcgagcgcgtccctggcgccgacgcagaagacgcgcgtccggcccgccgcgacggtgaagccggcgtaacgcaccaccgcctcgccgtggcggtagcatcggcccggcgcgcgccggttgctggcgtgcagggtcatgttgacgatggtggagaggggctgcgccgccgctgccgccgccaccgcgtcgaggccctcggcgctgttgatctggagggagaacttgggagggaggtcgaagaagatgtagtacaaaaacggtgtcgaggccagagcgagcaggacgtacaagaccttgagcatctcacgcctggatgccttcgccgccctcgatttcttggcgacgccatctccttggatgggaggaggctgaggcttcatagctgaccggccggtgacgatatgatattgaattattgatgactcgctctcgtgttcaagacgaccccaagcgccgatcaaaatctgtttttttttttttgtgctgatgatcttccatctcgtttctatttgagatacatatatgtcttcccttctgtcgtatgtctcgtacgaacgtatcgtatcctacccaaaatcctgttctaactggtaagtccggcac

SEQ ID NO: 6602 - DNA, 1501 bp, Oryza sativa
taaaagattgatcctaatcttctgttatccgaacaagggttgagagaaccaattctgcaaagccaacaccgtgcaatgtgccgtgttcggcagctgcgcttcatccatcctcagcccgcacgacatccacgtcggcctgggcgccgtgccgccgtcgtcgcgcccgaacagcttcacctcgacctccagctgcatggcgccgatacgcctctccaccgccatgcggtcgcgaagccgctgaggtagacccacgccgtcggccgacgccaggaacggcacctcccgtgccctcttccccggcacgcagaagcccggcacggtgccggacgcgacggtgaagccctcgtagctcaccaccgccgcggtagcatctcgccgtgccccgccggttgttgacgtgaagtgtgacgtcgatggcaggggagatgatcgtcggagccgccggcgccgcgtcgtcgaggccgcgggtggccgtgatctggacggaaaactcggatgggaagtcgtagaatacgtgatactcccttcgtctcaaaataagtgcagccatgatttttcgcgtccaactttgatcattcgtcttattttaatttacataagtcacgagtaaagtattgttcatgttttatcatcttataacaacaaaaatgttaattataaaaaaatttcaaataagacggacgattaaagttgagcgcggaaactcatggctgcacttattttgggatggaggtagtacgaatacgaaaatgtaattggtgaattcataaagcaggttaacgacaaagatcttgcggcgctgggggttgcacgtcgctgacgccttttggcagccgccggcgtgacgaaagattgctaaggggcgatcgattgcccctagcgatcgcccccctctcctctcctccacgcgattttctttcttggcaccgtattacttttctattttagtaaatttatacacccaaagtttataaatcaaaagtttatatatccgattcaaatttaaatttgaattcaaatattttatatatgtagtattttatacatctaaagtttatacacctaaagtttatagacctaaagtttataagccaaaagtttatatacccgattcaaatttgaatttgaattcaaatatttttttatatatagtatttctatgcatataaagtttatacacctaaagttcatagacccaaagtttataagtcaaaagtttacatacccgattcaaatttgaatttgaattcaaatattagtttatagacccaaagtttataagtcaaaagtttacataccagtttcaaatttaaatttaaattcaaatattttttatatatagtatttcaatacataattttttttaactttgtttttttattttttttaaaatttatggtgtagtaggaagagaagaaggggaggagctaggaagggagaagagagtgtatagggggatggggagcgatgaatcgcccattagccacacacacatatacat

SEQ ID NO: 6603 - DNA, 1501 bp, Oryza sativa
acattcaatttacctccttaagttaaggctttaactagtgatgggcccttctaatgggcgatcgatcgccagcgatcacgctgggcgatcagttcccccccctcccctcccccctctatactcctccctcttctccctccttcctcctccccttcttctcttcctattacagtacaccacacaaatttttttaaaaaaacaaaaagttagaaaaatttatgtatagaaatactatataaaaaaaatttgaattcaaattcaaatttgaatcgggtatataaacttttgttttataaattttgggtctataaactttaggtgtataaacttttagatgtataaaaatactatatatagaaaatatttgaattcaaatttgaatttgaattcaaattgtgtaaacttttgacttataaactttgggtctataaactttaggtgtataaactttagatgtatagaaatattatatatagaaaatatttgaattcaaattcaaatttgaatcagatataattcaaattcaaatttgaaacgggtatgtaaacttttgacttataaactttaggtttataaactttagatgtatagaaatactatatataaaaaaatatttgaattcaaattcaaatttgaatcggatatataaacttttgacttataaacttttggtctctaaactttagatgtgtaaacttgaggtgtataaactttatgtgtataaactttatgtgtataaatttactaaaataaaaaaataatgcggtgccaaaaaaaaaaagaaaccatgtggaggggtggagggagggaggggggagagaatcgatcgctaccctatccccatagcgatcgcccatcagcgttcctgactagtgatcggatcttatttgtacatcttaaacgtataaaacgggatatattgatctcttgactgtgtaaaacaacttcacgtgacagcctaggcatacggcccatatgctggccttgttgacatattgcgactgttagacccccccaacgacgtatggtgctctgcacgggctgggctgcggtgggctgtgatagttccatgcaatgccacgtactcctcgctacctgctgggctacacagcaaaacatcatcggcttccgcccttgcacactcttcggtggggtggtgacgcgcgccagtcggcagatcaccgggccgcgcgcggtaacgtggcaccacatcctgctcctcgccgatcgtccttgtaggctacagcgttcggtgggaggtgacgctgacgcagcgcaatcgccatatcaccgggccgcgcgcggtaacgtcgtaggcgacatcgttctctgtctgtcccgcactcccgccttttgccaaagcggcccgcgacgcgacacagcggagaggtgcaactctgccatcgtcgtcgcttctcaaggtttatcaatatctctctctcggcgcgtatagccgtcgcgcggagggacgagccaaggccacgccgcatccacagatcga

SEQ ID NO: 6604 - DNA, 1501 bp, Oryza sativa
gcatgccggatttaacatcctgtcaaaaagaagtggttaaaaacggtgagaattaggactaagcacatcccttctttctataaagttaaggccaaaagtttaaacctcgtgcttccacgtcatcatcaaattgtgaaccgttggataaatatattagattgcttctcagacattagatataatgcagcatagagcccaacccatcagtcaccaccccggtgagtctcttagcttcttcagtgccaaatgtaacccacatgggcatatctccacacacatctatatgcatccagcctgtcaatccatataaaagagctttatggctgaacattccttcacttgacatgtgctatctaaattatgtacaaatttttgatagggctgctaaaaagaatttcttcaagaaacctatttgtttattttgtttctttttgagattatacctcttatctaacaaattgatgttaacaaagtcctgcagcaacgcgctgggcatcctctagtttgtagaacactggataccgctgcactaacaaggtagaaagccccacatcgtacccatgcatctgaagtcagcgtaggaggaggaggcagcgtggtactcagagaagcaggagggactcaggaattcaggaggacggggagaggtggctgtgggcttctggtgtcgaggtctcaaggaggacacaacgtaccgagcccaagccccgctcgagagcctgtgtcgaggtctcaacggagaaaacaaagaatgaggttggaggagagggggaggggggggagatgggaagtggagaaattatggtttacttcatatacctctatttaaaaaggccaaataggcttcaaggttctacctcatatcttcggagcccaccgggtcatccgcgagctggaatttccactcaaccccaacaagaaaattgtcacccctaataagtatcatagatattatcactgttggagccgtcgggaggagtgtcttagagaagacggtgcttccgacaccagtcttggtgttaaacaacttaagtaaccaatcttattttagaaaacagataaaacttatattatcatcgatgtctcaattagaaggactttaattctcgatccatcctacaaataagcaaagattttaaaactcaattatctggccatctacagaaatacggaggattttgggcttcccaaacaaactgcaactaataaagccaggtccggtcccacgtcccagacacctgaggcgggaaacaaaaacctacccaaaagatttcccccgctccactgacgggtgggcccatcggacgggacccagcgtcataacaaccgggtacacggcagtggcagtttcccctggccccactccacgccacagaacccacatcccaccatgacgcgcaattacctcattatcctctagattttgtggcaactagactctagcgaggatggcatcccttgtaattcttccgaaccttgagtcctctctctaaatctctcc

SEQ ID NO: 6605 - DNA, 1501 bp, Oryza sativa
cgatgcgatgcccagccggtgccggaccacatcgtcagaaagttgcaagcggcgaactcagttcgaccttgtggtttgagtttgtcgatccggatttaaattataaacttaacacggttattaatatttatagctagttaattcttttagtggtagataatactatatatatcgacacatgacatccatatatgtctatggtaactttgaaatatgatagagagatatgtctatgataacttttgttaatcttaaattaaatatataccgatgtaatctttagagatgtttataaaaagagtaaattttataaaactacacgtcttgtagtttaagttgtagaaaaccataaacattttgacacttggcacttaagtatatatattttggtagtgtgatatcacaaaaccgcactatcaatgaatgaattcacccgcgagatgatgtgactgtttcaactaggacgagaacatggcatcttattactagccatcccatgaaattaataggatgccacgtcatcatctagataaaacaaccacgtcatctcatgtgtgaatccattcatcgatagtgtggttttgtgaaactaaactaccaaaatatatgtacttaaatgccaagtgtcaaaatatgtgtggttttctgcaacttgaaccataaaacatgtagttttgtaaaatttactcttataaaaatatgatgtgcgtatatgtgtttatatgagcgaggcgtccgtactgttgaaggaaaggaagttgcaagtgactgtgtataggcagcatagggcacgaaaagggcttagcgccatagagtgtgcacactgtgcagtgctcggaaaaggccgtggtcgatcggttgccgtcgtgctgtctcacctgtgtttctttcaagtggactcgagtgatctacagttgaaaacgcacaggacggtgcagcagcctgcagttcgtcgtgcccacaacttggccgtgcaactggtgaaaaggagcactggcaccgctgcctgtcatccattcgctttagcaaagtcgacatgatagccacaggaagcacactttcatcagagtgtagggaaccagggatatgctgcgtatatgtaattatgcatgatgatcgccactgctcgtcaccggaaagctgaaagggaacaacgaaaaagcccagagttagcatctgtgttgactccgcccatcagaagcgaattgcgaggcagcaaaaaaacgtaagccatcagcctcttgggtcagcaacatcgtgctctctccagcgttttgccgtttcgttctgcgtctccgcctgctttgaaattgtgcagttaattgcacgaggcaactgcttaccttgacgattctacagtcagcaaccagcaacggaaaacgccgggtgcgtgcgtgcgtcgagccgtcgatatccagcatattggcatatcaggagaggaagggggaaaaaaaaagaaaggaacagcctctgctcgtaaatggcatgtcagggcatgact

SEQ ID NO: 6606 - DNA, 273 bp, Oryza sativa
attcctgcagcccattcataaaattttagatgggttttcagtttttttttcaagtgcaagcaagtaaggcctcaaccgtcaagcatgggaaagctagaaaagttaaggaaaacccactcaaaagcccaggaaccccaaaacctggcccatctccccggtccccgacctcgcctctccttcctcctctgctcccactccgcctcgccgccgcctccaccatgtacggcgtcggcggcgggggggcggggttgaagccgcggtggacggggtggc

SEQ ID NO: 6607 - DNA, 1501 bp, Oryza sativa
gtgcgcggacgtgagacgagaaaagcgtgagagaaaacggtctatgtgcatgcctaactgcatctccacttcatatttatagaatgatccttgtaattcttttaaggttcataatagtacctccaaccaattatatgcaattatatactcataggatgattttatcaaataaataattacttgtctgtattttagttgatgagaaaaacaaaataagtcaaatatttaatgtgcttaaatatttatgttactatattcgggaaagacaaatacaatacttcaaataagaacatggaaatataatacaaatatggataaaaccgtgaaaacatataaaagttttgtttcattcaaaacttttacatttatagaaatatatggcactgtaaatcttttactaccttcaacctagaatagaagaaattttatagttgaacatggttattaagaaatttggtagaattaaatggggaagaatgtgattggatggaaagtggaggtaggtaaaaaaagaattgtaaagggttgtgaatggttaggaataggatgttcgtaggttatgatcgtatgctttcttgaaatttattttcagaatagtatgcggagaatttgttatattttggaacaaattataaaagctaaaaattattatatatattttggaacaaatgaagtaataaatacctcctttcaaaagtctaagacatatttcattctttggtttttccaaaagtctaagtcctatttgtagtcattatgtgttaaattaaattgttgaagccattttaatacttattggttgcatatttattggttttgtcacatggtgaataaattaattgcttcttggtcttgatgaaaaagaaatatgactcagatttttggaaggagggagtactacctaaaaatgctattaataggttctatcaaatatttaatttttatagtgcagatataagaagtcatgggtgcgcctattggcgcgtcaattttctgtatgtactcaaagcatgacacttattcttaataagagttcactaaaataaaatttaataagagtttcagcaagataaaataaatttagctccgttcagtgtaggttcgactcctcgcttccgcaggttttgcgagaatttttattatctgatgaatcttgatgtgaagttcatgatttgaaagtttttacgactaaaaaactatcgcaagtactatagtatagtaaaaccgaaataaaactttagtaagtataaacttttcctaaattttatctcctgtttcggtatcacaccgaaacgatcaatcaacaaaagcgtgccgccgtaggcccgagatccggccgtgtattagcgctcacgagtcggggcaagcgcacacacccgcatcgcacgagcagaggactcgagacccacgcgcatcctccccggccgccgcggcggctcggcctccgccactcaccagtgagcttcgacagcgagggtttgcacgggatccccgggtacga

SEQ ID NO: 6608 - DNA, 592 bp, Oryza sativa
ctctcgccgtcaccgtccgctgccaagcaccggggaggccggtgcgtgcgaggacgcgtgacgcgggactccgggcaccctcctccttcctcttccccggcccgagaacggagagctcgctcccgcgccgtcggcgctcgacaccgcgcccgttccggctcggtagtgcctccctcccgttccccttcctcactcgccctctccctccctagctcacgtggtagctcggctagccttccggtagttcgtagaagccgcccaagccccgccgccgcctggcatggcctcgccgccattaccgcccgctcccggaggctgccgtcgtcgccagccctccacggtgccactccaccccatccgtcgccggaaaacgggtttcccaactcccttgggtgctcccaccgccttgaatcgacctctcgtctaccgccgccgtttcccctctttgctcgccgccggcatgcgccaccgcgattcgtcgccgccggcctctctccggtgaatccgggccggtgattcgctccctcttgtccctcccatcactccggtgtccttccccctcccttgaatccccgtgtgttgccccggcgaa

SEQ ID NO: 6609 - DNA, 1501 bp, Oryza sativa
ggaaacctacgaaggtacagtatatatttgacccaaatgagttactatactaacattcatttgatcgccatcttgcaatcaaatggcatgcatgatcggtgcactgacggaacctgcagggtgccgtgcgcttgggttcaacatgatcatgtccttcctcattgctctggtcgtgaacgtgtccatgagctaccccacgctgcctgtgagtgagctgatcgatcttgggtataacttgagcgatagcatctcaaactccttttttttgaactgtgatcattgtagggctggctgccgtccccgttcttcccgatctacatccacaacatccacaggagtaagcacgggagtgactctgggacctacgataacgagggccggtaatcatacatcctcttctgaatttcgtcactctcgctgctgcccagaatactgatccgaacatttcgtgggggtgcaggttcatgccggtgaacttcgagaacatcttcagcaagtacgcgcgcacgtcccctgacaggctcacctacagggaggtgtggcagatgaccgaggggaaccgcgaagtgctcgatctcttcggatggtaagccatcatcagtcttttaacacactagatgtgttcaaatagacaatgcagtactctcaattgacagatgatactgaaattggttttgttttgctgacgtgtgtgtaggttcgcggcgaagctggagtggacgatcctgtacgtgctggcgagggacgaggaagggtacctggcgagggaggccatccggcgcatgtacgacgggagcctgttcgagtacgtggcgatgcagcgggagcagcacgctaagatgtcctagattagcttagttagctactggatcggtctgtgggtgtgagatcgagcctgtgacgcaggggacatgcaacggtgctctgcctgccggcttaggtctggtgttctctctggactctgggtgataacaaaagaacacccagatgcgtgtcgtgtctgcttgtaattaactttgtatcttgatgcaagagaaataagaataacgtgtggaggatgcgatatgcgcgaataatgtttagctactggcacggttttgcacttcaatcggatcatcttctcctggtgctgtgcttgcggcgcgcgatggctgcggattatgatcctcttcacttctgtacttggcgtgattgggccgcggaccggtagagcggtggctggttgcgtacattgactagcgatcggctctgcaccgagcaccaaggccgactatgcatctagccaacgcacgctcgcgcgtgtgctttggttaattgtcacgttgttcggttactaacgtgatctatgagagccagaaattttggcgtcgcaaccatagtcggcgtcgcaatgttgctcgtgctcggttgttagcgtgtggcctgcgaggtcgggaaatcgaatcatgcgcagttaatgtttctttttagtaacttaattaatgagtagcttataaaatcc

SEQ ID NO: 6610 - DNA, 1501 bp, Oryza sativa
aggttgaagctcaaggctgggatatgtttggatttacatccttggagttgggacaggaattcaaaggttgttagatagacggacgaaccgatggataacttgtagatagatagatagatggatagataggtagatagatagatgaacaggtagatagatcgatagacaaggagggattcaaggttgggatttgatattcttggaatcgagagaaatattggcaaggaattttaaggacgggattgaatttcgatgtttgactttagaagatgaatcgggattgacattttagaggtggaggattttgatggcgacgggagggaacaacaatggagatttgaattgagatcttggcacaacttagactctcacacaaataacgaaattttcgcatataggattttggcgaattagtttttaacatctcacgaaaagcggagcgttacatccatctactccctccgctgccgaccgggtcatggtcccttggctatttcctgccatcgcccgtcaactctctctggtgcttctctatgcgacaggcagggagaaaaaaaaaggagtgagaggcaggggtatgtggacttggtctacagaggctattcaacaaggggagggaaacaagagaccgacatgtgggacccacatgagtcccacgttgagtcagctgccacatcagataaacccggagtcaaaaaccgcagagagaactggtttgtactggttttgtaagttgagggatgcgttctatttgattttgtggttcaaggatgattttgtaactcgacgacaagttaagagacattcggtgtactttttccgccatatttctcttactacatgatatgagctcgttcattaattgggcccggcccatggtttaaccttacctgcaatgatgcagacttgcgatacagagcaacgtgcaagtgcaacgaggcaacgtccccctgcttctgtaccatctgggattctgggtcggcgtgacggatgggacaagattgctaccccacctgttggctttctgaggcgtacccggaggaggcgtgatgccgaaaccgaaacacgaagactcgcgacacgacgacgtacgctccccctctctgtccaccgagcgacacgttacggccgcgcgactctccgaacgccatgcacgcgcccacgtcgcgccaccgtgcccttcccggtggacacgtcgccacgcgcccatcgcgacgtcctatatatccccgccgcggccgcgacgctacttcctgcaccgccgctacacgttgcaactgcgactagtcgatctcatcgatctctcaaaagactacgagctcttcacagggaatcgagtgtgtttcggtcgtttgggccgcgccaagcggaagcggagggatgcaggggacaacgacgaccaaggccgggcgcaacggcgaccgcgccggcaccgaagccccgggcgcgacgagggcgactgacgggaggggcggcgccgccgtggcagcccgcaaggtcg

SEQ ID NO: 6611 - DNA, 1320 bp, Oryza sativa
tttgttacaaggctaaatgcaaattccagtgttaatacctgcttggcaagctccctggtgggtgttaaaataagagcacgaagtggactttctctagaattttcatcttgtgtactctcatcctcccgagacaatctcatggccttctcttgttcttcaagaaggcgctgcaagatagggaggccaaaagcaagtgttttaccagaacctgtctctgctgcaccaataacatcctgttacaacataaacatcaccacagttagaagaccaaaggcatggaacaacaataaatagtataaaaagttatctcagttgcatattctcttatttccactgaactgagaggggtccaagctggcatgattagtttatggcactttatccaggtatatgttaggcgacttttaaatgtggaatcataagaagaaatgtctaacttcgactaaataaagtaggctatcaagttaataaccaaagcaacaaatggtgcataagcaggtgaataatgaaatagaagttcatcattttcccatataaaagcttggccaatggcctacaagttagcacttgacgaaccttgccttgatgagccgctgcaggaaagcaagccttttgtattggtgttggttctttgaatccaagcctgcgcaccgctgtaataagaagagggtgcagtctaagctctcgccatgcatagacttcatcctctcccaaaatcagcccatcattgttatcttgttccatgtcattgccatcttgcatatctgtgagcacacaacagtgttaagtagactcgcaatgctgatccgacaaatttagtaacaatgactgctacaaacccagacagaagaaatgctgaaacttcagtacgtgagataccagataaaatgctcctaaaagcctttaagtgaaagcaattagcaccttccacattgtcatcggagacatcttccttgctctccattgtttactgcatttccttcacctttctcttcttcctgctcctcctcttctttttcaccctcttctcacccttctctccctcctcctcacattcaactaccaaatcaccatcaccaggtaaagcatagtcatcgtcacctcgcttccgcttcttcctcttcttcttcttctgatcctttcctgccttcctgtcaatttctcctagatcctccacggcaccgccaaagattccgaagtccgcctcgtcgatctcctcaagctccaggaaccctaccgcccaatcaaccaaacacctcctcgtcagagaccaaacgcattaactgaaccaaggatccaatacacgataaattcaaaccc

SEQ ID NO: 6612 - DNA, 1501 bp, Oryza sativa
gccagtggcagaagatcctgaagcaagatcatccttgctaaaatcaggtcggacgatagagacatctgttgagaatgaaaaggtgccaaaaaaatctggtttggatcagagcatgaatatttcaaacaatataaattgcaggggctctggagaaagggaccgtagttgccaaatcagaaaaggggatattagtgcacgggatgccaatagctgcaatgctgactttctctgtttaggatcaggtcttcctactactacggtgggaaaaccacgaaacagaatggggactatcacctttaagaagccgaaggaagtagtaggtgctaatgtctgttcagtatcgagtcctagagagggcaaaggggaagagatcactgacaagggcacaacaggaatttcaagctctacaccaagcattgttcctcaaaggcatgtgggccaaagaaagctggtgcggaatggttgtatttctccctccaacatagccaaaagaagtctgaaggttgatgaaaagcgagaaatatgctctacaagtggactcttacactatccagatactcaggttgatgcttctgggaagggaaatgtgatagatcttactgatagttcacctataataagaaggcagggaaacactgcaactgacatggaaaaaaggtcagggagaaagtcggcaataggcagagctggggagacggtaattccactggctgcaaatcaagtgaacagtattttttctgaaggtaacaagaataaaggaaaagaaatttcccatgatgtcgtgggtgctaagcagtctggagaggcttatatgaggaggtatgtcctgtctcttttttcctatgggcattgtcagttcatttcatttatatctaggatgtatcaatatgagtacaagatatggaggaaatgtttttgtttaaaagaactgtgaatttgcgataaggtaaattctggcttttagggtagtaattttattggttgaatttaagtttacaaaattcttgtgcatgtggttacaatttgtgaacttttgaaaattgtaagcaggagatgctaattctttttacaaatctttttttttcagcaaaataaccttcctttaaaatcatacagtatgactaaactagttttgctccattgttggacttacaaaaatgcatgattaatttgttgctatgtttagattattgcatgtctagaacctttacctgcactttcactattgttagggtttgtccaagatccatgggagattcttcttccgttgcaaacaatgatcacaccggtataggttctgagcaaggttggagaacaacgcacaataatactagtaatatacccatgccactatcaggtaagatgaccaatagttgtggaagagaatctggatcttctgaacagtctaatctggatcgagcatctgcagcaggagacagcaataactcaattgagggaggagacaacaataactcaattggtggagcaaaaacattgcaga

SEQ ID NO: 6613 - DNA, 249 bp, Oryza sativa
ttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccat

SEQ ID NO: 6614 - DNA, 206 bp, Oryza sativa
  unsure (1)..(206): unsure at all n locations
taatgaagttggttcgnccggggtgtccggttgtccagctgccggattcaccgcggcgcaagaggggaccgcccactgccttttgaggggtgggggtgaacccttagcgtggtgtggatgtttagggaagggttatgcgaagggtctcgtcacaatcactcgacatggtgacgtgtgcatcatgggcacatgatgacgcggtgaca

SEQ ID NO: 6615 - DNA, 1501 bp, Oryza sativa
tccagagctgccaggctcacagtttataggaagtggccacttgcaagaaccggcttaactatcattactggataaagatccgaacattatcttgcaattggagttggagcatgtgcatggcagacagagctatctcgcaatcaatggaactcgacccagtttctgaattctgatgcaagtgactcgaacaggcagccatggcagcatcttgggacagggcccttgtttctcagtgcagctgagagagtaatggaaaaatcttatcaggccaacaccatgaaggcgaaccagaaccagaacaagaacccaagaagaagcagagcatgtgaaaacgagggcttcttgcagtctgcagatttggaaatacagttactcctgcatctgcatatatatcatcgatcagaagatgatagctcagcaattcagattgccgaccagggattcctcggctgggtagtttcagaaccttgtaactgcaaagattcctacatttcgggcagggactggactgtagattcttcgacaaaggggctagttactagttaccacttacccacttctgaagttcagaacttcagatgcacacagcacacatggaagaatgcctgaaaaatattggctttgttagtattactctctactaatttctccagttttaacatgttcagttcatagtttgggctaaacttttcagatttatgcaatttgaaactcacccaaaatttgaattttgtaacttcattttatttatagttgattttgaggatcgtaatttacatcttagtactggcttttgggttggcttttagatcactaggaagacagatataaaaactttcatccatttttagttgcttagtttattttttcatgctttatcggccataacatttttggtttgtctctattctctttcatcctaaaatatatctgtcccaaaatgttaattccttcatccaaaaaagtacgaacatctaattgtaatttgaactagagagctacacttattttggtatgaagaaagtactatctagtataggacatgatattcgtagttttagaaaatatcgtatcctatactaaattggaggtagtagcagcactgctatattttagatcttatcttttcgtttatgcttatacttatcagccaaattttgaacttttaaccttaaatttggagatgattttgaggtttttttcatcgaagtttatttttcagcctttgcttttagatagctaagaacacgtatataaaaattttatttacagattacttttcatttacaaataaactgttttgcttattcagcgaaatgatggctccgtttggagtgagagagtattaatcacaaacacgtgcagtgcagggaagcagaaaaaaaaaatcacatgagctcctctgatcttggcagtcaacagttcaacaccatccagccatccaccttccccctgagtgtagcgtgcgcggccatggcgggcggagacgccgaggaggagg

SEQ ID NO: 6616 - DNA, 1387 bp, Oryza sativa
gccctcacctgccggtacggccggtacggcggcgccggcgcctgctgctgctgcgacatcagcggcggcgcgccctcgccgacggtgaaaaggtggggaaaagtgtgagacgcgtgttctcctctcttcgacacggacccgagatttgatcaaaagtaccttccattaaaattgaaatttgaggatttattttctttgacgcaggatttacttttttaaacacagtaaaaacagtgcatccaaaactactcccactgtcaataaaataaaataaaatacatactactaagagaggatgtgacctctccagcccttgtaatacgacgaatctaggagagagtagacctcagcgtacactctttccctgtaaacatctaaaaaaaccctgctccctccaactcataatataagggattttgagtttttacttgtaatatttaaccactcgtcttatttaattttttttgcaaatataaaaaataaaaaattatgcttaaagtactttggataataaagtaagtcaaaaaaaaataattctatttttttaataagacgaatggtcaaatagtataagtaaaaactcagaatcccttatattatgagacggaggaagtataacttatggtgacctcggatgcctcgacagaaacattgtcaaaataattaaacataaatagaaatatctgtgtgaagtttagaatttaaatgcaagtgaataggtttcactacaaggaagaaaattgttcacttctcgagaatttactcgtatttggttaagagcaggtagcatagcaaagtataaaccagctataaacatatgtcgagaagataaaagaaaagagagatgaacaacaagctatttatagctaggtgtaacacggactccaagacacgatgtatattatgacaggtgagaccatctattaatagtggttatatgtttatagataactaataattggctatatctctaacactaaaacgtggctatagctctaacacaaacgtggacaagagggaccaggatcctctgtagccgaagtcacttaactttatcactgatatgtgggtttgataatccctagattcacatgtaagtgataaaaatatcgtgcatttgactgcagagagcatctcagtccggataggaggggtaaatcacagttactgtaccaatccaaaatatttggtcaaattttacggttgcggattcgcgacttcacgtttcccctttccctatcggcggcgtcccaaatagcgaatcggttcgtgtaaaaaaaaaagtgagccgcttagcctcgccggcgccgcctctctccgggaagcggcggcgagaacgcggaggagagagagagttcggggttggcccgtcgcgtcgccggagcga

SEQ ID NO: 6617 - DNA, 1501 bp, Oryza sativa
tgctggggtcggagcccgcggcggaagcggaggaggtcgccggcggggccttggagaggagctggcggtgctcctcgtggcgccgcttctggagctgcttctgctccagctccgaccgccgcacgaagctcttcccgccgaagtcggccgtcgccgccttccgcttcttctccagctccctcttcagaagatccatcgctccggcgacgcgacgggccaaccccgaactctctctctcctccgcgttctcgccgccgcttcccggagagaggcggcgccggcgaggctaagcggctcacttttttttttacacgaaccgattcgctatttgggacgccgccgatagggaaaggggaaacgtgaagtcgcgaatccgcaaccgtaaaatttgaccaaatattttggattggtacagtaactgtgatttacccctcctatccggactgagatgctctctgcagtcaaatgcacgatatttttatcacttacatgtgaatctagggattatcaaacccacatatcagtgataaagttaagtgacttcggctacagaggatcctggtccctcttgtccacgtttgtgttagagctatagccacgttttagtgttagagatatagccaattattagttatctataaacatataaccactattaatagatggtctcacctgtcataatatacatcgtgtcttggagtccgtgttacacctagctataaatagcttgttgttcatctctcttttcttttatcttctcgacatatgtttatagctggtttatactttgctatgctacctgctcttaaccaaatacgagtaaattctcgagaagtgaacaattttcttccttgtagtgaaacctattcacttgcatttaaattctaaacttcacacagatatttctatttatgtttaattattttgacaatgtttctgtcgaggcatccgaggtcaccataagttatacttcctccgtctcataatataagggattctgagtttttacttatactatttgaccattcgtcttattaaaaaaatagaattatttttttttgacttactttattatccaaagtactttaagcataattttttattttttatatttgcaaaaaaaattaaataagacgagtggttaaatattacaagtaaaaactcaaaatcccttatattatgagttggagggagcagggtttttttagatgtttacagggaaagagtgtacgctgaggtctactctctcctagattcgtcgtattacaagggctggagaggtcacatcctctcttagtagtatgtattttattttattttattgacagtgggagtagttttggatgcactgtttttactgtgtttaaaaaagtaaatcctgcgtcaaagaaaataaatcctcaaatttcaattttaatggaaggtacttttgatcaaatctcgggtccgtgtcgaagagaggagaacacgcgtctcacacttttccccaccttttcaccgt

SEQ ID NO: 6618 - DNA, 1501 bp, Oryza sativa
tcccggcgctccactccgcggacgccggcgccgccgcggcgtcgccctgcagcagcgcgtagtcggcgagcagcggcagccgcgtgtcgtcgacggcgaggaggtggtggtggaagccggccggagcagcagccggcggcggcggcagtgacggcgccgggttaagcaggcgtcgtcggtgaggcatggccgccggtggagctagcgccgacgcatggagatcaagctcgctcgctagcaccaccaccgctcgtcggaattagggttcggagaagaggaggaggaggtggtgatgcaaatggaaatggaggaggaggcggccatggcgatgagagggagagagatgagatgaagagtggtttaattcaacttgcagggtggcccttggggtgtactcctagtttattttaaattattttttggttgctatctccaattttatttgatcttgtgcatgtctttggtcatggtttaccccctgcattttttatattctggtgatttttatattattgtgtgtgtgtgtatgtctgcatggaaccatagtactatcgttgttgttttgtttttttgttgggattttgttgtttatgcgtagtgtagattagacaggatatgtgtttgtgttatgttcttgtggagatagatgatgatgaggctgtgagtgaccaaacaggtccaatgttaaagtttggaacatacatatgtggtgagctgttgatcatctgttaggtgaaagtatttttcatttatcaaggggatatttactcatttattacatgttatctaaatagtgataaataatttaagaaaattgataagatagattaatatgaaatatatcactcgacaaacatacaagttaaattttacttctatagactgtaaaaaaacaataaatataaatgcgaatgtatgttaattatttttaattaattaatttctttttagtttatagaagtcgaattaattatgtcttacatatttatggagtgatatattttatattagtctatattattaattatttaataactatttatttaacatactcccaccgtcccaaaatataacaacttctagcctttagaatttgttccaaaatataacaatttctctaccaacattctcttctcaaccaatcataatcctccaccattctatttttccacctaccttcacttctccaatcacaacactccctatttaattctaccaacatttttaataattatgtcaactctaaaaatgcttatattctagaacagatggagtattgcctattcgagaaaatccaaattaacttcctatactatgcaatgcaaatatgctatttgtttttcgtgtactttatttccctcctctttcatcaggagagccgagttgaaaagctagaagaaattagcggatcagccttagggtccctttgaatcgtaggaataaaaaaaacataggaataggaaaaacacaggattctgacaggaatacaattgtgaaacag

SEQ ID NO: 6619 - DNA, 314 bp, Oryza sativa
ggattaattgtgtcaaatgcgctttctatatgtctaatttgctggattgtgccactgttttaggggtttagggaactcagggttgaggcctaaagtgtactgtgattgctacaaactgttcacatttacaatacccaatgtcacaatgttaggctgccgttgtattaggtccttttttttttttgggggggggggtgttcatagaaaatgctggattttccttctctgctcagtaaattcgctgtatatcatactatgttgatactcctattttcttttcttggtttcaggtactcctgccaatgtttcctaga

SEQ ID NO: 6620 - DNA, 233 bp, Oryza sativa
acttgataaaaaaaccaaacaccttataatatgaaaaaagagagtaccatggagtcagagaaacgtggtgcatttttagtgacctttttttaaacccacaaggtgtatttatattaattaaggagggggaaacactgtataatagctctaaagccaggagattataaaagaaaacaaaaggaaaacgaggagggtgagaaatgcctaggggtcttccatctaacttcacaaga

SEQ ID NO: 6621 - DNA, 1501 bp, Oryza sativa
tggccgactcgaacgccgccgccagcagctgcgggtcggcgggcgccaccgccgcggcggcggcggctcggcgcatttggggtttgcaaattctttttggcgcgtactcctataggcctactgggcccaaagcctcatatatttttagagacacggaccaaattagttggccacgtgttccggttttctttttcgcttcactgaaattctcccaaatgtagcaatgttttcatttgttttgtcaataggacaatttggttacataataaaaacttgtgtaataaagtttgttcgccacgtattccagtctttttttttctcttcactaaaaatttctcccaaatgttccactattttcatttgttttgtcaataggacaatttggttacaccaaaactgtgtaatgaagttagttggccacgtgtttattctcttcaatgaaattttctcccaaatgttgcagtattttaacttgtttttgtcaataggataatttggaaacagaaaaaacttgtgtaatcaagtacaagttctgggaccaatattttttcttttaaaaaaagaaactaaataaaactcgtacagatacaggagtggatgacaaaattattacatcgttctacgacctggttatcttctaacgtgtcaacttgtaactttctcccattaagactctttagctggataacaattcaaagcattgggagaatagctactttagtcactaaattttctctgtaggatcagtttagtctctaaccttttaaatggttcaaagaaatccttaacctttgtcataaggcctagaatagtccttgggtccaccaaaatcatcatatggatatgccatgtcatcattcatgcaaaatctatgatgaattatccaatttagccttacgtatatcgtagaaaaataaatataagggtgaattagacataaccataggaaaaaaatacttcttttttcacccttttgaggtatatttttgctcttacatataccatatatttttttaactttttccttttgttttttattttcctatgcataagggtaaattggacaaatcataaagattttacatagaaaggtgacatggcatgtccatgtagcgattttggtgggaccaaggactatattagcccacatgacaaatttaaaggacttgtttggacaatatgaaagattaaggactaaaataactcaggagcgaaactttagggaccatattagctattctccccaaagcgcttaagctatgcgtttttgtgccgcgtggacttcgatcagtatttgagttcggataaaattcctccaaaaagatgagaaaacctctcatgcacgatccaatgtcgcgttctcttaaatttctcaaactctggcgctataaatacacgtcgcggaccatgcaaaaatccaatccaattaatcaatcgatcgatcccagtatatatcccaccatggcgcgttccaagcttcctctcctcctcgtactcgccg

SEQ ID NO: 6622 - DNA, 511 bp, Oryza sativa
attcccattttgttgcccaatctctctcaattccttacggtggttgattggttgttgtcacgaacgtcagacatgtgattcatgaatctgatcacggccggactatgattgttccacgcacgtaatcgtcgttgtcgaatgaagtactgctgctgcaagtcatgctctccaaattgagttggccgaagtggaggataatcttatctgactgaggattgctggctgaataaatcataaaaaaagataatgaaatagctattataaaattaaaataatggatttaaaaccatattataataaattctcactttcaaaagatcgcaggttaattacaacatcatcttttcgtctatacttatactttatgctaaaattgaaatttttaaagttaatttatgagttttatttatcatttgctttgaatcgttaacaacacgtgtaaaattattcttattacaagtttttagttgctaacaaaccgtatgaataaacataatcatatgataaaaga

SEQ ID NO: 6623 - DNA, 1501 bp, Oryza sativa
acgtgtatttatagcgccagagtttgagaaatttaagagaacgcgacattggatcgtgcatgagaggttttctcatctttttggaggaattttatccgaactcaaatactgatcgaagtccacgcggcacaaaaacgcatagcttaagcgctttggggagaatagctaatatggtccctaaagtttcgctcctgagttattttagtccttaatctttcatattgtccaaacaagtcctttaaatttgtcatgtgggctaatatagtccttggtcccaccaaaatcgctacatggacatgccatgtcacctttctatgtaaaatctttatgatttgtccaatttacccttatgcataggaaaataaaaaacaaaaggaaaaagttaaaaaaatatatggtatatgtaagagcaaaaatatacctcaaaagggtgaaaaaagaagtatttttttcctatggttatgtctaattcacccttatatttatttttctacgatatacgtaaggctaaattggataattcatcatagattttgcatgaatgatgacatggcatatccatatgatgattttggtggacccaaggactattctaggccttatgacaaaggttaaggatttctttgaaccatttaaaaggttagagactaaactgatcctacagagaaaatttagtgactaaagtagctattctcccaatgctttgaattgttatccagctaaagagtcttaatgggagaaagttacaagttgacacgttagaagataaccaggtcgtagaacgatgtaataattttgtcatccactcctgtatctgtacgagttttatttagtttctttttttaaaagaaaaaatattggtcccagaacttgtacttgattacacaagttttttctgtttccaaattatcctattgacaaaaacaagttaaaatactgcaacatttgggagaaaatttcattgaagagaataaacacgtggccaactaacttcattacacagttttggtgtaaccaaattgtcctattgacaaaacaaatgaaaatagtggaacatttgggagaaatttttagtgaagagaaaaaaaaagactggaatacgtggcgaacaaactttattacacaagtttttattatgtaaccaaattgtcctattgacaaaacaaatgaaaacattgctacatttgggagaatttcagtgaagcgaaaaagaaaaccggaacacgtggccaactaatttggtccgtgtctctaaaaatatatgaggctttgggcccagtaggcctataggagtacgcgccaaaaagaatttgcaaaccccaaatgcgccgagccgccgccgccgcggcggtggcgcccgccgacccgcagctgctggcggcggcgttcgagtcggccatcgcgtcgcgctcgccgcgcctcggccgggccgcgcacgcgcgagcgctgaggctgatcgccccggcactctcgcccttcatctgcgcgcacctcgtcaacc

SEQ ID NO: 6624 - DNA, 1501 bp, Oryza sativa
tcgttagcaacagttcgttaatcaactaccaaactgtcacaacatgacgcagcaaccaaaccaattcgcatccccacgcctcgtataaaatccctcccgccccgcgcctcacactacgcacccaactcaacgcaagcaaaccgaagctaccaacagaaagcgcgggaaatttaaaaggagagctaagagacgttccggcgaagctaacaatgccgccgccggccgccgccgacctgagaacgacggaggaggagaacgagctaggaggcgtgccagacgatggaacgcatgttcgagggcgaccgcctgcaatcgttgtcggagacgatcacggatatagaaaggaataggtgtctgagcaaattatatagagttacagtccccctctcatctatataaggtaaaaaattcagtgcaattttcgtggggctctcatagttttcacgttcatgttagtagtagaggcttgagatcccgccagcctatgctggatccgcccctgggcgccacgctcagcgtcgtggccgtgaagctggccgtggccggcctcacgtcggcgacggcgaccctgaccactgaccagcgcggtagattctggggcaaactccatggaaactatatagtgggccaacctatatgggctgcagcccatgtacaatgggccacccgtacgtcgcaagcccgttccatctcgcacactatgggcctcacgtgcgtgggaaacatgatacggcccaaatgattaaagttctccgaaacgagaaggcgaaaagggaagggggaaaaaaatctgcagccttcccgtgttatcctcttcaacctctggccctctcactcctcgcgccgcgcggctgctccggccaccaaagtggcgctccgatggcggtgagagtcccttccatggagctgcaccgccccccgccgtccgtatccggtgtccgaggtatctattcatgattcatcactcccaatatgatggcgatatcgtcggattttggcatcgccgaaggttggctggatgggtggggggttcatgaaacttctataaactttatctcgctcagccgcgtgtgattttaggctgctgttgttgcggcgagcgtctcgctgtgcgaggtgacaaactgacaactttgggtttaatatcaggatattctaagtgctagattttggtttagtcaggggctttaatcagtcactagtgttgctggaacaatgctgtgaaggatggagaaggtttttttttctctctctctctcttactgctgaaaggcagaaacgatgctacgaatcaggaataatccgaggagtagataaagaaagttatgttttccgttactagagtctgaactctgaacaatgctatgagcaattggtagtgctaatggaatgggtataggagactgagtggttcagtgtgcataatcaataatatgatcaaactaataatgcagttaagtgacagaaagaacatctcgtaactcaaaatcaatgattcttc

SEQ ID NO: 6625 - DNA, 1501 bp, Oryza sativa
attgttccagcaacactagtgactgattaaagcccctgactaaaccaaaatctagcacttagaatatcctgatattaaacccaaagttgtcagtttgtcacctcgcacagcgagacgctcgccgcaacaacagcagcctaaaatcacacgcggctgagcgagataaagtttatagaagtttcatgaaccccccacccatccagccaaccttcggcgatgccaaaatccgacgatatcgccatcatattgggagtgatgaatcatgaatagatacctcggacaccggatacggacggcggggggcggtgcagctccatggaagggactctcaccgccatcggagcgccactttggtggccggagcagccgcgcggcgcgaggagtgagagggccagaggttgaagaggataacacgggaaggctgcagatttttttcccccttcccttttcgccttctcgtttcggagaactttaatcatttgggccgtatcatgtttcccacgcacgtgaggcccatagtgtgcgagatggaacgggcttgcgacgtacgggtggcccattgtacatgggctgcagcccatataggttggcccactatatagtttccatggagtttgccccagaatctaccgcgctggtcagtggtcagggtcgccgtcgccgacgtgaggccggccacggccagcttcacggccacgacgctgagcgtggcgcccaggggcggatccagcataggctggcgggatctcaagcctctactactaacatgaacgtgaaaactatgagagccccacgaaaattgcactgaattttttaccttatatagatgagagggggactgtaactctatataatttgctcagacacctattcctttctatatccgtgatcgtctccgacaacgattgcaggcggtcgccctcgaacatgcgttccatcgtctggcacgcctcctagctcgttctcctcctccgtcgttctcaggtcggcggcggccggcggcggcattgttagcttcgccggaacgtctcttagctctccttttaaatttcccgcgctttctgttggtagcttcggtttgcttgcgttgagttgggtgcgtagtgtgaggcgcggggcgggagggattttatacgaggcgtggggatgcgaattggtttggttgctgcgtcatgttgtgacagtttggtagttgattaacgaactgttgctaacgatgttcctataaaaagtggggaaatgaactgtggctaaagatagctattgctgtcgtaccctgattatgtattttgatttgtttgttctcccagcgagagaacttccggtggctacttaaccttgacatgctatcatagtttcattttgtactggatcatgtctttaaggggatagtgtatatgctgttagtataaataagtgtgctttaagattttaccatgtataatttaaagaccaagcattcaacgggttaaatagaataccatcgtacaagtgactttgt

SEQ ID NO: 6626 - DNA, 270 bp, Oryza sativa
tgatgtttggggcgtacggcgcgccgccgttgaacccggcccagcccagccacagcagcccgccgccggcgatcatgaggaggatgttgttcggcgagaaccgctccctgtcgctcttcagcctcggccccacctgtcacaaaaaaagtatttattaatcgccgtcacgtggttaacacttaacgccgtcgagattcgtgccacgtactgttctagaatctggattctgcaagctgagccagcactgttttttttttttttctttctagc

SEQ ID NO: 6627 - DNA, 226 bp, Oryza sativa
gaccaagcttaattagcatcaagaaactaagctagctctctctctctcgcgcgcgatcgatcgtcggcgggcggtgagtagaggcgcacccggcgaggggggggggggtgcgcggtaaaaaaaggaagagagatctgggcggtgctcgacggggtggatcgagatgggacgttggaaagggagcgggggcgggggagagcgacgggcagccgggaggggagctgaa

SEQ ID NO: 6628 - DNA, 1501 bp, Oryza sativa
aaatttaaatcttaaatcaaaagttttcaaatctaacttaaaaaattttcaatctattagtaaaaatatctcaaaaaaatcttcagaatctttcctaattactccatcaatctacttatgatagtcatatgtctaaatctaaaaaagttatttttgatagccatatttcaatccaacaacttatcatcttaatggcttttttggatttaatgtgtgattcttcattcttccacgcaagattggctacatggacatcgaggaatataaatattaatgaatcgcttgtttacgaggaatgactagtagcatatttaaatggataataagtagaatcacttatccttaatttatgtgtcaaagataaaatattactatcaaaaatagatggagagagtattatcattagtgttaagtgttaaataaaggtagttgaggccttaagttaagggggtgtgcacgctagcgcgccagctagccacccccaccgcgagtccgcaactacccaaccccacagcaccgcgtgcccgcgtgcgatggcattcgcgccgcgcgtaggccgcgcgggctgatcagctgatggtccgcgcggggctacgattctgctacgacttcatacgagtctacgaaccagtcgccgcagcccggtaacgatcttggggcaggcttgcacacaggtgcaaagatacgtgtggcagacatccgctcgacggcaaccgcctggcagtggagccaccgtgtcactgtcacctaccaaagctctgcaaggattctaactttccaatagcccgtgagtttacgttttgtcctgatgcatgatgaacagcccatcatcaacgggagaagccaaccaatctatcatggacatgtcgtcctgtgtcgtatggcgtgcagtttgtactttggattacaggtaatattgatctgtacatatactacttttaataatactccagaaactaaatactactagaaaggattttgttcgccttttagtacgtgagggataattatcccttgatgttattggtcggagtaccattgcatcaccatgaatgagaaataataaagaaatgaaaagaggattgcaaaccaaactgggatgctccccgcatatgggttctgcatttagcagcataacatctaaaaagcagataccacaaatattttcaggggactactccaggaccaataggaactagagattactaccatgaagggcacatgcttgcatcgcatgctaaccatctactgtagagtagtaaatacaaaatctccagttctgccaaaaacaaccaactcgagtcaagaaaaaggacagcagtttcatgcaaaagaaaacattaaatagtacatatccgggagatatgcattacttactgcgaatcagctaaatatttccccaatttattaggcatgtattacccccctggaaatataacaaagaaccaactggagtctggagagtattaaaaccaaggcaaggggttccttctcatggcgc

SEQ ID NO: 6629 - DNA, 1491 bp, Oryza sativa
aaaaaatatgaaaactttcgactcagatttaaaaactttcaactcgagaattgaaaactttcgactccgattcgaaaactttcaactcgagatttgaaaactttcaactcagattcgaaaaatttcaactcgagatttgaatactttcaaatcagatttaaaaattttcaagttaagatttaaaaactttcaactcaaaacattttttaaaaaataagtgtgctaaagattttaaaaagttatcagaaaaaaacgaaaaaaaaaccgaaaaaaatcgcaaaaaaaaagaaaaaacaaatcgcgaaaaaaaagggttgatgcgccttgggtcgggagcagctggcacgcgccaactagcaacccctcttggctgattatgccgaggagcatcaacgaggccactttcctcgagttgggccgagttttgcgagccttttgcgtgccgggttggcttgggcttctctatccagtcgcgccacggcactggcctaatcaaggctatcacctctctgtgcctctgtgggctattagtggagcccaggccattcaaaaaagatgagatcacagattcccaatccatcacagcacgtcagtaccaagtggagcacaagttgcacctcttgcacacagcacacttgttagatgagtcagctaacaaggattttattttcaatttttcccacacttgataatttatcaccatctctttttctattggacaatgatgagttagttgaacccaatgggcacagaggcatatggagtatggatttcttagctgattaaacaacaggggagaacataacattaggctttgaattaggttctatctatatactactcagaatgtcacttctagaaagacgtactagggaagtagacaaggattccatggattcttccgttcgtgacgcgcaggttgctagtccattttgtactggcaagtggctaaggagtaattggtttagtactaattctccggtccatgtaccacatgctaaagaaactttgcattaatctattttgacgtcatattaattaggttcacatagacgaaagattctgcaagttgctatttatagataggtctatccgtaacaacaaggttactattttatcacctactctagtaagaccaagagggaaaccactatagccagtttaatcttcgctttttctacctaatgacttgttcaaactagttacttccagccctttttactactactccattagaaacaaacctcaaaaaagtcaaaactctatcgtcccctgattaccctcgtcagtaacccctgaaggagcgcatcaacttgctcaactaaccaccacagtaacgaaagcaagcacacctatttaacatgcaaccatccacctcttgcctcacaaatgacgcatataaaatctcagggacgagaactttcgtcgttaatcctgacccacccctgtctgtctcattcttactttacagaggaaaaagaaggcaacgac

SEQ ID NO: 6630 - DNA, 1501 bp, Oryza sativa
gcaaaaatgcaaacgtttttctaaagttggagcttggtgcttttctagtgtcattgttcagactttcagaacaaggtgttgatgtcaactgcagaaacaagagacatttcattatcatttccccctcaattcaatattgcatcagcaagaacttcattgtttaggtgacgctaatgcgatttatatctggaatcgatgccaatatgttggagcagttcatatgaagaaatggaaattcgttttacgagcagttcatatgaagaaatggaaattcgttttacgacgattgatggatgcatgtaaagtgttaagtcttagcttccaagctcatttgcaagccatgcatgcacacccgccgtctagaaaatgggctgcaatcagatttggtgccaatgtgttattatcagaagattgatttggaggattgttggaacaaatattgacacttgatattataggctagctaccagttccaactccccagtactaaggtcaatacaatatgactccaatcagattcagcagtggaaacacaaaaggctcacagctgagcagtgaggaattaataatataaaatgtgacagttaactcctaatcattataattccaaactaagttcgctttgcccacaagttttagcaaagacgcaattgacatgaaaaggcacaagtattactccctactcagctattgataacggcagactaactgatacgacagagatggtcaacaaacagtctctagctataggtttcgtctgaaatcagacaaggttcaaaaggatgaatagaactaaatcacaaagcaaatcagtagctagactgcaaaacaccaatccacccttaattatcgtttgcatgagatagttttgcttctcaaaccatggggtaaaaatggattaaccgcaacgactttgtcccattcaattgacggattaacggattggtagcggtacgaaatggaatgtctgtctttcaaactcgaagcaaaagctaagtaaagtaacaacctaatcagatgacacagcacacaaaaatctcagaaccattgtccaaacacaacttgacgcgttggcgcgtgcgaagaaagtgcttaagctttgttctgtgaaaccagggcgccaacgggggcagccgctgctggcctgggcaggccagtgggtgcaccaaactatctgcatagttgaaccttggtgacacgaactcgacctcgaggcatgcatgcgtgaatgagcatgtgtttgcgaaagttttccctctaccacgcaagaatcaaaacctaaccaaccaaccagagaagcaacatgcatgacgaaacacaacgagaaatcgatcgtagaaccatgtcctttttgaaacgctatatataccgcgccatcactgtgggaagtttctcatcgccacacagaaaccttcagggcaagagctatagctaagctactgtgtcacccgttcgatcggtgagccgacgccagcacacgcgccgcaacgtttgcgcttag

SEQ ID NO: 6631 - DNA, 1501 bp, Oryza sativa
cgtgtagttggcggcaacgaaggccgcacggtggcacgaggcatgagtgtccatctaactgacgggctcagtcgttacacaaagattgggagcgtcatgactcatgatccatggctatataccgttaatttcccatttgttgtgtgtcatcaggaccgcacagtgtaaattgtaggacttaggagtacattttaagtttatgtcgtaatatttctaatacttaccatataagagatttggggtaggaatgattaatttactaatgttgattgacaaataatggaaaaaaaaggaaagagaaaacaagaagtgacaaaagcggagagggatgtatcgatctgtacgtcatttagattgcggatgagtactgctatatctaagatacacttagataactagagacatgaatcatagattaatcgaaaaaaagcatattcatatgcactgtagccgttaacaactgttgacgtgagtggaatagatgggtggtatgcatagcaattttctttgcggacagccggacatgcctagccctggatgacatgcaagcgcgcatcggacgtacggtcgccaacttcactgcggcagttcggcgtccgtctcctgctcccgcataccaaatcgcgctcgcgggcacagggctgacagatcacacaagtgtgctctcgcagtgaagtatagcgattagattagcgagacggatgatgatgcaacatgctactactagcttgctttacgtgacagcgttagtgggccaggctgacaaagcattctctctggctttgggccgcggacttctcggcaatcggtctcaaaggcccaaggcccagtccgatccgctaccctatgtgcccccgcacccgcaggcctcgacctcctctcctcctgggctcccagccacccgatgcggcggccacgacctcctccctcatccagctcgacgcggcggcggccggtgttcctcctcctccgcagcccgacgcgacggccggcctcgaccttcctccccagcagcttgacgcgcgcggtggcggctggcctcgtccttcttcccgagtccacgatgcgccgtcggccggcgtcatccctagccctcgccgcagaccctccgtcgcctcctcccacacgcaccgagcatggagtgatgactgcagtagcggagcaaaggaggtggccagatgtgactatataaatactctcttcgttttaaaatgtttgacaccattgactttttatacgtgtttgaccattcgtcttatctattactcccttcatcacaaaatgtttgacgccgttgacttttttaaatatgtttgaccattcgtcttattcaaaaaatttaagtaattattaattcttttcctatcatttgatttattgttaaatatatttttatgtatacatatagttttacatatttcacataagtttttgaataagacgaacggccaaacatatttaaaaaagtcaacgacgtcaaacatttagggaaggaggtagt

SEQ ID NO: 6632 - DNA, 1501 bp, Oryza sativa
ttttagaaggatttggattcgggattgaacttgacgatagatcggggatttgagatctgagatggtatggacactagacgacaagcaaagaaacggatttcgcaaataaggtttttaagagatagttttcccgctaggcgccacgacggaacgggcgctacatgcatccatgtgaagatccctcaagcgcacgagaccattgtagtgttttactacagagtgttccaaggtatcgtgtctatgatgacaatagccctgcaccaaacacacataggtaactccaacaaagaaaatacacacataggtatctccaacaaggaaaatattctagtgattgtaattcataaggaataaggataaattgatcatatagcttcacgattctagtttatagcattgaaagatatcgattcattgaaatagcgaacatttgctcctcactgtttttaccatcacatatactccctccgtttcaaaatatttgacaccgttgactttttagcacatgtttgacgtcttattcaaaaaaaattgtgaaatatgtaaaatatatgtacatgaaattatatttaacaatgaatcaaatgatataaaaataataaataattacttaaattttttgaactagttgggtgacccgcgcaattgcgcggctagcacccaaacaaaattatatattttttagtatgattttacttaaaatttattaaatagatatctcattgtcttaagactttaaaagaccaaaccttatcatcctcgtgtttctaattatatactttttaaaagtcacaccagttaccacctcttatgtcatttccttctttatttgcttgctcgatctacaactatttctattcattcttcttggaacctttaaaaattggattttatagtttttagagtttattgtcacgttgggtttcgtttttataatttatagatatcccgtcaaacgttgccattatactcctgtacggcccgtctactgtttcttctctttattgtcattaagattttaaaaatcgaacataattatcgtttggattcatttttactttctagaagtctcgccaaaccatcagcggctttgccattgtactcctctacgactcacccgctgccttccttctttattgtcattgagattttaaaatcgaacatgattattattgggtttttttttactttttggaagttccaaacctttaaaaattggacttgtagttttattttttataatttttagaagttccatcaaacgatgccactatgcccctctacagcacgtccgtcgcctactctttattgtcattgtgattctgaaaatcgaacataactatcattggaattcatttttttattttctagaagtcccgtcaaccgtcgacgggctgtgcaactatactcttatacaccccgcccattgcttctcctttttattgtcattaagattttaaaaatcgaatatgattatcagtgggtttattttttttacttt

SEQ ID NO: 6633 - DNA, 1501 bp, Oryza sativa
ttcaaaatatttgacaccgttgactttttagcacatgtttgacgtcttattcaaaaaaaattgtgaaatatgtaaaatatatgtacatgaaattatatttaacaatgaatcaaatgatataaaaataataaataattacttaaattttttgaactagttgggtgacccgcgcaattgcgcggctagcacccaaacaaaattatatattttttagtatgattttacttaaaatttattaaatagatatctcattgtcttaagactttaaaagaccaaaccttatcatcctcgtgtttctaattatatactttttaaaagtcacaccagttaccacctcttatgtcatttccttctttatttgcttgctcgatctacaactatttctattcattcttcttggaacctttaaaaattggattttatagtttttagagtttattgtcacgttgggtttcgtttttataatttatagatatcccgtcaaacgttgccattatactcctgtacggcccgtctactgtttcttctctttattgtcattaagattttaaaaatcgaacataattatcgtttggattcatttttactttctagaagtctcgccaaaccatcagcggctttgccattgtactcctctacgactcacccgctgccttccttctttattgtcattgagattttaaaatcgaacatgattattattgggtttttttttactttttggaagttccaaacctttaaaaattggacttgtagttttattttttataatttttagaagttccatcaaacgatgccactatgcccctctacagcacgtccgtcgcctactctttattgtcattgtgattctgaaaatcgaacataactatcattggaattcatttttttattttctagaagtcccgtcaaccgtcgacgggctgtgcaactatactcttatacaccccgcccattgcttctcctttttattgtcattaagattttaaaaatcgaatatgattatcagtgggtttattttttttactttctagaagtcccaacaactgccttacttgtttgcttcacgacctacctgacgtccctccttttaatcgtcatcaggattctatttggtgttttattaataatttttatatgtcgtatcaaccgccaccactctactcctttataggcctgttacttaatttatctcgtcatgtgttttagatggtcttttcttttaatagtctttatttttatcacaaattttagttatttataaattgtattcctaattgaaatcttattttattctaatttcataatttattttttaaaaaaatagttaatattgtattatgttcttttaatgtttttattttttatttgaaattttaattaatctcgtattgggttcttatatggattcttctttcaatattgcttatttttaattccaagtttcagctaattttaaattgtattcctacttgaactcttattttatttttgtttgcta

SEQ ID NO: 6634 - DNA, 545 bp, Oryza sativa
tgtttgtaaattagggactaaactttagtccctctcacaaaaatataagtctctatcttagaaacttatatttttgagcccctctctcccaaacaccctcatatatatatcttgcttctaaactgttaatactccaccatccgttataaaatataaacaatttttagtatagtgtcaagtcaaatatttatatatttaactattaattgcaaaagaataaaaaaatcaatcatatcaaattgatgttactagatttatcattaaacaaactatcacaatatgcgactctttttatttaaaacatcttacttttataaatgtcattggttaaagtagtatctcgaataccgtgtcgaagatcaaaagtgtttatattttaggacggaggaagtaataaagatgtaagaattttatctataaataaattatttgtaatagctcaaccaactagacatgcactattttgggccttctggatcaatattttcccaaccactccttttgcacatcgatatttgcatgttcaagcttgaaagacatatgat

SEQ ID NO: 6635 - DNA, 1501 bp, Oryza sativa
aagaagcaattgaggtttgcaagtatttgtggttgacgaatagcattttgcgttcctccgtgaattgttaactccagtctgagaggaaaccggagccttgcaaatgggtcatggagtattgacgatgggatcagaaagtgttaatcaaataccatcggcacttcttggcgtgccagacacatctgttctagaagcagaatcggaatccgttcattccggtcaaatagaaacagagcagtatcttggtgaaaactgctgcatcaatcgataatacaatgttctattttttctgtaactgtcataaacaatgttctggaagaaagcaaatgcgaagaaaaagggaacatgaaatcaaagtttggatttcttttaagctgaaaagaaattcaaagcgtggaaacgaatttgaccgcgtgacgcgtgggatgaagaggagaggagacaagggaaaaaagaaccttctggaggccggtttaggcacggcttttcttttttgtcttgcttcattctaaaataataacttcattttgtcttgtcttctgatttatctaattttaatatatttgtcccttggtttttataatctcgattagaattctcgttactataattgtcctataaatttagtgagatcaaagaatgtattgttgattttcgtcttttaagcatgaattagggggcttctttatagaatgtaagtatggtgttatccgggtagtgatgtgtgtgcgtatgcgtttaccatgtaataaaaaatgtctctaatattataaactcaaatgtaataattacttacaaataactgagaaaaaaaaagtaaattttagaaaaactgtaattatagtgagaaaactattagtttgctgcaacattagcatcatatttcagtttgttgtaattataccgtaggaaatcatcataaaactgtaactttgcgtagtatgtgtaggtgataacagtaagcttgggccacgtaaaagtatagttttgtaataattttgtataatatcattgcaacaaaccgaaaataggttattaatattgctgcaaactgatagttttgcactatagttatagtttttttgaaatttaaaaaaaaaaagatctactatacaccctccgtttaaaaataagttcattcgtaggaatttatatacaacgtttgacctttttcttatttaaaaattatttatgataagtattttgttgccattagacaataaaatacgaataattactttatgtataaattatgttttttaaatattttttataaaatatttaaataagtctagtggttaaacgttagatataaaaaccaaagtgaagatgtttttgaaccgagcgagtagatccaaacgccatcattccctggtgcggccgaaaccggtggtggtggtggaggggaccggtccaaacccgcggatgtcagcatccaccgtttcgcatcgcggattaactgtgttgctggaggcaggcaaggcatatgctgcgattccac

SEQ ID NO: 6636 - DNA, 1501 bp, Oryza sativa
taccaaatattgaaaacataagcaaagaataaacataaaaagcaattcatcttctatttatttatcattattactaaaataaaagctaaaataaaccaccacatttactctaagggaacttgcccacccggattcaaactctagacttggcaagacgtaccagttgacagcaaggcggctatggtggcttcattaatctcaagatatgtcaacccagtttttaggatgtgctcataaatgcgataggtttaaattaaaaaaaaaactgtagaaaaccatagttattatgacacgtgacatttaaccctagttattacggttttaaagtttcataaaatcccattattgtgggttttatgcgtgaatttactcaaaaatctaagatatagtttgtataaaaaataattattaagttttttactaaagttgatagcttaattcttcaccacttttaaaaaaattgtttgagatatgctgaaattcatcaagattttaataaagatggggtttataaaacattgagaccataaaacatgtgtttgtgtgcaacatgtcttagtacatgtgattttctgtaaatttaactatagatcatgtggttttctaaaatttactatataaattataaacacatagataatcattataaaccaacagatatcttagaaaaaaaggtaatatctcaatccacaaaagttgcacattatttttatcaccaagatcaaggagaaattaaattatcttggatatttcaaaatcaaggactaaatgtaaacatgcaatcaatgagtatttaaattactccttggattctcatcaaatatttaatttatctcttcatttaagttttaaatgcataaagtctataaataggaacaacttatgtggaaaaaactaaaatatgaaatatgtctaacttttgtggatggaggaagtattattcctcatcacaagaaaaaaaaagtcaatgcattatgcttttctaaataatctagattaattcatagttggacagatatgaccgcatatcaacgttaattactgccgatttgactgttgattaggcatatcttagcactaaaccttactgaaaattcggagaattactattggagagaagaaaaggcatccatcctccttgtcttcactctgcaatgcatcatcatccgccggaaaccggaaaaccaccgaagctcgaaaaccggcggaggcaagcagcagcagcatgcagcagacgcagagccttcctcttcttccaagcaaaaaatattcagatgacgcctcctcctctttcccccctcctccacttgcttgtcttcaggcgtacttgcccgcgagactcctaccactctctgatccctatatatacaccccctcctcccctctcgtctcctcaccagaattccaagcaacgaactgcgagtgattcaagaaaaaagaaaacctgagctttcgatctcttcggagtggtttcttgttctttgaaaaagagggggattaa

SEQ ID NO: 6637 - DNA, 1501 bp, Oryza sativa
atttttgaataagacaaatggtcaaatgtatcttaaaaagtcaaccgtgtcatacattaaaatatggaaagagtatataataatattctgcctcaatgattggtggatagcagtacatacatagaattgatacaagggctaagtgtaacatagaattgacacataaggcaagatatgtgtgagacgagtacattggaccttatatactatatactcagattaacttaagtttaaactcgaaagattgaagatgaacggataaacatatacacctcctattactcttaattaagacacattggtctagttcatttaactattttttatagtcctttaaatactaaagatataattatatcaaaatatttatctagacatatctagatttacattattgtgataattcatattttaaagtggagataatatttttaatgctaatcacaattagagtattttagtttgggatattgtagattgctttaaatatgaaagttatgatgacgtcaatttttcatgaaatatttaagtaacattacttcgttttgtgaaaaataatattattttaacatatcaatattagaacagtggtattttttttgagtgctaagcagaactaattatagtattttattttatgatattatagatctaatctaattatacatgattgtgaagtgatatatgatgatatgatctacattatctatttctacataattttttttattattgggatggcatgcgaaaggtactgatatgatttaaaataatagaggaattatttttgaatgttactaacgatttaagtgtttttatttttgtcatatctatcatatttaatttttttatgaatattttataaagtgatacttgatcatataatatacattgttgttttttctattttttttagcagtttcaattgcatcctaaggttaggatatgatgaaaattaaatattccttatgagttaaataatatagtagcttttattggtaaataatatagtagcttttattggtatttgaatgattgattaagcactatgaatacgacaatgaagaacgataaaaaagatttatgtgcaatttaaaggttatgattatttctctatacgaaaattatttaaaaaatatttttaattataataaacttgaaaagaaataaagagacgagaagatttgataggaggggggaggatacgtactcacgtaggggaggagggtgggctggtggggagaggggagggagatggattgtggtgttttttttttctaaaaataaatctaatagatgaaaattgtgggcctaccgatttattagagagccacgtagcagtttaggagcatttataggaatcccacatagcggcttgaaagtttttgtaggaagtttaatggacttttagtatataatagatagatagatagatagatagatagaagatagatatcacgtcgtcctaagtataacttctttaatgtttttcctgtgtaga

SEQ ID NO: 6638 - DNA, 1501 bp, Oryza sativa
acttaaaactctcattttcttttctaattttagatgtcactttatttttattttgaattttgattaatctcgtattgggttcttatatggactcttcttttaatatttcttatttttaattccgaatttcagctatttttaaattgtattcctacttgattatccttttatttttataattttggatttttttatttttatttcgaattttgattattctcgtattgggtacttatatggaaacttctttcaatattgcttatttttaattccgaattttagctatttttatattgtatttatacttggactctccttttctttttttctttttctccgattaatgtgagaatttctagcccccacagcgaacgtgatgcctcctttcaaagttgttttaataatataatagtttttatttcgaattttgattattctcgtattgggtacttatatggaaatttttttcaatattgcttatttttaattccgaattttagctatttttatattgtatttatacttggactctccttttctttttttttctttttctccgattaatgtgagaatttctagcccccacagcgaacgtggtgcctcctttcaaagctgttttaataatataatagatagatagatagatgtaaggaattagttacacacaaaatactacatattttatcatctaataataattgaaatataaatgaaattttaaacgaataataagacgtggcatataaacagtacaaagctacgttctttcttctttctggacggaggtagtggtaagtgtattctaaacccaatgactaggataatgtacatatcattaaataagtcgtcatctaaaaaatgatgtgacaagtaaataaatgaggaaagagaagaaaaccggtttttacacaacatccaaaacatcatgtgagataaatagcattaaattgaaatatggaatagttgggtttaaattgaaagagtagtgtcttgataatttagagtttataaaaatcatgtataatgttatggactggccctaaccacgccctaactaaaatcaatttactttcctaataatccacgcgtggtgcaacccagcgccgacagctcccagccgcagatctcgccggccgtcgcgcatccgacggccactcaccatcggcgtcgggggaggcgaaaacagcggctgcaattccgcttccaggtggagggggaggaggcccggtttgtgtgccacgccgccccactccgtccgtggtttgctacccaagaagacaagaagaaggaagtggcgaaacctcaccctccatcctccatcctctcctttcttccttcgaggaggaggagctatatatagacggggatggttcatctagcctcctcaccggttttgatttgatctgtgtgatttgagtgagtgagtgagattctttggaggagggattttggtttggtttggtttggtggtttgtgcgggattttgtggggaggagagtaa

SEQ ID NO: 6639 - DNA, 1501 bp, Oryza sativa
catgcatcagagcaaccaagtattaacaagaaacaaaatcaaggaagaagatgcataaaagcacataccctccagcttcatggccgaagatccgagggaacacgggagtctgtccctaagagattcagaagccacacaagaggcgcaagtcaaccacacattggagcagctatggatggataggaactgaagaagaggaggtgagtagataccttggcctcccagaagtagacgtcggtgtggcagagcgaggtgaagaggatcttgacgcgcacctccatggcctgcggcggcgccacctccacctcctcgatcaccagcggcttcgcggcctcccatgccaccgccgctgcacagatccagcaaaatcacccaccaatccaccaaaaaaacataatcctgaatgacatttttcactaaaaaaaaagatatgcttttctccacagcttctgcaagatcggtaatgttcacccaagaaaactctaaaaagaacacaatccaagaatttcatctacagcgccgctccagtaataaaatgcctaaaagttcgcccaatccaaagcaaaatcgaaccaagaagaaacagggaagggaggaaaagcactgacctttgcacttgatcaccttccctgcggtcgccattactctcctccccacaaaatcccgcacaaaccaccaaaccaaaccaaaccaaaatccctcctccaaagaatctcactcactcactcaaatcacacagatcaaatcaaaaccggtgaggaggctagatgaaccatccccgtctatatatagctcctcctcctcgaaggaagaaaggagaggatggaggatggagggtgaggtttcgccacttccttcttcttgtcttcttgggtagcaaaccacggacggagtggggcggcgtggcacacaaaccgggcctcctccccctccacctggaagcggaattgcagccgctgttttcgcctcccccgacgccgatggtgagtggccgtcggatgcgcgacggccggcgagatctgcggctgggagctgtcggcgctgggttgcaccacgcgtggattattaggaaagtaaattgattttagttagggcgtggttagggccagtccataacattatacatgatttttataaactctaaattatcaagacactactctttcaatttaaacccaactattccatatttcaatttaatgctatttatctcacatgatgttttggatgttgtgtaaaaaccggttttcttctctttcctcatttatttacttgtcacatcattttttagatgacgacttatttaatgatatgtacattatcctagtcattgggtttagaatacacttaccactacctccgtccagaaagaagaaagaacgtagctttgtactgtttatatgccacgtcttattattcgtttaaaatttcatttatatttcaattattattagatgataaaatatgtagtattttgtgtgtaactaattccttacatcta

SEQ ID NO: 6640 - DNA, 1501 bp, Oryza sativa
tgaaaaataattcaaagttagaaatgaggagaaaataacacatctccgagttcacagattcgcttggcttaaggacccaccaccgaggcagttaggttactttaggtactgaaatattgtcggtgaataaccgtttgacagttaattaatgaaactgccgtcacggagacttaggtgcagcttttaatgcaccataacactgtaattacctcctcagtccatgcataatcagtagaagatgcttttttttttaagtaaatttcacgaaactacgtatactttgaccaaattatcacacaactatagatttaaggtcgtatatcatagaactatagatttagcaataaatttatcacaaaactacaggtttaaaactaactatcacaaaactacatattttagaataaaattatcacaaaactacagattttaggatttagatcctttgcagtaatgtaatgtttgagttatagatatccaggttttgtgattaaattgaagttaaacatgtatgcttgtgataactttgttactaaatcgtagttttgcgatattttaccttaaatctgtagttttgttataaaattagtgttaaatctgtagtcttgtgatacatcatgttaaatctgtagttttgtgataatttagtcaaagtatctgtagttttgtaaaatttactctctttttttaccaagcaaactaagtactccttctgtatttaaatactccatataataatatatgctatcaaaatatttagttttataagtatttttacataaaattcatattgattgatttttctttataagtatttttaaaatattacagtcttttttatgtattaaagttattctaattaaaaaagtggttaaagttgtgaaaaaaacaaataaaatcaacggtgaatctatttaatacagagctagtagtatatagtgtacagaactctctttctatcactatttctagaaacatttttatattcatctacaaagttatatgtttcatagacacgctgcaaaacgtaccaggatggttttgtcatgttttaaaaatagagtgaattatttgtaattgcgtttattttttgcgctttctaattcatggtgtgtataccttttcgtttcgacctatctatatatatcttcaacttttgaggttaaattgtttttttaaaaaaagaataactaaagacacatatgcttaaacaagctgtgatgccaagttaagatggctaaggtaacttcttgatattattattttctacggcagtagagaacaattaacgtgtaaatgttgcgaaatagaatatcatttagtgcattgtacatcaaaataaataagtctttttgatcatagagaaagatacctttatctcctctaccagagaaaaaaaaaacctctacacattatttcggttgcaatggcctttccaaacatgcatagcttagctggatcacctctaaaaattgaaatcgcgagaaattgaagtgtgaac

SEQ ID NO: 6641 - DNA, 1501 bp, Oryza sativa
tgttgtcgactacgagtcagcacttcagaccgccaagtcgacaacagttagataggctaccccaaatattatactggtgtgattatggtgaataagagcaacgactggctttggccaacatgagtagggttattacctgacaattcagaggcccgaacctgtataaaaatcctcgtctccgtcttttttactacaatctcgcgtatatcctagtaccaacaattcccatactatgcaaataccggaatcgcgacatcaaacgtcgacacattgattattgttttctcattcccagttccctttcatgctaacaaaactttcgtgtatcctatcatataatcaaagtaatatttacatattatctttagaatccttttattttcaatacaaactattattcttttttttcctacaaagttccgcagcaacgcgcggggtaccttctagttaatagatagaattaagttgtgatgcaatggtcttcacgattcctttttaacttggtctcttttcgataggcttctctcaactgatcaacttcttttattaaccgaatccataaaaaaccgtaccaaatgttagcgttaacaaacatatgatcaaatgttatgtaaaaaatcaacgccgtcatacattttgaaaagaataatatataagaagtggccttttgtgttagctagctaagctaatactcctccgtcccaaaatataataacttatagtatttagaatttgtcccaaaatataacatcttcttcatcaatattctctccccaaccaatcacaactcttcaccattcaatttttccacctacctccacttctcaactaatcactagcgtccgatcatttaattttatttactttcttaataaccatgtcgaagacagagggagtagcaattatgtatcgagaaaatggcttatggaagatgcacacgtacaggtggaggccgcagagatagatggagctacaaggagcatatgtgtaccaaaaagagctacatgtatgtgtaataatccaaacaagcacgtagtacaaggagctagtagcacgcacatgcatgtagatgggtataaactcaatctctagctctcactggtacgtacacctcaaaaaggagcaaattaaacgagacgaacacacataacaggaagctagctggactgaccgggccgatcaataaccatacacacatgcatgcatggtgatcgatggacctagctagctcatcttttattccagaatacagatactactagtagtattggatacagaattcggctccacacacatcgacccaggtggcaaccggcgcgctgctgtatatatatgatcatcgatccgatcgatatagctcgatcacctcaccctgcacacgcacagtacatatatatagattagatgatatagatacttaattatcatacaaagccatgcgtaattatatatatttaacggaatatataggattagatgattaattacctagagcagtcga

SEQ ID NO: 6642 - DNA, 1501 bp, Oryza sativa
actaaattgtgtcttctttattgggttttgacgtagtggtatgtgagaggagtttcatcaccatgaaactcctttggctcagttacctagtttctggtctaggtaaccgtgtagtgaaactgtgcagtgagactggccttaattgatagagcaccgtttatttccaacttggaaaccattgcggcaggcaggctatgtacacaaatgccagcttgtgcatgtcctccctgtgcgaacgcgcaccgtacgtcgtcgtgcccgcagtaccgtggcatcatatcaaacagtgagttattgacgcaaaaatcaggcgatgattgttcacgtaagcatcacgcgacataggttcggggtcagaggtttgcttcactccaatgatgagcctgcaaatcttgaggttcggggcataacagtcaatttgacctgtaattgacaagggataaagagtgtaaaattcacagatcggctatgattccgaactgtcttcgaaaattatatcggctagaatcagccgatgcgtagtttaaagtccaaatccaagtctagatcggctatgcgcttaaaagctttgaagccgatgagaagctcgtaagtggactggataaattgtgataaaagctaaagcttaaaaaatttaaataattaatctattaagatttaacaaatatcgataacttggtgaacgtatggataaaacagagcaaagaaagcctataagacaactttgattggcaggacagacacgttcgataaattgtgtaacaactagatcaagacaaaacgatgcgtttaagccctaaatctagtatatacgataactcttaggagaaactagatcaaactacagcgatacacccggaagtttaaatctagatgcaccagataaaagcggaacttacaggcaagccggagatcaagatgatgcagccctgcttaacttgaaagaactcgttgatgaactactaaaactagggtttgaaaataaattgcaatgaaaagtaagaacttgtttgtttgattggtaggtaaagactttttacaaagccatcaggctattatttatagtttaaactaaagactccttgtcgactacgacttacaaaacttgaccgaaaaggaattacaatttcctaaaataaagactctcctaatacaagccgaactcttcgtggccccacaatgccatacgtcgactaatccttcagtcctttactggctacacgctacgtcggctccatcggctgcatgcttcatcggcctcagcagttttattggctatgtcagcttcatcggcttgctccatctttgactacattttgaccagtttgatgtaaaaaaggtgtcagcacatgccccccaatttcggaataaaatatggatttgttccgaaattctttcaagtcatgattgcaccctttcctcaattcttgcgccacacagcgattggtctcttgtgtcttgcacaaacgacgcctcgaaaatcgagccttatctcccaccg

SEQ ID NO: 6643 - DNA, 1501 bp, Oryza sativa
gtaaaggactgaaggattagtcgacgtatggcattgtggggccacgaagagttcggcttgtattaggagagtctttattttaggaaattgtaattccttttcggtcaagttttgtaagtcgtagtcgacaaggagtctttagtttaaactataaataatagcctgatggctttgtaaaaagtctttacctaccaatcaaacaaacaagttcttacttttcattgcaatttattttcaaaccctagttttagtagttcatcaacgagttctttcaagttaagcagggctgcatcatcttgatctccggcttgcctgtaagttccgcttttatctggtgcatctagatttaaacttccgggtgtatcgctgtagtttgatctagtttctcctaagagttatcgtatatactagatttagggcttaaacgcatcgttttgtcttgatctagttgttacacaatttatcgaacgtgtctgtcctgccaatcaaagttgtcttataggctttctttgctctgttttatccatacgttcaccaagttatcgatatttgttaaatcttaatagattaattatttaaattttttaagctttagcttttatcacaatttatccagtccacttacgagcttctcatcggcttcaaagcttttaagcgcatagccgatctagacttggatttggactttaaactacgcatcggctgattctagccgatataattttcgaagacagttcggaatcatagccgatctgtgaattttacactctttatcccttgtcaattacaggtcaaattgactgttatgccccgaacctcaagatttgcaggctcatcattggagtgaagcaaacctctgaccccgaacctatgtcgcgtgatgcttacgtgaacaatcatcgcctgatttttgcgtcaataactcactgtttgatatgatgccacggtactgcgggcacgacgacgtacggtgcgcgttcgcacagggaggacatgcacaagctggcatttgtgtacatagcctgcctgccgcaatggtttccaagttggaaataaacggtgctctatcaattaaggccagtctcactgcacagtttcactacacggttacctagaccagaaactaggtaactgagccaaaggagtttcatggtgatgaaactcctctcacataccactacgtcaaaacccaataaagaagacacaatttagtgacgcgaatttgtcacacgtctcaaatatgacttcagtgacgtatcggtacaagacgcgtcactaattagttcaccccggtcatatgccagcccaggggaggcatatcacagatgtgtctccacaaaacgcatcactggagttgacatagtgacggctcttgttgagacgcgtctctgacatgtgggtcttccagagatgggtatagtatgagcatataccagagtcgcagttttacaatccgcgtcactattgtggataatattagtgacgcgttattacgatccgc

SEQ ID NO: 6644 - DNA, 1501 bp, Oryza sativa
cgtcaaccacgacggggctataatttctccagccccgatcaccacgcggtgaatttttccccgtggtgaacccgtccccggttaaacaatatattcacagtcacagattgtagtatactcaccttgcatcgtcgctattgtagctttaggggggaggtggctgaaggccgaagccatggtcggcagatggcggcggcgacggcagttcccattggcgcggcgacggcgactcccggcggcacggcgacgacggctcccattgaagatggctgcaggctggcggcgcatcgacggagcctgccggccgctcctggtgaagatggcttcaggcgtcgcgcggcccggcggcgcgtcgacgaaggcggccggcgacggcagcttcagtctcccggcgagaaggcagcgagtggcggtgcgcgtggtggctggcgaacggcgccggaggtggctggcgaacggcggcgcgcgcggctcccggcggactggcgaccggcgacgcacgtgactcggtcgggtggctggtgtggatctggatctggatgggtggaaaatttggagtttgacctgttgacttagggttagattatatatgtgtctgttaaatgggcttcaatattatgggccaatacatctaaaaagtctataattcctcccttgtacagtacagtcgggtcaccgtccccgcccccgtcatcccgatggtgagaggtttttaaccattttattccccatggtgagtagatattaaccatccccgtcacgtaataggtgaattcactgcggggaaacggtgaacgggccccattttcatctctaatcgtgaatggactaacaccaccatcatgtgcatgatttcctctgcaacaagccccagttttgccgtcactttccatcacgacgtgttgttttcaaccattagatagcttaattaagctctaattaacaatccactagtagtttcatattaaaaaaaaaacaatctatataagtcctccctccgtcctaaaaagactcaattcctggggtttttatgtctaacgtttgaccgtccgtcttatatgaaatttttttatgattaatattttcatattgttagatgataaaacatgaataatacttatgcatgatttatctttttatttttgtcataactttttcaaataaaacgaacggttaaacattagacacggaagcctaaaaattgatttttttttttacggagagagttgcacctttttcgtgagtccaatgaaccgtcagcatgcagagatccgtatccaaacgacccctagctactcaatttttaattatttcgagaattctgcccatggtttgctggcaaatcaaatcgcctcgaaagaaaaaaaaagtcatgctgaaaggatcataaggattagaaaaattaccatggaaaaccgagagtacatgtacatacagacggccccggtaaagaaagcggcggatgagtcgaccgacgacgccaggcggaaaaccagcggat

SEQ ID NO: 6645 - DNA, 1501 bp, Oryza sativa
cttgttgcatttacatttgtgcaatttacattcctagagatatactagagatcttatcaccctaggattgctaaactagacttaggaagtgttttactttcctagtgatatacttgagccactttcaccctaggattgcaaaacataacttaattgcttagttagacttgtccctcaccgagcctagcaaattaggttagttttgattaggtgtcatttaattttaaatcgcctattcacccccctctagtcgacatctcgatcctacatcaggtcttcgggtctacttctctctattttggccaacttgatgaacacaccgacagcaccaccggagaatagcacgagaagccaattcacaaacctttatgggcctctaggatgtggatgttgtggcgttgttggcacacatttgaacttcagctacctgttaagaatccattgccagaggcacgaagaagattgtatgagagggagtatagtaggccaaacaggtggcctagcccaacacagcaagggcctgatggcaggcaaaggccacgacgcaatgaggacccgcaccatgtcagacaggcatgactactattacgacccattagtagaaaaagcgaaataaaagaacatagaaggaaaaaaatggagaaagtagggaaagtatggggaaaatttagtaaaaaggaggaaaaataaggaaaaatatgagtaatatatgataaaaatggaaaaatagggaacattatgaaatttgtaaggaaaaatagatgggccagttgggtcatgtcgtgccatgccggtctataggtggagttgttggcccaagcatgacacgggcaaaatgcgtgtgccgtgcttgggctggctacagtatggccgtgctcgggccaacccagcttagcactggccaactataagtgggaaagcggagaattcaagaatatgagagtgaccgattctgtcttgttgttgtgtggaaggcgaggtagttcttcctttgctctggtaacatgtgtgattcaaccaacgatgacaatcgagaaagcaagggtggttgtagttgatgtagcctggatgcaaacctagcaagggcctccaagaaggaaggttgcgacaatcttaccatgatagaagaacaaaaccacacattgaagaatcgatgacaaagatcatggaggaaacatcgtagttgtagagaacttgtcagagaggatcgatcaaccggcaacacctccaccacatgcctcacctttgttgcagatatgttgttccctaagcttcaaatggcattggtgcaccaagaagccacgggtcgatcgtcggatgtcagagaacagcccgacaactaccagtcgctactaggacaaagatggtggatgccagcacctctctgataggttgggtggtgggagggtgggggtgggagggtgggggtgggggctgaggagaaacaacgagatttacccaactttggaaccaccccgactactcgtcaggcatccatcca

SEQ ID NO: 6646 - DNA, 1501 bp, Oryza sativa
ggtcggatgtctcgagcacgcagctcgtcatggtactaagtgtctaataatgtaattatcacattatgtgaactagtggatctaagcatggctaaccatttcctaaaccaacatctaatcaaattaatacccaagttatcaatgacataagggaaacaatatatggccgagtaataggatccatcccacatgacattgtaaaataatgcaacatttaatagaaagcgggacatttgtaaaccaagtacaatatgatcaattgtaatgcatgacttgccttgctctcgcacttatgagacttctacaacgaacttgaggtatcgcggagcgacgaaacgaccggaatctatgtgacaaacaaagcacacaagcaaaacatgctataagtctactgaaacaggaaataaaaccattttaatggattctagggatttttatgaatttattgagacttaaatggacttaaacggagctcggatgaattagttatgatttttagaagattatctgtgtttttactataaatggaaaagccttaattgatttattgcacggtaatacctaggactgacgtcagcaaaggagggggcggtgccggcaagcgggccccgcatgtcagtggctcggggaggggggagtggcgccagctagtgggccccatttgatagcggcaccaggacgtcggtccaccgtggaccgggaccacgtgggcggtccaccgccgatccacgggaccgacgttccagatcggcctttggccgatcggacggcggcaggaagcagttgccaggctcggcctcggcttcaagctggccgaccggctatggcgagggcggcggcacggtcaccagtggcgatcggcggagcggaaggcggtggcgcatgcccgaagcagcggcgcacatgggagagggagaagaaaggagggggagggggttttccccggcgagcatggcggccggagcgggagatgaaggcggcagcgacgacccaccgacgcgaaggggcggacaggcgccgacgacacctaaggagagagcggagagggattagtagtggagaggacgaccacgacggcttgcatcgctggccagagatggagaaaaatggcgggctcaccggaggacgagggaaatggggttttggtggggttccggcgacgggaggcggcggccgaggtagctctcgcagcggcgaagctagaggcagtgttggcatggcgtggcggcagctctagcggcggttagcggcggtcagagatcgacggtgggcggcggagctcgggttggcgtgggaagagcgcgggagaaggcggtgagcgcggaaaaagagaatggggctcgggggaggcgttttataggtgagggagaggcggacgtggccaggagggtggcctattgcgccggcgacatggggaggtgcagagagagaggaggggattcgaagccaaattcggccattgcggggaggcgcgcgtgcgggaaaatcggagtagtgggca

SEQ ID NO: 6647 - DNA, 1501 bp, Oryza sativa
acgtctcgaaccaagttgttgctgcttgaaggtttgatcaacacgttatgcgttattgtgtatatatgcttcttgaaacaaatgatgcacttttggaagtttcgtggctaagcaaaatggagacctggtaaaatgcgtcgttttattaaaaaaaaaagattcttgtctggaatcagcgtgcgttgcatgtgggtcgatgaacgtgttgcccatgctatcccatttttttgtgagcccacaagttttcctctatctgtcttatatatatatatatatatatatatatatattgttgttgtttatggcaaattgtaggtcttagtatttaggttagaatatgaatgtccttatcaagggaagttatacaaaatattttgaatgtgtatatatgtacttcatataaatttgctgcaacaagtagaattgcttatgagtaatagaaagccatgcatgttatatcttttatagttgattttcaatgcacagagacagagctctggaaaatattcaagtgcactgatttaaatagatataaataagaattaagtattagcgttatatttctataaataatattatcatggtgcctagttacaagcttgaaatgatatctttgtcaatatcatgagccctagaaaatattcaataacaatctcggttttaggttaatttgtggcatttggttttgatcagatcatgaaatcactacatattaatggaagagcctgatgctgacaatacgccatgtaagaaagaacagggttactaatatattgtagtattgtactacggagagtgcctaaatcattgttgatcactttgatatagcttgaagccttgaagtgtgttgattcaaaacagttaggaacaattattacattagtttacagactacaaattctccttaatttaggcaagataataaacacatggtctacaaaaattttgatagtgtttttaagaattgtagttacttcaaattttgtaagcatgccaaacatatactctttccccccaaatagttacccttttgcctttacaagcttgaaattctattttgtcaggaccagatcgagccctgaaaaatatttgttttagctaggtttgtgcaattttggttttgattagattatggaatcactatatataataaaagtgtgttgattcaaaatagttatactagtgtattttgtctctgtgaagagtactaatccttcgttagtttatggaccttgaattatccttttaggaagatcagaagacggcaaataatccatacaaatttctgttctattttaagcatttcaataagtaaaactgttgtatagccacgctaattgcttgatttgtaatacaccagaacaaaaacgcttggagatttgtgcaacttagctttgttgggatcatagaagcaccatatatctgaagaaattatgtttatccatattatctactatcattcataccaccttgatctatcttcatacctctttgtctctta

SEQ ID NO: 6648 - DNA, 1501 bp, Oryza sativa
gtcttatttaaaaagtttatgtaattatcatttattttattgtgacttgattcgttatcaaatgttctttaagcatgacattaatatttccatatttgcgtaaaaattttgaataaaacgaatggtcaaacgttggtcgaaaagtcaatggcatcatacattaaaatacggaggaagtatatgttgcaattagctgtttttatcgagtatatccgtcccatgtctgcgtccaccactgagcactccatcataggttgaacaaccaaatactagaactatacgctatgtttaggtaagtaaaaatgcagttttccccgcaaaaaaaaaagagtaaaaatgcagtttcgccttaacaagaactaacatgttgacaacttgacatattaaattactataatatggggagaaatcaaagttgagtaccctagtttaaacctcagttttaaattgttaaatcattgcgtacatgaaatttccacagcttaccaaggaagcttaagcatgggaggcaagcaaatgtcaacgaacttagcgggttgccgttctaattaaaaaaaccggaattgctataacaatctttcatattttgattccgatccaactgattcggttgaagattcgtgcacagagtcatgaactccggcgacctcgacaaactagatttcagggttggcgtcggggtatttggggagagggggaatgacagggaggtggtggtagggtttaatttaccgttttcggaatgtatttcggggtaccgatttgataaaaatttagaaaatttccaccatttgaataaaattttgtcaaagtagtacaaaattgaccaaattcataaaaaatgaaaaaaaaaatccaaatctgtttgaaataatttcatgtatgggacgagtttctgcctcatacaacttgagccgaagaccgcgcggggggccaaggtccaatagaaaaaaaaatttccgaaattctgaaccctaagtggcggcgctgggcaccagaggacatgatggtggtgttggtgctggtcggctggtctcgccggcagtgcttgggggagggggaggggccaggagggaagaagctgcgactaggggtgaaaatgggtgggtacggtcgaattataacattttccatatccaaacctatatttccctttaagttcggaaccggatacgggtagtgccggataacatatcactcatctcgtatcctatcccatattatttcctttgaattagattcggaaatggatatctatttgtatatctaattcattgaaattatatatattaaggtgtatcatatcccatattatttcctttgaatcagattcagaaacggatatctatttgtatatctaattcatagatattaaatatactaaggtaattaaagtactaaaagagatacatcaagagacaaattatataatattacatgtgagctcataaaatagtgattagccgatcttttatcatgtttataggtaatagattttcat

SEQ ID NO: 6649 - DNA, 1501 bp, Oryza sativa
atgtgaatatagtcaccatatttcaaagataaatattttagaaattattcataactaaagattttaaagtttgacctcacccttatccaaaacgacaagtattatcagcccggagggagtaacaaaatttggttcacgtcaatcggatctaaaatgaattttctatgattttccaaattttcagcattttatagtgcataaataattaacagaaaaccttttctcagatttaataatttgtttataaaagaaactaaagcaaactgtcttcaatacgttttcctacagggaaggcgcattttcgttctgtgtaatcattttaaaaccgtggggtccaactaaactaaagtttgcataaattacatgtaagtcctaggccaacctgtcagtgtctggcattgttcggaaagaaccctatattttatcctaattacagaacaaggtccttcttgttcaacctgggcacaggcagctcggtaggcagaggcgcggcggctcgggaagggcagcgtcgcggcttttgcgcggctttgcagtagcgcgcgcagctttgcaggcgtggtcggggtcgttgtgctgctgcgtcgccgcacgggcagaaggagagagagagaccggcggcattggagtggtggcgaggggcggcggcttcgggttggccgcggcgggctgcgaggtcagcgcctgggcgcggcagggcatcgggcagggaagcaccagccttgcctcagctttgccagcgggaatcgcgggcagaggttgcttggtcggcttggaaacgatgacctcgatctcgcacgctaggtgctcgatgaattgcctgaaaggaatagagggagaggagggagaaagagagctgggagatggggatggtggctggcaggtggggccaatggtccttaggcccactgatcagagagagagagaaagggagaagggatgaggtgaggggatttttctgggaatttccaagaaggctgagagtttgattaatttttggatatgctacagtgctcaaatgcttgcgcaaaaattactggaggttagtgtggtcaagaactccacttggtgaatttttgggatttttctcaagtcctgtttatttttgaaaattaaaacaagtttactaatttgaatcaaattttggatgttttcatccttttaattgagttgcaaaacttttgagatttatggaagtttatttcaagtgtctaccacttattttaattctttttatttgttaatatttattgcatgcaaaagtgttatgagatgcaaatcggttgtttttttcgtccacacttaatgctccatacatgtgtctaaacatttgatgtggtggaaattttggaagtttgaagggagctaaacacagcctctatctataaatagctgatgcatgccagcttcagtttctcacatccctcacagccacagccatagaccatagtactacaccacatcttctcccctacccaccagcagttcccagccatgtctg

SEQ ID NO: 6650 - DNA, 1501 bp, Oryza sativa
ttattgttgtaagataagacgacgttgccgccgacggatctcgccgggctgcgtaggctccttgccaccgcctcgccacagtgaggcgtagagatcagcactagaagagaagacgtacgggaacaactgtggaggccatgcagccaccgccgtggtctcccacatcgccgtttggtttctctgtagctcaccggcatgacatcttcactggctgcctcctccccacgcagcagctgttagcccaatctgcctccgatccttgtcattgtcattacctgtgattattaattgttgattgatctgatatccgcctggtctgggatatggcctctagcgttactcgcttgtcgtgcttcctgattgttgatgtaatttctgatttgtagggatgcctaattgtgaggttgatgatgttatgttatcagtgaataattcttttatgaatactcattcatcgtaacaatacacgagtaaaatttatttttacgtcaaggtgtctaccaacaactcgattgacatgataaacgggtcgggagatcctacaagagagtcaacagcttctgccgccatcctcctttaggaaagatatgaaccttgagtccttgatgtactcatctttttttttttgagaagggtataactcaagacgcacacttacacacaccgcactcacaccatgacacacttacacacatcctccttcaggaaagatatgaaccttgagtccttaacgcactcatctttgaaaggtaaaacaaagggtatatataaattaacgatctacaacaaagatatatagaagaagctcctcgctcgcatgttcagtagtactccttgctgcaatagcccatagccaccacactattacatatgtaataggaaaaatgagatgacactatatgtgccggaaagtctagaactgacacctataatattttttccacccgaacacacgcctgcagggttctattcaacacaaacagcacctatgtggcaacatatgtatgctggatgttaataggaaccggcacctatatatattcctcctaaaatataggtgccggtttttttcttctaatcaacatatttaaaattagctatcattctagttttttgaaaaccggtacctattgagcggtaggtgaagctgagcggggtgggataagaaaccgaccttaaccattcacctctctcactctccctgtccttatccatttggcttcctctctccctctcccatctccctactctcaatccatcagcatattctatgatgtgaatttgtgactctttttttaaaaggattttgtgatttattttatggagcatcacctccgcttgaattaagacgagcctgttttgttttttcagaaatgtagtacaactcataggtgcagattttcaatctggcatcgatgagtccctctcatcaataccatctccgtggtgccggctgaaaaatctagctcctatatgggattccctactggcaccgaagtga

SEQ ID NO: 6651 - DNA, 773 bp, Oryza sativa
ctgcagcccatatcactgtatagattgaaaccgagaggagtgtgcatgggatctcggactcaaaccgagaccgagaagaggggtgtgttttattttcctttttaggggggaatcggatctagagtaagacttttttttatttttttcgctatttatattgttttgacgggagtcggacctgagagggagtcggactttttttttatttttttcgctatttattttgttttgacgggagtcgaacttatttatttatttttttcactatttttttgacggacgaaggaaacctctcttattttttaagtagtagagatagagatatatagaaatactatatataaaaaatttaaattcaaattcaaattgaatcgggtatgtaaacttttgacttataaactttggatatataaactttaggtgtataaactttggatgtatggaaatactatatatagaaaatatttaaattcaaattcaaatttgaatcagatataattcaaattcaaatttgaaacggggtatataaactttaagtctataaactttagatgtatagaaatactatatataaaaaatatttgaatttaaattcaaatttgaatcgtatatataaacttttggtctctaaactttagatgtgtaaacttgaggtgtataaactttaggtacataaatttactaaaatagaaaattgatacggtaccaaaaaaagaaaatcaggtggagggagatcgctacccaatcgccctggcaatcgctcgcccattaga

SEQ ID NO: 6652 - DNA, 454 bp, Oryza sativa
cgggtgagggggcgggcggcggcttcggcttccggccagggcggcggccgggcttgcgcttgggggaggaggtggaggcgagctcgtggttgtccatggcgacgagctagggtttcatgaaggtgggagaagccaatgcccgaaagggttggggttggctcggtcggtatttcttaggtgcgggtcgggtcgggttcgagccacaaggtcggttccaaaggagaaattggacatcctctgccatcgtaaaaagagggtttcctcatattcaccatttttcacgttttttaccattttctacgtttgatttgaccaaaatactctgagctcgggttcgatgggtgtggcgtggcattggtggggacggcatcggccgttgcggcgggggaaggggggaggggctcaggttgctcaccgcccaataggctgtcagcgataaccacgtggaggagga

SEQ ID NO: 6653 - DNA, 1501 bp, Oryza sativa
acgacacaacacgcatatactatactcgtcctataaatacacacgtattatatttctataggcatctcgagaaaactaggttaaaattatcatggacactttgttgtcgagggatacgtcgtctacaattgaaataataattagccgtaaatacaagtatctatgggctgttttcgattagcaccaaaacgtgccctaccaatatttgggtagtttgaacagtgttaatgaaggttttggtttgaagccaaatcattggcatttccaatgtccaatttgatatttttctatattctacttaaagtttggttctaaattggcctccaaccaaatacaactctaccctactaaaaaattaggtggtgccaaaatttacgtaggtttcgacactaccaatattttagtagggtattaaatctaacaagcactatatcaagggtatgacttgaagttgaacatgagtgcattggttatatcactagaaacataatgaggtgagctactataatcatgtactgtgggagtagattagtgaggagcgggtattggtccagaaaacaggggcgtatcagggtgtgtggtgcaaaaaggccggcccttagagtaggaacaaaaaattgatggctccccatgcttggcaacaagactgttgatgcagctgtgctccgtgctgctgctgccaaatttgatggtgctgtcgctgccacagctccgagagagaggccagtgcggaaagaaaagaaccaaaagcagctcacagtcaccacgccagatatacccatgcacacacatccacccatggactactactactactggtagcagctctcatctccacgctcacagccacaggtctgtactctgtaggactacagctgcgtgtccccctcgatcatctactccaacgcacgagaggagataaggccgcgtacagaaaacatgttgaaacacggataaattttgctgtgcaagagatggaaaagatctcgtgctgttgttgccgaatcgaatccgttggtacttggtacaatggtacgccggtcactaacctaacctaccccgtactgtacacttcacatgcgttaatagttgatcagtggatgttaatagtgaaatttggtaagaccggagtagtcatcggtttagagtcagtatcggcttcgaagtcctgagattagccgatgagagttgtcaagtcgtcatttatcggattcttgctatattcggttaaggaaattgatctactaaaggaagcttatccagaagagaccgagtttaaagagaatacggcatggtaagttatctattaattaggaatagtttgttagtttccttgtatctttaggaaagtgtgtttagtgtcctataaggactttatcttttccttttatccttaggaagctctctttcttgtccgacaaggacttgtatcaacccatgtgtataaatatgtacacccggggtctatgtaatctatcctcacgatcaatacaatttggcg

SEQ ID NO: 6654 - DNA, 793 bp, Oryza sativa
cacactggcgccgtgcccgtgccaccgtggcactagggctgtcgtggaggtgctgactgggcagaaagggggcgccaaccacactggcgccgcccctcataccacggcgccagcatagctggcgcgcccctcctctgtgggccgacccttaaaccccgtgggccccaccacctttctcctccccactcccattttcgccattcccagcccgagcagcgagctgctgttcttctccctctctctccccctcacctctccacctcaaatccactcaatttgaagccgtttttcgcgggattttttgtggaaatcgaagagaaaggtagactccttcattctcccctcttttttttcgtttttattggttgaatttgtagatcggtgggtaaccctagaaccccttttttacccaaatttgtgatttttagcatttgttcttaggattggcttgttgtagtgctacatgtttgcattgtactcattggtgtcatgatttttttaaccatatatgtggtaatgttaatttttggatggtttggttggatggatggatgaaaaattatggttgaggcatgacggaggtttgggttgtatgatggagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtaga

SEQ ID NO: 6655 - DNA, 1501 bp, Oryza sativa
ggccatcgcgtcaagaaggggcagatgcatctacgagcagaacaaacggatctcatcgttgatggagcagcgaatagctttctaatttgagttattgtcatctaatctcttcctaattcttttgttcttctcgtctatttgctgtctgtgacttgtattttccttttatgtatatagcactcctgagtattgcacaacaacgaccacagggattgagttcactttcgatcatgtatatcaatatatgcgtataaaataaatttttgatggatgagatgcagtcaacacaatagccactatgttgtacaaattagctttaacatcaactataaaatgacatggatacgagtggagccatcagctggctatactattgaccttgctcttaggggggtgtttagatccaggggtaaaattttgacgtttcacatcggattttatataggatgtcgcaaggggtgttcgggcactaataaaaaaactaattacagaatccatcagtaaaccatgagacgaatttattaagtctaattaatccatcattagtaaatatttaccgtggcaccacattgtcaaatcatggcgtaattaggctcaaaatatttatcttgcaaattaatcgcaatatgtgcaattagttattttttagcctatatttaatacttaatgcaggggttcaaacgttcgatgtgacggggtgtaaaagttttttttacgttggatctaaaatttttagtggtagtcttcaattcaaaacacgtccaatcacaagaacagtttaaccatcacatcgaaggtacagaacacaaacatcgacggatccaaactcatcaacctgaccccgaatcccactgccacacgggccccaaatcccacggcccacatccccccacccacaccacaggccgcggatacttcactggattcccaatccgacccaacccaactggcacgccaggcacaccaagtaccccaccaccaaccagggccccacactcccaaactcctcccacccgcacgccgccgttgccacagaagatccacgcccagttctacgccacctatgaacacgcgcgcacacacgccgcgcacatacatgatcaaatctcattcgctcgccaacgccgcaagatcgagcgaaccccagcgaatccgagcgcccacgcagccacatcccatcattattccgcacctttcctcgctttccttcgcacactcccggactcctctcctctcctctccccatcgcgaagagaaaaaaaaaggatagcaccaacaacaacaacaaacacagcggaaggaagcagaggcggcagaagagtcaggcaggcaggcaggagcagcgaataataaaggggggtttttattaggagagtagtagtagtaacaccacgatggaacgagcgatccaaatcctgaccagttcggatcgagcggtggaagaacaggtttggagtggcctcccgtgttgctcctcctcatcctcctcctcttttctttc

SEQ ID NO: 6656 - DNA, 288 bp, Oryza sativa
cccccctcctccctctagtctctcatatgtacatcatatgtatatactatatatatacgtgcgtatatatatatatatttatgaagatatttcaatacataaaaaatatatacacacatacacaaagtttatatacacataaaaaataaaaaaatacatcatgaatagaaagtttgtatacgcgtaaataaactttgtatatgtgtatacaaactttgtatacgcgtatacaaactttctgtatgtacgaatacaaacttggtatttatacatcttgaaaaaaaaagg

SEQ ID NO: 6657 - DNA, 1372 bp, Oryza sativa
aaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaacttaagacagtggaataaagcagagagagaaatcaaagcaagaaagagagagaagaagcgaggcaagagtcaagaccatctcccatggccagtggtgatcgtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgc

SEQ ID NO: 6658 - DNA, 448 bp, Oryza sativa
caatagcctccccctccgtggtagcgcggtccagttctcgccgccagttgccgcctcgccgcgccgccgcatagggtttgcaaatggggagcggcgcgagggagccgagccagggagggatgggtcatggagggagagcgagagggggccgtctggaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgggaatcatggtagctccgcccatggggtatacagtaccgaaaagaaaattatctccacca

SEQ ID NO: 6659 - DNA, 1501 bp, Oryza sativa
  unsure (1)..(1501): unsure at all n locations
ccaatattaccccccaaatcaccgaaccggaagggatcatcaaaccccagaacgacacttccgcacagccctagggtttctgttcagcgaccccccgaatcgaatcaagagggaggtgccatggcgtcgcggccgtcgctgaagccgaagcccaaggtcaagggcgcgaggaagggatccccggcggccgacgaggagcagtccacggctgcggcggcggtgcggttcgtcaaggagtggaccacgtggaccatgaagaagaccaaggtggcggcgcactacggcttcatcccgctcatcatcgtcgtcggcatgagatccgagccgaggccctccctcgcccagctcctcagcccggtctgatctgacgatcgccttcaagccctagatgcgatcgatctgcccccctttactaccgctttagtagtgactttagtaatagttctttcttagatcgtgccttctgagcagttgatgctgctgtgcggatttagaggtttttgctatatgaatctaataatgttatatgggtggatgcttctttggattaaactcttgctattattgtgcgggtcatggatctgctattaatacttcggtatggtatggagaaattttctgtgttatttgtatattcctactccttccggttccattttaattgacgttttggacaatgacacggtctaaaagatatttttaatcttacttttctattataatatatgttgttctagttcctttaaactaaatattttttaaagttattaatggtcaagttataaaagtttggcctcaaaccggagggagtacatgtttatgcttctgtgtgacctatttagctttccgatccgttctgattgaagtattgaactactcagaaagtaagcatttgctttcctttgcagcgttttgtgtgatgatctggtatacagtataagcctaaaanntnacatcacncnnngttgcnnagnnagcaaatgcttactactaatcacttataattagtgacataaaactgggacaattattgtgtgtttttgtggatgtggataacttgatttgcaaaacagcaagctcgtggtggcgaggaaagattcagaactcccattgcctaatgaattgtggactatgctagcagcgaagtggatgcgaccagggttttcgatttgacgaaagccgatcgaataccgtgaaaatttgaggttttgacatgggatgcaagtagattttggatgaaatttcaaatggttctttagaattcaaatttgaaacaataattcaaccagaatttgatcaaaacaaccatcctcaatttgatcttactgcgtttttctattgatttttatttataggaaaaaaaacctgccaaacacgggcagatccaatttacaataaacttgtccgtgagcattgcaagctaagtttcacaagtgcaagtaagaaatcagtcgatttacttcacaatgtaaaggggcttaatatgtgtcacttcatattg

SEQ ID NO: 6660 - DNA, 1501 bp, Oryza sativa
attttgaataatgaaggtgctatacttctttatattgtttgatcttcagacaactcatcaatcaacagtcttggaaaaaagcagccataatataaaccttaattgatatagtggggtatttctataattaatctaggaactaattacgttatcatttatctctgtgtttcctcattatcataaaaatggcgaaaaaaggagggatcacctacagattaatttcatttgatcagcacatactcgaatccattatctctactacgtaccgtaagagcggtgccatcctcctgccagaccatcgctccttttccactaaaaaaaaacatcctaactcgaaaataaccaacccataaaaaaacagtatttccacgtgaaaatcaatcgactagaaaattaattagatagacgaaccacagctcatagaatcatccgtgtccatcttcctctagaaaaatacagttttcaggatattcatccctaaactttctctaaatatatatgccgacgattaacttcggcaaaagaagtgatcattatttcactatatgaaaagcaagacaaaaaatatcagtgatgagttaagtcaaccctccacgaaatcaacagaaattaaaaacttgtagacgtacatgttcgatgtagacacatctcacagatacacacgcatatactactatattttttgccatgttattcaattggaccatgaggtcaatgctagattgtgtagatcagaaggcaattgcaatgaacattcttctcgattttttttagacgtacgtctttcttctcgaatttttttttgacgtctttcttctctaatttttaaccgaatgaaatatttgtccttaataagatgagagtagtttggtagctgtgcactgtgcaagggtactgtgacagccgtacgtccaatatccaactataaatatgtacagctgtatatacgtatggatacatgtcatccttcaaaacggtacttgtgtggcacgtgtatgtcaagaaagagctgtagtgtactgtgcaaatcatttaaaatcttgaagcatgcctgatcatgcataaacatttgaatcgaaattcacatgcacagtttcgaactcttggctggatccccgtagatgtccgttaaaacgcggtggatgtaagtgagttacattgctcaaattaatggacacaaaacatgtacatagtatatgcatgctatgcccaatatataccaactccaaccgggaaatagtatcttaattcagcatacagtaagctgaactgtatggattcaactattcatagtacggcaggccctacacaatttaattacgttgacactggccggtcttatacctaatacctccctgaccaacagatgcgaaaagaatctaaattaagcacgctgatttcattaataaaacgtctctaccattaagaattgacgactagctagctagtatatatgtgtgtatatatattaatagtactgctggaattatggagtattata

SEQ ID NO: 6661 - DNA, 794 bp, Oryza sativa
gacgaaattgaatataacgtgttagttcagttaccctgaattatttgataatcaggagctgaatagatcacttgagatactgacataagttatatatgtttgatgcttctccccatttagtaatactcctagtacatgcttaattctaaacttgtcaccatagatagttgatgccttgtatggccaaattagtggtgttgctagcatacaatatttggacaaacaaccttacaaaatactggagtgaaaagcaatgatattgtccatttcacttgattaaagtggtgtccttgcacacagaattttagataatatggttagttcagttaacctgtatgatttgataatcagattctgcaaagataaactaagaagcatcttataaactatatatacgtttctcagcatcatggtagcaggtgccaggacatttgggtttttggtcatagcaatttaatttctaggtctaaattcaggtatatgaatatttgcatcctaacgacattaaaaacagtgtgcgtgtaaaaaactaaaaattgaacaaaaggtttataacaagtgcgataacatttactcccctgtgctcccccccccccccccccccccccaaaaaaaaaaaaaaaaaaaaaaagctcctagcatcccaatgtggaggtaaatgagttggtcattgggtaggtaaagggtattgaagggataaaatttctcaatttgagaatcgctggtaggtaagaaggtaggaactgatttattttgggacaaagtttgaactctagaagttggtttattttagg

SEQ ID NO: 6662 - DNA, 1501 bp, Oryza sativa
aattggtttacaaaacctgaaccatactaagttccatacttctatatgatcgcgcccgtccgtctccgaagtcgaatccctcttatccatggggacagctgaggtagggcccaacatgagaaaacggcttccaactgggccaggcccaataggggaatcagccacgaaaggaaaaggtgtagtttgacttcctcaatcaaatataattcggatattattcgtatccttcaaccgcaaagtcgggtatatcgacatattcaactattaaaatcgagcaaaacaattcccttggctatttggtatttgctcatgtggcacgttgaatttgtcccacctatactggtgtggtaacctagacacaaaatagaaagagttaattggatccatgccattattattttcataattttgaaagatacacatactattcacctatttgaactcgtgccactataattataacgttattcgatgtatgccactaccacttgtggagaaaccatctttggtcagtcgaccagatgtcacaatagtcccggttgtattaaaaaccgggactaaaaacatctttagtccaggtttgaaagctcagaggtattttttttatatttagtactggttgatgttaccaaccgggactaaatatctatttatagtctcggttgttaacaccaaccgggaaaaaagatcgatataagctttactcccggttgatgttaccaaccgggactaaagatctacttatagcctcggttgttaacaccaaccgggaaaaaagaacgatataagtagagtggatgcacgcggatcggatacaatctcctcctcttctttaactcctctcctcacacagtcacacccttatctcttcctctccctcctccctcctctcctcctctccctcctcccttctccctcctccccatctctctctgcaacggcgaggcgcggagggctggccggccggcgcggcgcggcggcgggcggcacgccggcggccgcgggcgtagcgccggtggctgttcgtctttttctattctttttttttgtagaatctgtgatttggatttgagatttgtgtgtgatgtgaatatgtgatgaattttgtagaagttgtgatgtaatttttttaagattttgtgatgtatttggagatatcgatttgagaatttggagactattcggggatgattgatttgggattttgggataggatagagtgaatcaatatattaaaaacaatgaagaaaagaaaagaataaagtagcaatcggatctagtctctttagtatggatttttactcccggtttttgcacccgggactaaagatcactatctgatctttagtcccggttgaaaaaccgggtctacaggttacgaaccgggagtaaaaacatcttctccaccagtgtacttactctttcaacacactttctaaaattttggaccaaactgcccattgtcttcctcctccatccctccgctgttcatcttccctca

SEQ ID NO: 6663 - DNA, 1501 bp, Oryza sativa
actaaatgtagccacttttttggcaactttatcaaaacttggtaaggttgaaaatagcatcaaagtgaacataccctaaattgtcgaagagtacataacaaaaacaaaggaatctaaacttccaagaatattacttgatcaggtggaagagggaatcagccacactaaattgcatagtgcttgcgtacttaactggcaatgtgctttccatagaatgatagaagtggagaaaagcaacgtgcttacatatttataatatgagtccaaaatccaaatgactatgatgctaatatgttgtctatttcatgtacatatgagatgcaaaccgctctcactcagaagataatgataacaagaccgtacctacggctatgatgtttttttttagataaatgtgacaaacatgggcaacacttgtgattggtggggccataaaataaagaaaaacaacaacttatgataaattatcaacttgtacatatatgcctttaaaatgggtagaatcagctgaaagtaggtatatatagctagttataatttgatttagattttgcatatgtatttaatgcattgtaatacaatttctcattcacaatatatgtgaagaatgtgaacgtgtaactttagtattcagataaatcttactgtcctagggtcctcgatataaatactacctctatcccaatttgatcaccgcctaagatttttgaggttttcgtagattgatcattatctaactggtggccattcgtttatttgtgcacaagtaaatcgcctaagatttttgaggttttcctagattgatcattatctaactggtggccattcgtttatttgtgcagaagtaaatgatatcatggcatgtctatccatttatttgtgcatgagtaaataccattattacatgtctattcatttatatgtgcaagattaaatggcatcgttgtctacatgcatccctaacacaacaccttatcaatgaggttaaatttcataataaatgatactttattgccttgatattggtgctatttataaatatgatgatttactagaaaaaatgcccgtgcgttgtaacgggtgaagtatattttaattttattattgttatatatatgtctagttaagatgaaattcactgtggagtttgtttgaacatatatatatatatatataatttgattactcagagataatagggctcccttcggatttcacgggattgtttttttcgaattaaaacgggtccgatcgatactcccatagttagacccggtagcgggagtgggaggatgatcatcctggtggggcgatgaacggtggatgggagagggagtacgtactcccgggagtacagaagcattttcctatatatatatatatatatatatatatatatatatatcatcaagggaaagaaaatttgaaaaaaatccaggtcgctccgtcgcactgcgtaaacgacatacagtatcatactatcatatgcataatcacgtca

SEQ ID NO: 6664 - DNA, 1501 bp, Oryza sativa
cacacgaacctacttggagtcgttcacgtgatggctgaagtctgaactctgaagaggatcgatgagccagcgcaccgagcaacatactgtacatatgccatatggtcctcttgtctgacgaatactctgaagagtttaggtaggcagtaggctgccgtgccgcttggaaaagcatgacgtgattatgcatatgatagtatgatactgtatgtcgtttacgcagtgcgacggagcgacctggatttttttcaaattttctttcccttgatgatatatatatatatatatatatatatatatatatataggaaaatgcttctgtactcccgggagtacgtactccctctcccatccaccgttcatcgccccaccaggatgatcatcctcccactcccgctaccgggtctaactatgggagtatcgatcggacccgttttaattcgaaaaaaacaatcccgtgaaatccgaagggagccctattatctctgagtaatcaaattatatatatatatatatatgttcaaacaaactccacagtgaatttcatcttaactagacatatatataacaataataaaattaaaatatacttcacccgttacaacgcacgggcattttttctagtaaatcatcatatttataaatagcaccaatatcaaggcaataaagtatcatttattatgaaatttaacctcattgataaggtgttgtgttagggatgcatgtagacaacgatgccatttaatcttgcacatataaatgaatagacatgtaataatggtatttactcatgcacaaataaatggatagacatgccatgatatcatttacttctgcacaaataaacgaatggccaccagttagataatgatcaatctaggaaaacctcaaaaatcttaggcgatttacttgtgcacaaataaacgaatggccaccagttagataatgatcaatctacgaaaacctcaaaaatcttaggcggtgatcaaattgggatagaggtagtatttatatcgaggaccctaggacagtaagatttatctgaatactaaagttacacgttcacattcttcacatatattgtgaatgagaaattgtattacaatgcattaaatacatatgcaaaatctaaatcaaattataactagctatatatacctactttcagctgattctacccattttaaaggcatatatgtacaagttgataatttatcataagttgttgtttttctttattttatggccccaccaatcacaagtgttgcccatgtttgtcacatttatctaaaaaaaaacatcatagccgtaggtacggtcttgttatcattatcttctgagtgagagcggtttgcatctcatatgtacatgaaatagacaacatattagcatcatagtcatttggattttggactcatattataaatatgtaagcacgttgcttttctccacttctatcattctatggaaagcacattgccagttaagtacgcaagcacta

SEQ ID NO: 6665 - DNA, 1501 bp, Oryza sativa
tgcgacatcggtgcacagtaccacattggttctgcgggccagtcacgcggcaccgcatatgtgcgtatactgcatgcatatgcgtaacttggctgttcagtcgtgcgccccgcgtcgcggattgttccggacgttggtctcgcactcccgcgccttcatgctgtgtaaaataatctgtcatttttgaactgcggaatgcgtatatttcgataaatcgttcaaaaccttttataatcgtacgtaaaaaataatgtatatttttaaattttattctagccgcaaatgctccgccgccacgccaccgcgcggtcattcgcccgcctctagtcctctctctcctcctctctatagtaagtagtacatgtataattgtatatacgtatgtgtgtactatacgtatgtataaactttttatatgtatatatatattacaattttttatatgtatacacttttactataaaaaaatacatgtatataaaatttatatacgtatttttataaagtttgtatatgcccatataaaaaagaataatacacgtatataaacacatatacaaaatttgtaacgtattaaaaaaccaaaaagtgggaaagaaaccggagaaaatatcaactttgtatttatatttgtatatatacatataagaaaatacacgtatataaagtttgtatatgtgtatacaaactttgtaaacatgtatatacacgtaatcacgtatgtaaactttgtaaagtaacaaaaaaccgagaaagaaaaccggaaaaatggaaagagaaacggagcgaaaaatagggaagcgcgcggcgtccgccgcccctctttgcgcgcgacacgtgttcgcgcgtgggggtgtgtgtggtgggccatatgtggtatgccgtgtgcccctgtcgtttcgaagataacaaattaacggcaaatataggggctcctacgtctttccagccacaatcaccaccgtgtaagatcgatccaacggcgcatggagaagaggccgcgagatcgctaaaattttccccatttcccgtcgccgccgccgccgccgccgccgctcgccggagctgcgccgcctcccgatcttcccggtccctctcctcccttccagaagcggccaagaccaacggcctcgcccccgctacgtgagatcgctggtgccctcgtagctccgatccagcctcgcccccaagccaaggagcgaattcaggtattgcttcttcttttttctccccagattgctgtgcacggatttgccgtaagatgggggaagtaatttttttggagcttccagtaaagggtctgattgcctgacccttcccttgccatatcaagaacgcggcatcagcatgttctagtattcgtacagattctagcctgaagctgacttttgatgatggatgattcctgcaaagttgcttgatgtttttagtgactgagttcacactatcatattgggtaattaacttgggtaaacttcatcgtcggtcataatgtatcatc

SEQ ID NO: 6666 - DNA, 1501 bp, Oryza sativa
aaaatcatattaatcatttttcaagttttttatagataatacttaattaattatgtgttaatcttaattgctccattttccgtgcggaggggagagactcccaacccctccaaaggaacacagccttaattcgcagggaagttagcaactatatttatagtagaccttctcctgcagtctaggcaatatcacttctatcagaagcttctcctacagttggtctgctacctgtgtcaaccaccaagttcgaactaacaaaagccaaaactcgtcttctctttcactcccacaagttattaaaccttattttcagagggcaagactcagagcagacatcagaccagaattcaatgtgagaacccatacctacaatcaattgacagttttgtttcacccaactctttaattgagtgtaggcttttccaaacctgagaaccccccttctgctcatattggaaaaaacctttctcacccagatatttctttcgcaacagctctatgcaaggacccttatcacctgactcttaacttccagatccattttccaagcaaaacaatgttaaaacttcttgtctctgtgaagcccaatctcccaaactctttaggagagcacagatgttcccatctcatcatgtggtattttctttttctacccacaccagcccagtaaaacctgctcataattttatacatcttaaggtggatacctttaggtaacagatagaagcccattgtgtaggaatgaattgcagataagcaagagttgattagaatatccctacctccagaagaggggttagacttccaaactcccaatctcctctaatttttgcggtaagaacataaggtcagatattagcaccttatcagggcagatgggtaagcccaaatatttcatggggaaagatcttacatgacaattaagcatattagcaactctatccacctctaaacctacagcagacacttcactcttgtcatagttaatgttcaaccctaacatttcttcaaagcagtaaagaatgaacttagtaacaattatctctctgtcaacacagggaataaatatgattgtatcatcaacatattggaggtgggtcaaaccccctgagaacagatgaggaactaccccagatagtaaaccattttattaggattatttattaatccttaggctgtttatcttcaagacctttggtcttatgtaacttatagcttttagtgtaactctccactagctttaagtatgactcttggtcttatgaatcattaagtgtaactcagctatatatatatgagaattctcctccacacattgtgagaggcatccattccacttcctctacatggtatcagagcctaggctcttaccttcttttctgctgctccagcgcgctgctgtcgcagctgcgtcctccctcactccggccatgtcggctgaatcaactcagtcctccacctcctccgcctctagtggttcttcttcttccagcaccaccag

SEQ ID NO: 6667 - DNA, 201 bp, Oryza sativa
gggggcgttcttgaccaacccggccctgccccgccccgttgccatccctaatctcgcggctgcatttgtttgtttcagagctactaaaaaagatttcacgcgctacgccgcgtggatacagaagcaggttagcaggctgactatgcttatgtttatggacttatcagccaaaatttaaatttgaagtttttttctttaaga

SEQ ID NO: 6668 - DNA, 1501 bp, Oryza sativa
tcacatgtttgatcattcatcttattcaaaaattttatacaaatgtataagatataaatcacacttagccaaaattctactcaggaagactcacagaagccaaaattcagttagtcactacttagcaaataaaggtagatgtgagaacctcaacaaggtttggtgcggaagtgattgcacctttgtatcaaatcttgtaagaaacgatttgattcctgagtaatttattctctttttccccgcaaaaaaaaatcacacttaaagtactatgagtgataaaacaactcataacaaaatgaattataattacgtaaattttttgaaaaagatgaatggtcaaacatgtgagaaaaagtcaacggctgtcatctattaaaaaacggaggcaatacatgttaacctatatcagaccgtactcgggcttattcgtatggtgttctgttatacaaaagaaaattgaacaatggaatcaagcatgatattttgtacagaatttttttcctgtcaaagtatcattgtgatgctgttgtgagatgtcacgtagcgttagcacggacatattactagtatagacatgggtattcattggctatattttcgggggcccatggggacccgcgggtggaattcttcccccggccccgaacaaagtcggggccctgccccggtcgccccgtgggtacgaaaccagtcccgaccccagccccataggggcagggacccgtcccctacgggtccccgcccctaccgggtaaattgccatccctacgcgagatacgtgtacagttggtattaattgaagcaactaatatatgtgttgcattgttgcacggctgagaagatttggctggtcattatcgattgatcagagcaaatattaatgcatcactttgtgactttgtgagaaaatttttgactctttaatatgttctgctactattatagtgttagcactatcctgctgaaaaagatataaggtgtacagccttcaatttacagtttccagtgttaaactttaatataactaaaatttctaaatatattatcactaaccaggaaattaattgaaagtgatacaaatccaatacatggcacctatgtgatgctaaatatcttacccgctccgttactgaacaatgcacaatcaaacttggcatgacctacaaaattaatctttgactttaaatttctcatataatataatatttatagtaacaaaataataattataagaaagcaaattaaaatatcaatccaatataatactattttcatcaaataaaatttaatttataatgaaatagttatgggtcagatatttaaacaaatgaatattagaatacatgcgtgtcttattcaatgagatggagggagtagtattttcacaaaaataattggtattagcttaattatttttgaaaaactacaaatgtaattttctccaaatacgtacgttacttacgcgtgctcaacgatcgtgctaggagctagcggggctagg

SEQ ID NO: 6669 - DNA, 333 bp, Oryza sativa
aggaatagttacgattgaagtggtagatctaatcgacccggcaaatcaacacaccaactattgggggctctgaatctatagtcgccgactaatcgagcgaggactagagacaaggtgaatggcacttggtaaaattcaactaaacaaaactcaaatgtttttgaggatgaacaaagctatttatagaggaaaataaagctagggttcagtgctaattcgtggaggtggagggtgacactttcgagatgagcctagtctattacaaggcccaaggcctaagttcggtttcagcaacagcactgtcttgttttggcgattcccgttgactcgaga

SEQ ID NO: 6670 - DNA, 1501 bp, Oryza sativa
ataaaaatacttagggtactgactagtgatgacaattttggcctgggtgccaagcgataagcaagcacgcgtgcaagcagtcactatatgtttgaccaacccatccttctcatcagttacgttaatcatttgctgtgactctctgcactagctacttgactgaacaaaactacacatatcgattgaaacatcgatcgatcagagacagtatatactccatccgtctcaaaatataaatatttttagactatgacatggtctccgagatactactttgaccaacaatatctataaaaataagatgttttaaataaaaagagttgtatatttgatagtttgtttaatgataaatctagtaacatcaattttacatgattgatcttttttattttttttttgctattaatggtcaaagtttaaaatgtttgacttatcattatgctaaaaaatacttatattttagaacggagagagtatatatttctgagctaggcaggagaacacgttaggttaggccgggtgacatgttctccccggcatagatagcactagaaaacaaattgatctgtttgcattttgtatacatgttgtgtaacaagacgtgttcgatgtgtatatattgattaattatcagtttattgtattggctaatgtatattgttgggtgaaagctacttgacgcggttggaccgaaagctctagctagctaatcactacgtgcctgataaaaggcgtacatttacgtgatccgggataaagaaaatgacaggagctcgatcaggagaatttaaagcagagtgatttgcaacacgtacgatattcgatatcaagctaattaattataagtaggagtatgtaattaaggctactgtagtcggtagttttccgtgtgtcgtctcgacatataatgttatcaattagaaggaaaataaatgagctaattaagcatatatatatatatatatatatatatatatatatatatatatatatatatatatatagctgagacgacgacgattctcgcttcgcttgtactactcaaactccattgctcagagtggatgatcctcttgcaataatcaaaataaaatagtaaggaacgtgtgcatgcagaacaaaacgaagaaggcaaagagacaaggaaaaacaagatagagtattagttttgtcttaggatccatcctcaggctgtcaggcaacacaccagtactgcagatcgatcatgtgcacaccccaacaattgcaattatcaataccatacgtacgacacagcaaagtactgtactgcccactgatcatcatgcatatcatcgatatcactcgttatatatatatatatatatatttcagtcccccctcgtatatatataatgaccatgcgagcttctgattgatcgatctatatatatgatcgagatgcccattacaaactagctaagctagcagctggtctctctcttgatttgtgtttccccagagagagagatctagggagaga

SEQ ID NO: 6671 - DNA, 1501 bp, Oryza sativa
gatactaaacaacctgttggggttgcaccatgatatattgatactcctacataaatgtaacaccacttgtacagtttgttttgacaatcaagcttcagcaaggatagctgttttattttatggttttattatagatggtattatataccaaaaagttccatttacatacacagtacctgagagtgcaatcatgtcagttgcgcttagtcctttgtttgaaaaagacttcgtgagatcaccaaggtcaaaggttggagctggaatgtcattgtttgcagtatccaggcttgctgttgttgagtcgcgccgtcccagctggacaacccaagtaggacctcctagctgaaaaataaattgtcggttttcatatgtcactactgattgtattttataaatatcaattaatttattttactatctttggcaacttgacttttaatactttgtaaggcttgttttggtatagaatttcatagctatacataaagagttatgttttgttcatttcagttgctcatcttctgacgtcaggagttcctgttaactttttaagacagacaaataactaacttttagtttgatatcctttgtattttctccccttaccgcaacaacagattcgcgtgccgccacagcaaggatgtcagcacatgagaccacctgcggacagatcccctcaatatgtgccttgatgttgtctataacatcaaatccacgcagagagttgttgtttggagcagcggtcttctctccagtgaatgttggagtgtcatctagcagcaccgagccatcacaaccctgcattgtcagaatactgaaggttattacgtaatacttagaagtgagaaaattttgaatatctctgcaggttcaggacactttcattgacaaagcagtcgtggaagtggaggcggagcaatgatgcacccatgcggttctcccttgcgatggcagatctcacggctattcggatggtgggcagtgcattagggcatgatttgtcatagaaatttgcgctaagctgagctgacaccaagtttgcagcaaataacaaggcaatggcactgcaagcaaagggtttaggggaagccatttggtttggaggcttgagtgctgttgctggttgccagtcaaatgtacacgaatatttataggcagaattctgtgcacgtgctcaatttgtcatatgtatattattgtggctttgtaattctttgcattttgttagttgatcttccttttttttgtatcaggctaattaatggaaaactctacagtcagaaagtgcatgcaagtggagaggatcagatgggggcatgccaacatgacaagataccctttgtggtttggtcttttgatccctccactaagatgtaaccatctagaagaattactgaaaaaccaaatggatagctctggagactcgaggtaaatattatccatgaatgcacatatgtttgctcccttttagtataaacaagattgtgtggttttgtacctc

SEQ ID NO: 6672 - DNA, 1501 bp, Oryza sativa
ggccatgtactttgattaccatgatcgatcatttgataatgagcagcttgctaactgcatgtgttagcctagctcccttaggaaaaaggggaaaaaaaaagaaaggaacaactacaaaagacacacatatatacatagtacaaaaaaccagaccggaccgacggttgaaccggaaccagaggtctggatggctcggtttgctgtaaagaccgcccctgcatttgaaccggaataaaccgcttgaaccggatggttttcatgtgaaccggtgaaccagagagaaccgagccggccggtttgtcatgccaagagaggatgggccagtcaatgccttgtgcgcgcaaagatctcaaggcccacggtgaatgtgtactattgaaaatagcaagaaaaatgtggggaatggggttcgaaccctggttggctggctgttttcaacggaggatatgcaacaatataacacttccggttcaacattcgaaccgtgtgaaccggcggttgaaccgctggaccggtgacccagggacttgagcggttcgatcaccgattcggttttttcaactatgcatatatactccctctatcctaaaatgtttgacgccgttgacttttttaaacatgtttaaccgttcgtcttattaaaaaacttttgtgaaatgtgtaaaactatatgtatacataaaagtatatttaacaataaattaaatgataaaaaaagaattaataattacttaaattttttgaataagacgaacggtcaaacatttttaaaaaagtcaacggtcaaatatttagagaacgagggagtactatgcattatgcatatatatgtaggcatgcatgatgatgctttagctttacttaagcgtgtataactgttggacgcggtccaagtgttctcacgtaccaaatcctagctaaaagtacgtgtacattcttttctcttttttttctgaaactgcaaaaaagaaaagagaagaagaaaagaaaagaatggtgcactagtatacgtggctactccacaatgcctaacaatataaggaaaaggcacagcaaaaggaccgacacggcaagaaagatggtatagacagtgcagctagctgaaggtgcaggctttgcatagtgtgaagcgtctgattctctgacggccagcagcatattcagcatggacggtttgattgatgatcaactcaaagtccaacagagtaggtgaacattaagacacagagatgaccatgacgcaatctaatcatgaagacaccatgtattttaattcatactctaattagctacatactcttgtgcctctgtgaagctctaactcagctataaatacatgcaccaccacagctctgctatctccaggcactggtgcactcaccaaatcaacaagctagctaactaagcttaccacactcacatactcctatatattttggcacgcattgattacctgctagctccttgagcaatatcaatatggctcagccgacttggtcag

SEQ ID NO: 6673 - DNA, 1501 bp, Oryza sativa
ttttggtttgcttttgcttattgatagtgctaattgtaagcataagctttctctatagaaaacacataccacaataaaaaaagagacactttcatgagcatgagaaaacttcatgttgaagaaactatgagtgtgtgataggcaaggtggcaattctaatataacaaatggttccatttcaaaacctaggacaatatactggacaataaaactaaatactagactctctttcttgaaagcaacccatagtatttgacaaacactttgatttaacaatggaaagtgaacattttgtgtacacttttagaaagcatgtgcttaattactcaataggtgttataatacattaatactatggatgttaatataattaaaataatatttaggaccatggtagtatgatacacttaaaaatatgatgatatccaaatattgcatttataaacaagatcttaactggcagccttatttctttcttggtgtaggagatgaatcctatttttatatattcttttcaccgacttgtaatacactactatgtaaatactatactcttaaattaagagaagaacaaacatgtactcacttttagttatacacatagggagaactacaatacttcaccattcttttcttgatctcttaaaaaaggaagctctataaagaaagtaaagctaaggataagggtaaaaagaaagtactatgatgaatagcttggaataacctagtatatgctaatattagttgaattgaaaacaactactaaaacaagaataaaatgttgcattaatagtcaaaggctgagacaaagcacataagcatactctagaatatacaaaacttttaggaaatctgaaaaattttcaatacaatttctatgttaaaaaaattatatattgtgttttctttaattgtgtagtactagtagtcggagtaaggagaagcaaaacatgaggagggagcgacacaaaattaactagaggaaagaaagcaaaaatggcaaagaaggaagaaaaaagaaaagggaagaagaagaagagacgctggcagcagctgcgtcgagacgctttatcccttgcctcgcgagaacagaaaaaagaaaaaaaaagaagaggaagaggggaaggcaatccgaaaggaaattaggctagggttttcgccatggctaccacccaccacctcgagctccccctctccattcccaatctctccgactcctcctaattaatcccgtattcccaccccccaagccaaggacagcatctcgcatccgcgtccttcaattgatttgattgggttccccccctccatttcagggtttcgtttcgcatcgcagcaatcttcccgacccagcaagcttcttcttcccttgggtccgttagggtttgagattgagaggggcggcgctggcgatcgagattggtacggcggcggaggcggaggtgggcggataatgtgtatactgtgcgccgtgcaacggtggtcgcggcgcgtcgcacca

SEQ ID NO: 6674 - DNA, 1501 bp, Oryza sativa
cccgttttatatatacctgttgacacatgattgattatttaattactaatcccgtatcatcactgctgtgtcaaccctttagcagtagtccgggaacagataagtaacagtgctgtcagcgcatctgctgcattaattaaggtcagttcagttacattaatgtctttacccgtactgttgattatcttaggctctgtttagttctcacgcaaaaaattttcaccatatcacatcgaatatttgaacatatgcgtcaagtattaaatatataaaaataataattacacagattgcgtgtaaattgcgtgacgaatcgggtcggacacggataatgccgaatacggatataaactcggataatgtcgggtaaaaatacggaatgaatacgtaccaaaatagatacgtacactatcgattacgaatatttattcggatatcaagtcgaaggaacaatcttatatatcacatagacaataaccatttaacaattccatatatacataatacgattatattaggcattaggaacataggaaataaatagggtacaatacatcatagtagaaccaatacataatactaaaaagtgcctcacaaaaacataatatagataatatctgtatatttatccgggtaatatatacccgatttttttaccggataaccatatccttaggatactacattttcgaatccgatcccatatctgccataaaatacccgtattcggacccaatatccgtgaaatatcccggatcccgaatttgtcccgaaataatgtggctgggcgcattttcacccctacccggcccatgtaattttcttgacgtattggaccatgaacgctttgcatacgtaattttgtgagctgtagtacggatatctttgggagatttagaactactataccgattaagttcatgttaaggaggtgtattcacagttgtgcactgtagtatactggcaggttcgatgtaatcatgtaatcagaaactaaaatatcataagaaatgtgcatgtgtattgtggctgcattatgcatgatgcatggcgccgatcgaatcgaagtaccgtacagtatgtagatcgtagctaggtggtcggtccatggactgaacggtctctacgcatgcatgtcagcacatggacgtgcatgcgtaccacggacacacacacacacacaactaacgatccacatcgatcggctaccggaccacatcctgcatgcagggtttcgtatttttcgtcggaggcatcggatggccactgcccaccgctgtcttcttcacacattgtacccgtatgccgcgcccgcccggttattggactccatcctcgtgctagctactgtgcagatttgctccctctatatatcatcgcaaccgaatatatatataggatttgttttgttcgtgaaaagaaaatttttaggtatcacatcgaatgtttgaccggatgttagaaggggtttttggacacgaatgaaaaaactaatttcata

SEQ ID NO: 6675 - DNA, 1501 bp, Oryza sativa
cgaatacgggtattttatggcagatatgggatcggattcgaaaatgtagtatcctaaggatatggttatccggtaaaaaaatcgggtatatattacccggataaatatacagatattatctatattatgtttttgtgaggcactttttagtattatgtattggttctactatgatgtattgtaccctatttatttcctatgttcctaatgcctaatataatcgtattatgtatatatggaattgttaaatggttattgtctatgtgatatataagattgttccttcgacttgatatccgaataaatattcgtaatcgatagtgtacgtatctattttggtacgtattcattccgtatttttacccgacattatccgagtttatatccgtattcggcattatccgtgtccgacccgattcgtcacgcaatttacacgcaatctgtgtaattattatttttatatatttaatacttgacgcatatgttcaaatattcgatgtgatatggtgaaaattttttgcgtgagaactaaacagagcctaagataatcaacagtacgggtaaagacattaatgtaactgaactgaccttaattaatgcagcagatgcgctgacagcactgttacttatctgttcccggactactgctaaagggttgacacagcagtgatgatacgggattagtaattaaataatcaatcatgtgtcaacaggtatatataaaacgggaataatcaatcatgtgtcaacagcactgttactctactacttgctcgctaacaccgtcgctaatcagttgcaaggagtcgagctcgcaaggcggccgggaggaggaggaggtccaggccccacggtggctgccgctgtcgccgtgccggacaaatctgcaaatctgccgcgcgcgcgccaccaccctcctctacggcttcaataattcactctcacttgctcaaatcttcatcctcgttacctggcctaccaaaccttacaagagacagccatttcttctccatccaatcgtctcctctccctcattctacctcaacctctctgctagctcctcacctctacaacaacacattaattgacatagacagcagcagctcgtcgtctgcttcaattgggagcaggaggaggagaggagaggagcgagggggttgctgttgcagctgctgccccaggggctcattactcgccagcgcagttattgctaccactgtagtataccttgccactaccaccaccaccttcctcttgtaatggagaggatgcagctgcaagggcccatcggctcgctggtaagcttccctggccggggacggggacggccactgcactgctgctactagtagctagtagtaattgagcaaccatgtagcttccattcctagtctctgcactgcagcacatgtaatgcgatgcgatgcaattcggctgtattaattgcattctgctgcttcttcttcttcttcttgcagctgctaggttgcaacatctagcc

SEQ ID NO: 6676 - DNA, 1125 bp, Oryza sativa
atcccttatattgtgggacggagggagtagtacttactagtgctaggctgctagctagtactaggatttttgatgtgaaatagtagtggagattctctcggaacagtaattttggaacaatcacgagtaaagcacctgttaggatggaacttttcgtaatactaatacgttgtgaatcgagtgagcatgatctttttataatcctcgtcgagcgcgagatctgattgtccggtacagtattttattcaaccgaacatgacaaagtgttttaacgtcgaaaagtcactagtttacctcggggtgaggtgagcagccaatcgggtggggtgtcaaagacagaaaccaaaaggcagccagtcatcagagcggtcactgcggcacacgtcgtggggcgtggttggaggttcgctcaagtcgtggtcgtcctcgtcccggttggatggactagggggtgcaatgcaaatagcgtatggttacgggcgggtaattgcaaaaaatgcggcgcacccgtgttgtggcaccaataatgttgggcttctctccccgagaagagacagccaatggggggggggggggggggggaagcggaaccaactttttcgcgggatgggaaatttcggcctcgctttccttgtttgttcggcccggatgcattaccacttctgcccctgggtgcggtggccatgatgacgataaaaaacggaaatgcaaccgcacgcactcctcctgttgccgtttgcctctgtctccccctaccgcgcggtggggtggccactacgcgaacaaagggaaacggcaacacccgcagggaccaaaaaggaaagccgaggaggagagggaggggagagaagggagagggggtcggggagaaagaagagcgagcgagcagctttggctacggccaaaccctacagcgcctccaccaccactccttgccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatcgaaga

SEQ ID NO: 6677 - DNA, 1501 bp, Oryza sativa
ttacatattattaaaaaaaataacttattacaaataaatggagaacgcgaccctgtcgaacgggggctgttcgacagccctgcctgtcgaacgggggctgttcgacaggtcctgtcgaacggcagccttccgatctcgtcgccagtcgcgctctggccgttcgataggcggcctatcgaactgcacccgttcgacagggacctattttcgcgattttccccggttgaccactacttttgcgattttccataaaaataatattaattctcaaaaaaattcagtatatatggtagtaataaatcattactccctccgtttcacatacacacatatatatatatatatatatataatcaatatgaatgtgaaaaatgctagaataacttatattatgaaacggatgaagtagtatttattcgatgttcagttgatatacactgctgctcaaacagctcgtgtcacgcggaggcacggaagggaacataggcgaaaagctagtggtcacacgcaattagaggcaaaaaggatgcaggaaaccgcaggaatcggtagaattttgacagggaaacatacgttgaagactgcctcacatgcaagtacgccacgtggaggtgttgtattcgcgttggagacgtacgtacacgtcgctgtcgcgtatactagcatggactagcgggcccaaacgcgatcgaggcgatgtagggcaaaagccgtgatgggcttggggacgatacggcccaacgcgccaccgtcctgggtagtatgcggcccacgggagtgtgggggaacaaacggcgccgcgtgcatcccatgcgccgtgagcggacgtgctggtggagcctgagcccacgaagatggcccaacatctacgtagcatatggcccacaaactcccgtggcgagagataaactagcacatggccgtcatgcagagtactagctccatcttaagggggtgtttgataactagagactaaatttagtccctctcacaaaaatataactagggacttatgtttttgtgagagggactaaagtttagccccactttagtccctccatccaaacaccacctaaataccttcatcttaaataagtttgtttttaacccttttacgatttgttctaaaataagttctttctcaaacaattattatatcgaagtttgtgaaatttggatataaatgcattggaagtatacaaagaaaagaataactgtatcgaaatttcataaagttgagtattttaattattactccctctgttttaaaatataacaacttttaactctcaggatttgtcccaaaatataacaacttctccactaacattctcttcacaaccaatcacaaccctccaccattcatttttccacctacctccactactcatccaatcacaaccctccaccactcacttctacttactttcttaataagcatgtccaacactaaaacttcttatattctgggacggagggagtagtttttattggtatgttt

SEQ ID NO: 6678 - DNA, 1501 bp, Oryza sativa
cttgtgccgctgaccggtggggcccgcttgccggcgccgcccctcccccttgatgacgtcagcgaggtccatttcctttgtaaaaataaataataattgcgcaataaatcgagtttaattctagaaattcattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagatcgcggtcgcgaggaaaagagttcggaaaatccaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctgttctttgtcaaccttgggtaataaattgactagctcatgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggctggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagat

SEQ ID NO: 6679 - DNA, 1501 bp, Oryza sativa
cgtcgctccatcctcgcccacctctcctccttccccaaaccctagaatctcgccgcgcgggcgcagctccgcccttcgctcgccgtcatttcccggcttccccgcgcaggggctagctagctagctagctagggttccggcgcacgacgacgatggccgcggacgatctctcatccccggcgcggaagcgcggccgcgacgaggaggaggaggaggaggaggaggtcatcgacggggaggccgcccagaagcgcgcgcgcggggaggatccggagggcggggcgctgctggggctcgccaactacgaggaggacgaggaggacgaggaggcggcggctgctgcggggaggcgccgcgcgaatggccgacacgaggaagaggaggaggaggacgacgacgacgacgaggttgacaacgacgtgaggagggctccggagcggaggccgaggcaagtggagctgcgccgggactgcccttacctcgacaccgtgaaccgccaggtatggcttttagcagcagcagcgtttcaggtgccaattttttagacattctgtgtgattcgattgatgtgaataacctcgatgaaatatagtttttcattatgttcacgatctccaatttacttgggatccaccatttacgcctagtattttgattatcaattgctggtattgtgatagaagttcctttttttgtgtgtatgtttgatttaatagagctgaacaacatatacagatgctaaagggaaacttaatgttcatggtgttattatatcttcatagtgaattccaattgattttatttttgttgtagtgtgcaacatgtgagcctgttcatttgaagtaatatattatttttttgtcatatgtctgtcttggtactttatcttttttttttttttgttcgagagcactgttctactgctactctactgtgtacattactataataactgaacggaacatatttatcaaataattatgtttagttcttccttgctctggtggctattgggtttatgggtgtattgggttgaacgctggtccattccactatggactgtttcttaactgagacacggtcccttaggacatatcagaaagcctcttatgtttgctgcaattttaaaaagaactgtaggcttttcccttcaagttcttatccgttcaacttgtgtatccctttatttcctcgttctcactggccggtacataaaagctttaattaaactaaacagtatcttgtgagctgtggttggcttttttctaaaatagatccttaaaatagctttaaactaaacaattgtaagctcttgtaggatctttaaatctatccttctgttttagatggccagtgtgatgtgattgtttgtacaattaaaatctatggaatcacttccacgctatattctatatatgttttacactcttctggcagaatgtgtgctggactgtatcattgatgggctatttcacatgttcattgattgttgtatatattt

SEQ ID NO: 6680 - DNA, 1501 bp, Oryza sativa
gcgccggtgacgtgggggcgggtgtggagggcggggcaggaggcggcggcgcacgcgctgctgctctgcttcaccgcgctcctcgccctcaagctcgacggcctcttccgcggctcgtggtggtaaaagccgccccccccccccctgttcccccccaccctctcccttcgcttcatctagccccgccccgcccgctagaaatgctctcgcaacctcgcgtttggcaataattggattgtgctggctcgttgtggaattgcgagttaggagtaggtgcggacgtgtggtatattctattggttatttgtgcaatcgctgcgctttttagtgatggcgtttcttatttttttaggatataattggatgcgatagatgcatcgtgcgtatctgatggaatcctaatctgcatatagcgcacgtcgtgccctttttggtgcgattcagtccttcagctgagccactgagtgaggttattgttaacatcctgttgggttaatttgttgttgttagctgttgcacattatcctgagcagggtatggaactatgttttgtttgtttgttttttttttttttttttttttgccgggcccggctgaagaaggccgaccaattccatcaaggttgtgggaaacagttacaagttacacatttatcgacgatgtgatgtcgaaaaacagggtccagcactcccagcatgtaaaactaaaagagactattcattgtcattcttaaacaccccaaatgggtatgaactctttgatgtcttgtaattggcctgctgtgcgcgactggccattgaacacccttgcattacgctgcttccaaattaaccaacaaaccaacatgaagagagtgtcaaatgacttcctgtagctcggctggaaaaacatccttgccaacatccaccacgctcttgcagctcggcgttcagttcactgggaagctgaagaggaatgcctatccagcctttcaatattccccacaccctgttagtgtaagatcaggagacaaagaggtgaatgcagtcctcatcagctaccccacgtaattggaactatgttttttatacttggttttggaggtttcccaaagttgtcaaagtttactgcatgcattttagtatgagaactatttgagaaagggagtaaattttgtttttgagaaatggacactaatctggtgagtgtgatttgccagaaacctttgtgtgttctttgtctttttttttttttgggtgcgtgtgtctctttgtatgtgactgaatcattggctacacaacttatagtattgtgcaacatggatatggatgaaccagttagtatggcacacagatagctctacagagactggtatggccattacaggaaaactaggtggcaagtggtcctctaaagttgggtcctgaataacaattgcatctcattcgtgcttcattgacttgttatgtgatacatttgattctctgcatgttgggattgacagaatgcttgacctgcaggg

SEQ ID NO: 6681 - DNA, 541 bp, Oryza sativa
ttattttaattttaccctgtggcatattgtactgtctattagtgacggagccagaaattttctacgcctaaagcttaagtagagctcatattggctttctcaaaaaaaatacatggtgatttaaaaggatttaggcaagtttatggaggcaagcctagggcttaagcccaagctgtcctaggcttgcctccacccctgctgtccatcactaaaatcatagagtggtttcagattgctgatcctacaacaccacataaagaaagaggtcatcatgcaaaatgtctcacctactgaaggaactaaaaatgggaccaatttaggaaggactagattgattttgaattaaggagggggtgtggcttgaacccggacgggctagctcgcagcttgcgttgctagctgggaagaccccgggcctttctcgaaggaactaaaaatagcaatggtgatctcatgtatatgaaggtgtatctctgtcgcttacccttggcaatatgaaggtcatcatgtcatttctcctcataaatatcgttgctacagg

SEQ ID NO: 6682 - DNA, 1501 bp, Oryza sativa; identical to SEQ ID NO: 3151

SEQ ID NO: 6683 - DNA, 813 bp, Oryza sativa
aaaggctttggtttggccagctaacaacaccacaactaccgtatcaaaagctaggcatcacgcagatcatcacgttggctccccatcaaggcccccacccacagcccacacaaccactctcacacacagacgcgcaccgtagagcatcctaaaacagtgtcaagattgcccacatcgtctgaaagaaaaaaaaacacgacaatcaaattcagatagtaatgctactccctccatagtccatccacgtgtgtagagcatttctaagattgttatgacattattaagaaggaaaataaaagacttttgatgcctcttattcaagtgcggttgccatcttctgattagacaagatgaaaggctgaagcctgtggttcgacgagaatttagtgataggtggttgaaaggagatagaatactttataaatttcgtgtacaaattttaaaggtacttacatcgttaacggagaccgttcaaaaatatagcagattcttctaaatatatcaaccaattacttataagataaaaaaaattaccacttaacttaattatagtcccaacaagtctcgatctatattcctcacttagagcaaggttaagatagcatgttattagctgaccgtgtcatctatagtaagcatagtaactaatacctataatatgaatattataacataaatattttattgttttatgggatccaccatcttttttcttcctcatacctcatcatttcctgtattattctctttctccttttcttaccttcgattcgtcaacgattttgggcttgagcagtcagcgaggatggacga

SEQ ID NO: 6684 - DNA, 1501 bp, Oryza sativa
ctcgacggtggtgcggccgccgaggtgggccttgaggtaggcggcgacggaggccgggacggagacgtcgcgggtggtctggacgacgacgcagggggcgcggaccatgccgagcacgccgcggaggtcggtcttgaagacggtctggcagacgtggagggagatgtccgggcgcatgttgaagagggtgcggctgaactcctgcaccgccgccggcacgtcggcgcccaccgccagaggcgcgtaccccgtcgcccacgccgagtagttcgcccccatcgcgtcgaacacctgctgtatctcctccagctcgaacccgccgtggtagtcgctgtcgttcaagaacctgcacacacatgtccgtgctccccgatcgcccccgatcagattcaattttaagagcgagaaaggattcacatcagtggaagcgagcgtaccggggagaggcgccgatgaggacaagcttggcgaagaggtcaggtcgtcgaatgaaggcaagaatcccgatcatggcgaagacggagtggccgacgaaggcgcagcgcggaatgcggagcgcgtcaaggatggcgagcaggtcgtcgacgtaggcgtcgaggttgtcgtagcggcggaagtcgaagtggtccgggttgacgctgccggcgcagacgaggtcgtagagcacgacgcggtggtcgcgggtgaggtacggcagcacgcggctccacgccgactggtccgtcccgaagccatgcgacagcaccaccacccgctcgccgctccccaccacccgcacgttcaggatctgcagcagcttcgccccgctcggcgccgccgacccgctccctcctccccctcctcccccgccgcccaccatcgtcttctccgagctcgacgacgccgacgaccccccgcccccgccgccgccgctgctgctgctgctcgggctactgggcggcggatgcgtcgatcgcagcatcacaccagcgcggcggattggcaagccgtggcgcgctccccttttatatactactactactactactatcaccactggccatgggagatggtcttgactcttgcctcgcttcttctctctctttcttgctttgatttctctctctgctttattccactgtcttaagcttcgttgggtgcggtggtagattgggatttttgcagagaaggtgtgtgattgcttcagttatttaggggggtgtttgggttttgtctccatgtccaattatccaatccacagcagataaaaaggagaggcagtgaggcacctataattctctggatttttttttctcaggagaagtttttttttctcttatcgttttgttttatttttttttgacttcacaatcccaaccagagatgccactgcaattaatattactcgtagttgagagttttgacaagctaagaacgtcgctgttagtgtctgtaatgtagcgtttgattatcagcgttaagggaatttttgcagcaaacgttgtagacatattagatgatg

SEQ ID NO: 6685 - DNA, 1501 bp, Oryza sativa
agcttgttcatacgtacgtgatggggaagttctggatgtgtgcgtgtttttttataaaaagctaaccttctaaaataaaataaaagatacaccgatttaaatgaaaatcgatgatcggattagagtatgacttggcgacatagaagcatttgtaaggtgtcacttagcgacttaggatcggagtatctgtacgatgtttaatggacttttaatatataatagttatttttctaaattttttaagattttctttaatttaagactgtcatagaggcgtttaaaaaatatttaatggactttaacaccacacgggggtagggagggagggagagagatttgggatttttttattaaaaattaaccacctaaatgtaatcatcaatttaagtagaaatcgatggttggttgttatgtatttttaagaatttttagtactttctctaatttatttgcaccacgtagcgacttaggatagttcgtaggatgtttaaatctgtgacggagggagagctgctagacatagcaattgatctatttgtgatttttttgcatgtaaaaataattttaattttaatttctcatgaaatagaaagtaacataggaaggaaaagaagggaagtacgtacagtacctacgttcatatagtacgtacttttattcgttagtatatatgacgcctctattgattttatttttttggtttgtacgtcgttggtttcggatgtgatttttgcttttaccgaatagatctaaccatccaaaacaataggtccaccaatttaaataaaaataaatggttaaatttctcttatttattagggtgccacttgacggtttgagagcgtttatagaaagtttaatggacttttagtatataatagatgcttctaattgtaactatactgtacctatgatataacttatataaaacttatattcaattatggtttggttggttagcactggaatctttacgtgtgacatgtgtaaaagttttttctagcaattttttttcatgcacaaatcttaaggtgatccaataatcacaaatttgaaagtttttggactaaaaaaacttacataagttttctagcaattccgtaaaagtttcccccgttttatagagggcataaacccgtcggccccattatatgtgccatttgtacgtttctattttctcagtaatcagaccattaagccgagaccgaccgccagaacatccctagtttccgcgccaaacttgtggaatttctgtgagaaatttgcgcatggaagcaccggaattccacgttatccagactataaatatctgcatcgatcgatcagtcaccacaaccacgcactccactacaggctaacacaatggcagctcccgccatcctccgcctcctccctcttctcctcctcgccgccgccgcgaacgccgccacgttcaccatcaccaacaagtgccagatcaccgtgtgggcggcagccgtgccgtccggcggcgggcagcagc

SEQ ID NO: 6686 - DNA, 566 bp, Oryza sativa
gtcggcacccatactcccccatcatctccccctcaggttacaggaaccgaagccccgtggcactctccgctgtgtcaggccagcgccgctccaaccccgcccacaacggacgccgcacccgcccccaccggcaccgacatccaagacgtcgtcgtcgccgccgccaccacctccacccttattctcctctctactcaacgtcgccggtcccatcaacgctcaccgggctgcaacgacaggaacgacgatggtggtggtgttgccgtggctgagcacagaagaaaggaggaatgaggcgtcgtcatggttggcgggtcctcacgacgagcagaaggacagagggcactgatctggggcgagctcgagagcctggtgacatacggttctcctcttctcgctgctgccaccgccttcattgatgccggctccgtcaccaacgtcgtatcttcgatggcagcggcaacggaggacggagcagcggccgtcggcgatggcggcgaaggacccagcaggggcgctcggcgatggcaacggcagcggaggacgggtgctgcggcggcggcgct

SEQ ID NO: 6687 - DNA, 1501 bp, Oryza sativa
ggacggcgccggcgatgaggaagaagcggcggcggtcttcgggtcaacggtgacggcggtgctccggcggtcttcggcggcggcgaagcggtggacggggatggcgacgcaacggcgaccacgacggtgacctccccgagcgacggcgacgactggagcgacggcggcgcacggctggagcggcggcgacaacggcggcgcgaggtctcacggcgctaggacgctacaggcgacgagaggcgaaggcgagggtggcggcgggtagaggagagctcgggggtccttttataggggcaaggaggcggcggcgaaggcccacggcaaccggcggcgagaaggaaaggttagggttcgagagagagaaacgaatccgattcgacctcgaatccacgagtttccaaaccgaattaggcgatgattccaaaagagaaaaggaagaggagatcgagaagattatttcccctctaaagatttcaccggatcgagaaaggatcgaccggattggaaagcggcggcggcgaagcggctcggctagggtttcgagcggcggccggcgcgaggagaacgacgaccccgacaagtgggtcccgcctgtcagcggctgagagagaggagggaggggcgcggcggactgggtcgacttgggccggggaggagagagaaagagagaggtttttgggccgactttcggcccaaagccaaaagagacttttaaaaacctttttcaatttaaattattcatgaaatgcaattccatttattaaaaatactttcttggctcaaataaatcccagaaaaatctaggaactatagaatcaagagaagtatttaatgaaattttatctggccccattttatattggaatttattaattaaaattagatcttctcttttaggcttttaagatcatttctaataattcttttaaacaacaatttataatttaaggatttttaaacaagaaaagctcttaacaattataattagatcattattgatcaaataattactgaactgttctttgtatcatttagaaattgagctctgaaaaatccgagaaaatttcagagagtgtaattaaccatggagaatttaataaaaattaaatccatccatgctttaaatttaggaaattttatttcccacatttaacttcacttgtaaattaaagaacatttaatataaattctaataataatttattaaataatttataaatcctgaaaaaatcaggatgtgacaaataagaaactatatttttcaaatccatcatctaaaaaaagcaagtgatcaacgcatacaacgaacgacagccattttatttaaaatttttaaacgcatgcatccatggcaagataacctcatcactctctggtcataaggaaggaatgagtctccgctctagcaaccgaagatgatataaatgcctatatttagtctcattggtggtccatgaagctctctcggccccatatatatatagctcttgtactatcacgt

SEQ ID NO: 6688 - DNA, 1501 bp, Oryza sativa
gtgagaaaaatgaatggtggggggttgtaattggttgagaagagaatgttggttgataagttgttatattttgggataaatcctaagggctaaacgttgttatattttgggacggagggagtacgtcaggttaaatgcatcagaagagactcaggattactgatgcactgtaaatatcaggttaagtgcatcagtaatatgacattcttttttttttttgagaaacatagtacaaacgtgcgcacactcacccctatgaacgcacacacgcacaccctacccctatgagcacctccgaaagactgggccggcagtaatatgacattctgatcaactgatttgagagtttacagtgctgatcgatgtatgcacactgcagatgcttcttttcaactccctgatgatttttgagcgaaagaagtgtgatgataatggatgtgatcgatgtggggaaaatgtggtgttcttgatgatactgaagctgatccattgacttgtgatgacgaatccttaatttatttttgatttgcgggtgcatggcttgtgatgatgccactctgcatttgttgcagtaataaggaacaaatgttgaaatggtcgtggcttcgtttctgaatgttgtagggttattagaaatctggaacaatattcaggggaattgttgctacacaagttactgcatacggagtacgagttaacccgttagcactactacaactaaaagcaacgatcagatgattcgtatgacaacgccgatagtattaccactgaatgaatactaacaagatacaaaaacgagcatgtgtgcataaagaatctaaccatttaaattaagctcacatcgtgtcaactcaaatttttgttactcgaaattcaaatagtaacatcaaacttcatggaaatttggtattcatctgtttcatatgataagatgctttaaaattttcaatttaaaaacatagtaacactatcaacataaaataaacgtactattaaaatattttcaatgttgaatttagtgaaactaatctgacgttataaatgttgttaacttttttataaagtcaaagcgtattatagtatgaaatggttaaaataacatacaactgagtactacttgagaagttattgattttaaagttttcaattttttttatcaaatactatcactgtagacatcaatatttataaccaaattgaacggttgtcaaatgagaaacactcaagaatcttccggctagctccacaaggtagtggactagaaaatctgagttcgaagactcacctcttctaatttttgatattaggccattcttttatattcgcgttttttaacggccgttaaaaaggataaaataatcccttgctttcttattatagggctgtaattcgtaaaaagtctgtgcataaacagcaaagtaggcccagccaaagcccaaagcccttgagggcccaccactgcaccctaaattgccatcccaaccgccgccgccgaacccca

SEQ ID NO: 6689 - DNA, 1501 bp, Oryza sativa
ataactactagattgttggctcatggattcaatttcgtgtttcgccatgttcataacctgagacaattaatatgttgattagtcaaattgctcaaaaattatgttatttgcatgcacttacttttgataatcatatatcttttggtttcaaatcgatagattatttattattacaactaaccaattaaaagcaatacatataatacatgtagatctttatcaagatggcataaaaggtatggtgtggaatattttgatcttttaaccaaaatgcacgcactagccaagtttttacatctatatactcatttttaagtttttcactagattacacccacatactaagtttatataccgtagacgcagtttattactcaaaagagagtaaggagcaactatccacgttggaacatgtgacgtgcatatacccccggtccacgtcagcgtggaggacacgcgttacagatcttatccgctgtgggggtattgtcgtcgtgttaattgggtggtcgctttctggcactatttagtgatggctgattggtgctgattttcctttggtttagtacacccagatatatcaaacaaacggtgtgagctcaactgaatatagttttcaagctacctttttatttggtgccacaggatcgctgacgtgtacgtaatccgatactgacaccaacattatcaaattgtacatatgcctttgacaaaaagaaaattgtatatatgtgactcgtgctatggaaacatgatcaaattatcaagaattcttttttttttcgccagtccaaacagggcataaggttatttagtcgacttaggacctggttggagaaacttttggcagcggtagattttctcagaatcagaatcttccctgaacaatctaacttttcgttaagattctgaaaagttgtagttgtagaatccaatttttcaaaaatctaaataaggtagaaaacctagtttattcaaattttcagaagctgactaccaatcagctcttgtatcttaaactctctcaaaaggcatttaggcttgggccgagaagggtttttcaaattcgctccgattcgaattgtatctgggtactactttcattacccaacatatgaaatagacaaaatactttcattacacaacatatggggtgtttcaatctcacctcgtgactgacaagtagctgacctcaagacaaatgactgaaagaggccttccttggtgccatatatacagttcaaatgaagggggaaaatgaggatctggcatatgagatatgtgcatagtaaaaggacgggctcaacagaataagattgagacaggttgactcatttgctgaattcatggaggagctgaataatgtgaggaattgaatgagtagctgataagttgaatagctgatgctggccaatgtttacatgattgggaccatggtccaaaatccagcgtgtttactagctacaaggatatgaactcgaaagaaaatctctatttcaga

SEQ ID NO: 6690 - DNA, 283 bp, Oryza sativa
cagaataagtctaattttcctccctcctattgggctgtgacatattagctaaaaaagtatattttacctccctcttctttgggctgtgatatataaatagctaaataagtctatttaagatccctattctttggacaatgacatttatatgtctatttttagtccctatactttgtgtgccgggcctggtctgccggcccatcgtgctaggccgacccgaccgtgccgggccaacccgaccgggccagcccagcgtgtcggaggggaggcccaggtacggccg

SEQ ID NO: 6691 - DNA, 1501 bp, Oryza sativa
caaagcatatacttgtaatgaaatggcatattcatatatagtgcttcgcttcgagttcttttcatcaagccatgtcaaaagaacaacgagtaattttgtgatagatttttttttaaattacaaagtacaacgcagacactcacaacacacgcacactcaaccctatgagcatcttcgaagactggatcggcaaatccttaagattgacgaagtcaccacatgtgcctcgctgtcgacgaatacgtcgcctaccactgaaaggttaaatcataaatttgctcctgtaggaagtcgaacccacgacctaaaatgtacttaggcttttataaccactatactacatgccatttcgtattttgtgatagaatttaatgtcccgcatgagacatttgtagcttgggataattattgttactgaattatatgtttcatcttaccattaaaatcaatggaacagatcgcttccgcgtagatgtcttctccggtcgtattgatccgccctcaagttaatacgtcgtcatctacgtcgatacgccaataatctaccagatgacatttcgataagctcaagcattttttttcaaaattccatttgcatgatgatcttcaccaatgtttattcaacatcagaactttctagcagttttgctcaccccaatcaaagggaaaacttgaaatttttgtgaggcaacaaaagtggaaagtgaaaaggagaggggacgctacactagcagggtgcccaatatcttctctagcgtttatggaatttgcatatataggttgtgtttagatccaagatgaaaaatttcggcgtgttatatcggatatacatatacacatttaaagtattaaacataaactaataacaaaataaaattacaaattctgcctattatctgctagacgaatttattaagcctaattaatccgttattagcaaatgtttactatagcaccacattgtcagattgtggagtaattaggcttaaaagatttgaatcacaaattacaaataatctgtgtaattaatttttcgtctatatttaatactctatgtatatgaccaaacattcgatgtgatagggtgaaaatttttactggagatctataaataaaacatgcccatatatacagagagtgtgtaaaaaaatgaagaaaagaaatggctccataaataaaacaataaccataggtgagtaagtaggcaaccccacctctccctgtctctctctctttctctctcctccctcctctcctctccaaccccaccggcggccaccaccaccccccccccccagccccatctccggccaccaccaccgtgtcctccacgtgttcccggaggcctccaactccggcgaccactcggaccacccgtgcggcggaaggactcgccgtattttccacttgcgggcttgggtggcggcggtttcttggtttcttgggaggatggaccatggcggcggcggcggtggtgggggagcggcgccgtcgagcagta

SEQ ID NO: 6692 - DNA, 1501 bp, Oryza sativa
tgtgtttcgtgtaaaatgattttatatagaagttttataaaaatttaaataaatcaatttttcaaatttttaatcattaatacttaattaatcattcactaataacttatcttattttctatactgatgataatattcatccttacgcttacttgaacgagacctgagtatatagtatgaaaattttatttttaatccctacatgttcgcagggtttaacttaccgccaccgcggttaccgggcttaccgcgggggtacggtaatataaataccgcggtaacctccttaaatacaaataaatttaaaaaataatttgaatttttgataaattttgtatggttttgtacggtttttcacggttaccgcggttaccgcgcggtaaccgccggggcgggtaaaccctgcatgttcgtcgatgagttgcgctgccgtccagggttgtcaggtggtggctcccactagacaccaattgtgtcagtatctagctaggtttgtagttaggatctcttctttttttaacatagtagtagtatgttttttcaatctattttatttgagtataacgttaaattaccgtctcacgttaccaaattaatacaagatacagttttttcatagatgttctcgatcatgtgtggcactgattttctttttggtgctgttacaatttttgtccctgatcagcattgtttttctaattcagaagatttttagataaagaattataaattaacctggcctctacaccttttaaggtgtacacagccaacattcagaagatccagatgttagtcatttaggccatgtacaacacgtgacctggcctgtggtcttgcaggtccacgtcgtagccgagccgagctggcacgagtttgggtggtctcgcaggctgtcagtgagcttgcagaggaaccggtgcaagcgccacgcctaggttcgggaaccgcgaagccacaagccgaagcctcgcgttggaggagtcggcgccccgcgcatttcctcgtccggtctcctcatgtcgtggtcgtcgtcgcctcaccaaatccgcctgtaacaccctgaaaattcgaccgacaaaatatcaaaactctaaaaatacggattttcaaaaactttttaaataaattgcatcatgccgattttattcgattattttattggagttgggtttggagtttataaatcgcgaataatggataattggttaggaataaacccaaaaaaaaaataaatggacaaagtaaataattaaagtgcaatttaaaataagatttggtgtggacagtaataaataaaatattatcacgatcatatttgtatcaattcaatttaaaaatgtaggaataagaattaactctaattaaattcaagaaaattatataaaaataaaatatgggtaaaattaatcaggggtggatccattggttgggataatacacatattgagtaaaatgcatatatgtaaaattaggaattatagaatcaaatttatatgggaaa

SEQ ID NO: 6693 - DNA, 396 bp, Oryza sativa
tatcgaactcgctatcccttgacccagtggagactttgcttcggggtgagaacaccagggtatgaatgaaaattttattaatattggcaaaaagtgagaacaaaatctaatgagataaatgtcattttttatataaatacaaatcaatatccatattggctcaagccaaagttttcaataccagtcccaagctcaaacattatgtaggttgtaaggaacatattgttggaattaatagatgggccttagcccactcgaagtttaattctttgaaaaatcagaaaagtccaccacatgcgatggcatgcatagcgagtttagtaccaccttacttattctaggagagagggatctccttagggaggatgccctcctagccacttgaagtatgtgaga

SEQ ID NO: 6694 - DNA, 1090 bp, Oryza sativa
tcattactgacttgggaaaaaaataacatcaaatttgcttcatcttttgcactctcccaaaagttgacatgagaatacgggtactttgttggaattaatacatgggctaaggcccattctaaaattaattctttggaaaatcacaaagcccacctcatgggatggcatgcatgtggtgtttagtaccaccttgcttattttaggagagggggacctccttaaaagggaggatgccctcctatccacttgaaacatgtgtggtggagagaagagggggaatacacgcgcgtgctcactcgccttaccttgactggcaagcggctcgcgtgcacaacgtacccgtcgaatggtccgcaaaattggcttctcacccttgcgcagatgcagcctccttttgcagttttgtttagttgcaagaaaatttggatttgttttgttttgaaaacattccgaaaaatccggtgcctgaaaacggcgtggagtccggataagttacgcgcgacttatccggttcggttacgcggagtggagatcgtgcgggcaccctgatcaagcgacctatctctatataaaccgagccaccgccttcacgcaaaacacatgaaatcaatctagggtttgcctcctcctctgtgttgcgtcgtcgctcgtggactactccatcccgctcgtcagtgtgcaccggcgatcgggagagcaggtctccggaacctctgcctttcgacgtcctgcacctggagaaggcggcgataaggtttttgggaagcgcttcacgcgactgctccctgttcgtccgcgatggctcgccttcctctccgctcgcgtgctgcacgccttcatcgacgctcgcaaccgcgagtagttcctgccgagcaatcagtctttccgccacctcggtacgtgttcgacatgttgcgcatatttgatctgttcatgttttactgcttagtttacatgtatagatctaatgatgcgttaatgctagtatacatctgtaatgtcatgatttatttatggaatatattaaatcattatatgactatattctcaacaatccaaaaatcttaatataggcgctatgattttacta

SEQ ID NO: 6695 - DNA, 564 bp, Oryza sativa
tttacttccaagttgcaccagcacatgcatcaatctccgccacaaaagtaatcggatttagcattgccagtcagtggttattcttgagttccatcttcaggcaatttgattgtcttttcgccgttttaaaaatcaatggtgctaaatctttggggtcttccatccaaccaattatcgacccaaaactttatattttttccatttcgtcgtacgattcattataagggtttatttttctggcttgagagtttccacccttcgtctattttctattgtaatggatcattttcaccattgttaaattttgaattgcttttctggtaaagggtgatcacgcaataaaattaagggctttaaatcactcaacacactgcacgtaagtagggcactagtgtttctaaaccggtaaatgcggccgttacatttgaacgcatatcctctaccataaacgacagatgatcctcagccattgcattcgtatttagggatgcagcaagtggacggataagctagcggaggtgttctttttccctgttatcacaattgtactttattttttttaga

SEQ ID NO: 6696 - DNA, 1501 bp, Oryza sativa
ggtagcactagccaggggtggggcccgtgtggtgcgctttttgtgggacccacgatgggtgtactttgcactttgggggtggctggtggggcacacctgtcaggccttatctgcgacgtgattggttgacggggaataccccatccggcaggaaggcctgggattgggcggagccggatttttggtggggccacggcgttttgctacgggacgcccggagtcctgtccaccgtcgccctcgcggttgatgcggctcgcaacgccgctggcagtgggcccattctaggcctgccgctgaaaagtctttctaggaatatatagggcctatttgggggagttgttctgagaaagaactggtagtgcttctgaaaatccggaaaagccgggtttttcagcttctgtcttctagttcatttttaggattttacaactacagcttctcagaatctggaccaaaagctgaactgtttgggagagcttctgattctgggagaagccgcagcagctagaagctcccccaagcaagcccagtttctttttagatataggagtatatatatatatataatatgtagtagtaataatgaaaatattttgttttaaaaaactactttgagacactactaataaaaataggttttgcattcttgtttataaaacatgttcacaacttgggttgccatttatttatttattttgtttactgaaggatataaggtaaagtcgatgcatgatgaaaatatgttgtgcgatgctattcttttgtacctatcacaatgcatccaaagggcccatccacaagcttgcacaatcatctcttcattttaggtggaaggtgcactggtaatggcgattcatcggcaacaactcttttacataacgttatatggtagaatgtaagaacatcttttggggacacaacggcaaccatgctccatgcattcagtagtcatccatcaggcaaatccgcttcctcgtgtgtggtttgcaagtgcccttcttagggagctatggtggtaaagaaaaaggaaggaagaagaatcttaccatatagggttatatgttactttttctttttcgacaaagaaagcataactagggttctatgttaccattgccttgaaaactaggttttctttatctgagctttacttttaaaatatgtttgtaagctttggtcaaatactactttgcaaatagacttcatttttagatagtcagataagtatatatgtgtgttcgctagattcgcatacaatcggtgttttggatctacattgtatttatttatttatttttgaagaaaagacaagaagatctacattgtatttatgaaatgttagtacatccaagtgataacgattgggtcactattcaattattggcacttattcggcgtaaaatttcacgatatataagtgaagtaaaatcagcatatatacatagttttcgccgcgtcctggtatatggtcccggaagaaagttgttgtgctattagcca

SEQ ID NO: 6697 - DNA, 1501 bp, Oryza sativa
ttatccagatgtattgccgaaaatagctataatttttttaacgaagatagtagttactacctccgtcccaaaatataacaacttttggctatgaatctagacacacggttgtccagattcatagttaaaaatacttatatttggggatggatggtgtagttcaatagcatgcgcctattatttagcaaatcatattggtaaaaaaaatcagttcaacatattaccatataatgttggatggcgtacatattaattagcgactcacatcgtcaaaggaagctcatcaattagcaagagaccccttaagcttggatggtacgtactccatccacacatacaaataagcatagccacataggtaacctctattgaccgtaatttttcgtgcagtagtcgttattgaatgccacctcccgttcttgaaggcaagtgacgattagataatgacaccattctaaatatcacgtactatttcacactaatgctacggttctagacactcgtgagaactcgtttaaaggaaaaaataaaaactatgcaaatatatcagtaccattctgaatatttcataatccatggtgcatttatattttcgttcccttatcattgctataaactaaggtgtaagatatacaataagttgccgttaacacacaagcctcaataactctctaagactctctcatgtttttagtgaagtttgtgtatagattatccctgtacgaagaatggctcatttcctcctctttcatctctttcacattattaaaacaattggagtatatgaatatgatcatagtatccgtttgttatactagataggattatatttcatctatatctctagacttacttaagaaccaaatcttgtactcatatatatatatcggctctcaagactcaatacaatatgtcaatatttgcagtaatttcttccccatttactatttagcaaatgtctatatgacatctaaaatcaagtgtttaagattgcttactctataaacaccatatattccacgctaattttaattttctagacactcgtacgtaaagtgaccttaggtaaagagaaaaacctaaacaaatataccgttttgaatagtactctttccgtcctataaaaaaccaacctagtattaaatgcagaaaacctagacaacggtatttcgttggaacgggatactcttctatgagacagtacctgatatctgatacctattgtgataccagctgcatgatacttgatacctgtgatacctgttacccggtatctgtgatatctaggacctgatacctgtgatactcgtgcaagagaatagttaatatgtctatcccattgcaacgggatcccgttttgtagcagctctctgttgaatgtgatacgttctagtactacgaatctacatatcgtaggtttttttttatcgggatggagggagtattttacattcccattcccgggttggcgcgattcccatcctcccctgctctactgccc

SEQ ID NO: 6698 - DNA, 1043 bp, Oryza sativa
aaagggcagtgaaaaaagaagatgatattttatactattatcgagcccaaggccattgctttatatacaaagctactgcatacactgtattgtagtagtatactactagtagtattgagatcatgtaggtttcatgcatatagacaggcttaaatattcacaggaaaatgagacaaaatatggtggactcaccccccagaaagcagaagcagaaagtggtttctgttcagttaaaccatgcccaatgtttttgtattgcatgcacacacaggttacaaattcatattttttttaaaaaaaaacaaaagtgcacaaaagctagacctccttgctgccttctcctacataagggagtacttccattagtagtagtactactaacttagcaattagcatcatgcatatctatcttatataaatatctaccagtgatactgttgcttagtgctccaaacctctcttgacctcttcttcttcttctcagttagcttagcttaagcttcccctaaccttgagctcaccacaacaatggcgacttgatctaacagagcttaaccaagtagcaaatcatacatataaccatagcttaattcgcattgaatcttgtcttgttcagtgtgaatcatcaaccatggccaccatgaacaactggctggccttctccctctccccgcaggatcagctcccgccgtctcagaccaactccactctcatctccgccgccgccaccaccaccaccgccggcgactcctccaccggcgacgtctgcttcaacatcccccaaggtaattaagctcaccaatcgatgcatgcattcatgagctagatatagctagtgttggttgggatttgaagagacatgcatgtttgattgattgatttgatgtgcagattggagcatgaggggatcggagctctcggcgctcgtcgccgagccgaagctggaggacttcctcggcggcatctccttctcggagcagcagcatcatcacggcggcaagggcggcgtgatcccgagcagcgccgccgcttgctacgcgagc

SEQ ID NO: 6699 - DNA, 1077 bp, Oryza sativa
accaatcactaagtgctgatgaaaaaaaaactaaaacgatattatacttatttaatttgttgtgcatactacagctagatgcactgatcggttcaattatgcttttggttggagtgtgtgtgtgtgtgtgtatatatatatatcaacttgacaagaatatataaacccagtggcagtcttgaaattagcttagcttgaccatatacgtgttatggcaaatataatagagtatgcatttttatttcgcttctgagatatacgtacgtgtacaactactggactccgtctgaaccaatttgtccatggtcttgggtcttgactgataaaagaaaaaactatatacatatataaatacacaattgaattactttttgaaaggatatatttaagttagaaatcttgtactccctccgtttcaggttataagacgttttgactttggtcaaagttacactgctttaagtttgatcaagtttgtcgaaaaaagtaataacatttttaacccaaaacaaatttattatgaaaatatatttaattattgatttgataaaactaatttagtattataaatattattatatctgtttataaacttagtcaaatttgaaatagtttgactttgaccaaaattaaaatgtcttataacttaaaacggagggagtaacagatactaggtatattcgtttgtctgtagggtttaaaaatatctgctccatcattgtataaatatagatacatacaagtatagctaggcacacactgtatacatttgacaaacaaacaagctaatactagattgatcacctctgcatgcatttgacagtgaactatggattaagcaatgtatagagcagtagagagttgtagataacacatgcaaaaatgatagagaaatcgagagggcatgcaggggttaatattttgtcaggcttctcacgtgcacacggcgatcatgcatatgcatcatcgaccggccaatataatcttctcttggaacgataaaaaagagcatgtgcaatggcaagcttagtccattgtcatgtgctcgcatgcttttcttctactcaatacccacaa

SEQ ID NO: 6700 - DNA, 1501 bp, Oryza sativa
gcggtggagcttggggggcccttgactttgaaggtgccggaagaggagcttgcggaggagtcggtgtaggagctcgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagcttgaggtccacgtacgttccttcgaccaactcaacttcgaccttggagtatcctgctggaatcggcctgcagtggtaagtacctgaagggtccgttgggatggctatgcccgacgccaccttcatgtggtgagaggttatttattagtaatcaacatatataagcaacaactagcggaatgggcaaatctaaaatatataaactacgagcttacctttattgataagttcttgaaaggaatatgcagctcacatggtgtccgttgagtgatgtcatcaacggggcaggtggattcgtcctgggtttgcatggcgtccatgctctgtgatcctacctgccccgttgaggcgcagctgctacggtttcctgacgggctcaccattgcaggaggaatggtcggctagggatcattggaccgatgtgcggccatgcgttcatcaaccttccttgccacctcctcttgcatgctgagctcgtagctcgataccctgaactcaagatctgcaatcttcgcctcggtatctctcttgctcctcatccgactcttgtacgtgtggatgtcctccttgaacctaatcttccaaggaatcacccctttccctcgtgttcatcctggatgctctggagtctgcagggcgagtgacagctcgtccctctctctatctggtcggaacgtgccctgagaagaggcttccactgcgtctgttagtcgacgcgcagcctctcgtatctgatcgccgaagaccagtgagccatcagctgggttgagcgttccaccgtaagcatagtactagaacttcgatcgttccggccaattagcggtggccggttcgatacccctctcaagcaagctagcctccatctcctcccacttcggcatcacgacgctatagcggcctgaccccaagtggtgatggtacttcttcttggctgcattttctttgtttctttccatcatcgcctgcccttgttcactgtcttatatgcaacgaactcgtcccagtgatcccttagctttgggaatgtgtcgaagttcggtgtctgccccttcaggatatatttcttgtacagctctcccttgaaactctgaaactgttctgtcattttcttcagagtccactttttcactttgtcctctgtacccgcgggaagggtgaatgtctcgagcattgtggtccacagca

SEQ ID NO: 6701 - DNA, 1138 bp, Oryza sativa
cttttccagattctcagaagctggctaccaaccatctgcttctcataatcttacactccccaaacaggcccttaattagcataagaagattgctttgcttttttttccagaggaacaaaattggttacataggcgaaaggccctgcagcctagaggttataagagcctcagtagcacctgaggtcctgggtttgactccttatgggagcaaattttccaagatttaacggtgttgctttcggtggtaggcgacgtacccgtcgacagcgaggcccaatcttcgaatatgctcataggggtagggtttgcgtgcgtgtgtttataagggtgagtgcaaatgcgttgtgagtgtttgcgttgtactgtgtaattctaaataaagtaattacataaaagcagagttcacaatctcaacgaattccgagcggctggaattttcgaaattaatcgagattgtagaaatggttcaaaatgtgttgatggggctcaaaattcgctaactaatcgagattgtaaccctgcctaggagaagtagtatgatgactacttgtttggtttagttcatgggccacacgtatattttcctgggctgatttggtggctgatgcatgggcccaccttgaacctaaaacaggccgtagtgacacacagatggaccgaaactaaatgggccgagccaacaatcaaggcccgcccatccgtctcctcacactctggcacaccttcttccttttcttcacttgcggtttctttctttctttttaaaccaaccaagcagagagcaaagcgaaagggtgaaataaaaataaaaaaaaggaaaaaaaataccaataaatcgcggatttcccaacgccgccgctcctctcgcggattccccaaccctaaaccgccggcggtttctgcggcggcggcggcggcggcgcgtcgagtcggcggagtctccggtcagcttcccttccgcgattctcccgcagccgcgccgcgtggtttgacccctgtctctggtttcccccatcgcattgacgaggttacggtttcgcaggatcggatcgggttcgtcgctgatcgaggagagatcgcgtcgccgtcgtctcgggggtaatccgtcgggtccttgttcttcctggcacggattatt

SEQ ID NO: 6702 - DNA, 1029 bp, Oryza sativa
accggcgtgtgatcgcctgatctagctcggtcaaaggcgtacgtggactacgagtgtgaagagaatatataaaacgcgatcgagtacgagttctttcttccttgcagctttcatggcgctgctagcttcctgattgcagtagcagactagctaggccgtttgatgacgacgcatgtacaggacggccggcaataattaatggacaaggccagggaccaaaaacgtttctccccatattttccagaatggtactatcaaattaagtcacactattcagagctcaggttttatttcggttcatggttaagggtgtactcttctgttttgtttttcaacttctactttctagttgttgtgcgcacgtacatttcccaaaccgttcaataacacgtttttttttttgcaaaaatgttactatataaaagttgtttagaaatagaccatggtacctttctgtttattctgcgtgccgagtagaaaagatttccaaccctcttaaaaaacacgaccttagttgtcagccatgtatccagattctagaatatagatatcaacataatgcatagtagtagtaattactccctccgtctcaaaataagtgcagttttgcactattcacgttcaacgtttgaccgttcgttttatttgaaaattttttatgattagtatttttattgctattagatgataaaacatgaatagtattttatgtgtgactaaatattttcaatattttcacaaaatttttaaataatacggacagtcaaacgttaggcacgaatatctacggctgcacttattttgggacggaggtagtaagtagtaacacgcaggttttgattggttcgtggttaaagtcgtcaggatctccacggcggcgtaggatagggtcaaacggtcggtgaccggcgttcgttcgctttgtcatcctgagctcagccctcgggactctgaatagattgggaaccgggcacgaaggctgcgagagcaggtacaatagatagccagctgcttttgtccaccgctagg

SEQ ID NO: 6703 - DNA, 1501 bp, Oryza sativa
tctacttatcctttaggatgctttagaattcatgagacactagttggagggtgagagcatgaaagcacctctccacaatttaacctactgggtagtgaattgggacaagatgacacggtgagggttaattatcgctgcaaatcttaatgtgctaatatcctacagtgagaatctgcaagcaacatcttaagggcacatacaagtataacacagtttaacatgtcaacaagctagatcaataaatctcacattagagccatcatttttcttttatcctaatacaagacaaggaaatgaacgtgcagattccatctggcacattattgagtagagaaccaaaatatctacccagcaatgctggcttagtgctcaacaactcaagcagtgaattcaattgcactaaatctgaaccacatatgcttaaagacacacaagcgattgcctccgtgaagctaaccaactagatcatcctaccaaagcgcaccaagcaaatgcaagacagtaatcagcgctcgcatcaacagattcatctcacctgcggcgctcccgaagagctgcagctgcagcggcgaggccttggcatcaaacacgaactggctctccttgggaatggaggcgtaggggaaggaaccaccccagtggccactcccgaacatctccccgtccatcctgctcctctcctgccaacaacacgcagaacaaaacacagcacaaatcacgcgaatcccctccaaaataatccgtgccaggaagaacaaggacccgacggattacccccgagacgacggcgacgcgatctctcctcgatcagcgacgaacccgatccgatcctgcgaaaccgtaacctcgtcaatgcgatgggggaaaccagagacaggggtcaaaccacgcggcgcggctgcgggagaatcgcggaagggaagctgaccggagactccgccgactcgacgcgccgccgccgccgccgccgcagaaaccgccggcggtttagggttggggaatccgcgagaggagcggcggcgttgggaaatccgcgatttattggtattttttttccttttttttatttttatttcaccctttcgctttgctctctgcttggttggtttaaaaagaaagaaagaaaccgcaagtgaagaaaaggaagaaggtgtgccagagtgtgaggagacggatgggcgggccttgattgttggctcggcccatttagtttcggtccatctgtgtgtcactacggcctgttttaggttcaaggtgggcccatgcatcagccaccaaatcagcccaggaaaatatacgtgtggcccatgaactaaaccaaacaagtagtcatcatactacttctcctaggcagggttacaatctcgattagttagcgaattttgagccccatcaacacattttgaaccatttctacaatctcgattaatttcgaaaattccagccgctcggaattcgttgagattgtgaactctgcttttatgtaattactttatttaga

SEQ ID NO: 6704 - DNA, 1501 bp, Oryza sativa
tctcagaatatagcaacttctctacatactccctcatttaaccgatcacaatcatctctcatttaatttctccagctacttcctcatctcaaccaatcacaaccatcccccatttactgtcatccctcaccttaatccccgcgaaaatcatattttgggatggagggaatagaaaaacataaaattcattccatggttgattctgcagcagttcagcatagccaagaaaaagcaacagtgtttgaatcttgagttgacgaaattctcaagtatcatgcagttcaatctgataatcaatatatctttgaattatttgaatcatattttacatcgaaattatcgttattatttcgtttagagtattataaaaatttcaatcttttccaaattaaatatcctacaggtggacatgtattccagaaagtggtaaggatttcaaagggtactatgacccatatcctcaaggctctgtccccaagcaaggaagctccgtaaatccacaaagttaattgctgttgtcacaaagaaatgtgaaaattgactaaaatactcaaatcagatcaagcatctgaaaatatattactccctccattccaaaatataaggcataaccaccctgacggagcgtggggctcctcaccgggagaccgcgcagcccccctttgccggttcggccgggggccctgggtgaggttctaagctcttggtctgtggaaagttcgcgagagtgaaatcacacaagacacgggcgatgtatacaggttcgggccgctgagaagcgtaataccctactcctgtgttttggtggatctgtgtatgaagaagctacaaagtgcgagccagcccccaatcgttctgggatccttttttctcctccttctctaagtgggcaaggtcctccttttatatctcaaggggataccacatgcaccatctctccctctctttcttacttcccttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctcttgtcctgacgggatggggcgaggcgtgcgtcagaccgcctgtcgccacctaacccatgatctgaccggtctgtgactgatcacagaccggataaacgagcgcgctgcacttcgttacatgcggcgtgacgcgctcgtccaaaccgcaataaatgtggttaggtgagccccgctatgctcacctaccccatatacgcggcgcaaaacccaca

SEQ ID NO: 6705 - DNA, 1501 bp, Oryza sativa
tgcagggagccttcataaggtacttaactaagacccagttactctgagttgccgttaattatttagagaaatcttttttaattatttgcatttcaatagcaatactccctccattccataatataaggcacaaccactttttttagatgttccgtaatataaggcatgcatgcatatagaccattaactatgacctcttctccattaaattattacttttttaaatcctccactctcatgttctctaattctattggatgtatgtattgtatttattaggatgatccaaactacaagatgataataattattttcttggtctttgggttaggggtgtgtcggtgacatgggaccgggagtattatgacttagagacttgaggcagacacgatcacccacgtggcctaaccccctcgggggggggggggggggcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacgacagccatacaaatctccgtccattaatgaagagaagggaagtaagaaagagagggagagatggtgcatgtggtatccccttgagatataaaaggaggaccttgcccacttagagaaggaggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagctttttctgttcagcccaa

SEQ ID NO: 6706 - DNA, 1501 bp, Oryza sativa
tggtctgaaatcttcaagtatatatatagccttacagcgtgacacgttgatgatgtgccccgtgctgttaacattgtaattttttttataaaaaagaaaatcttatcatcgttcataattcctcccgttttattgctattatttgagatggagattgatcactttatctgaactcgagtacgaactggtgggcagtgtttgtgctgttgctgactagtggtcatggaaaagatagggctcgggtggcctctgtgcacgctggcagggcagcaataccctggccgcgtcctctccataaaacattcagataaactcaactcctttttccccagctgttattttcaccatgtttaatttttacctttgcattttgtatggcccaagaggccaagaagcctgtgccttaggtaaatctccagtaaatgtagcgtagtttttttaatagacaaaaatgcaccttctcatgtggataatatatttttgacccccaaaaattgtaccaatgagcatacttttattcctgttatttctttaattttcttgggagaaatgtgagatgtcgctttcggagattaggtgattttttttatatacacttgctcccagtgttaggtgatggatgacaaagcgtttgtgacttgtgatctgtaagttgagtggtcaagccgctgtttcctttgcgatttggtaccctgcgtcctgattagtggtagctaatcgcagcaattatataagcaaaccatatctctaagcgcacaggatcattgtttggttcgatacattttctccagtgaagaatcttgcctgcttttgggttggtggcgatcttgaaagctaacacgcacgtaaaataaactatgctaaatggcagggcacccggttaattatttcttttcctgcctctgggaccaacatccccggatactttcagccatttgatctagtgtcattagatatgggaatataatctcgttatgcgaattttctcccttattttgctgaaacctattttgcttaaattgcaccacccattgcaatttacacaattaaaatcaagatattctttttatccgaatgtaaccgcatccataaaaaaaaaaggtactctgctatccaaaagaaaacgttgtgttgcaaaagaatagaaaaaacagaagcagaaaaaaaaacataaaaataagtaatgctagtggcaaataagaagaacgcgaaaacaaacgaccaatttacatgtctaaaatctcaaaaaaaaattggttaaagattttttaaaaaataaaccaagggttggaattttttttctttttatttaaaaaaagaagaaaataaaaataaaaggaaaaggaaaagattaagcagaggttggtgatgctgatgcgtccggtgtggtgggtgctggggctgatcactgcagataaaaacgccacgcgaatccactacctcccaaaccccgagacccccccgcctccaccaccacccgccgctcgccgctcgcccacca

SEQ ID NO: 6707 - DNA, 1501 bp, Oryza sativa
aggagtgaatgtaagcatacaaccaatgatcgagtatttagatgacttcttaggttctcaagcatttaatttatattttcatttaagttttaaatacataaagactacaaataaaatcaacttaattatttgaaaaaactcaaatgtgaaatatgtctaacttttgtggatggaaggagtattatttttcagacaaattatatctaaggagagtacccaatttataaattagaagtagatatctcttgctgacaaagtaataacatccattttaatttttatgttctaaaaggtctcctaataaccatatctttagaaatacttagcacactatatatattttgcaatgcttctctgcagatactgaattactgcacacagcacacatcatatcgactttgaggcggcagagagatagatatatacagaacgaaatggtcaatgcatggtgggtatatatatatgtgcactctgcataaacctgtaaattgaaggacacaatattgtcctcacaattttactaacttttaactagcaggagcctcacatgacgagatataaactagtctcaacgtccaaatgcttggagggccaccacttttattattgacacaagtttgcatcgatcatagtttttttttttttggaaagagatacatcggttcaaaatttttatctccacttgttaattaaatatatacagaactcctgccaattagtgcaactgcaattaattggtaccttgcactattaaactaaaaatcgtggcacacgagcgccatgatacggtgttatcaagtactcccccagtttctaaaataaaagttatgacattagttagttttctttacggtctctaacattgatctctttgatttattttcatactatgttatatgaataactacaaaattaatatcatgtgagaatattttcaaagacaaatctaacgattcaattattagtcaaaaattttaaatgttgatatatatatttcctgatcaaaactaggacacgttgtattttagggaggacgaagtagtagtacctctctatttaaaacatacaacattgttgatttttttttcggtgtttggtatataactttggccactattctattttttatacaatataatgataatatctaacaaaattatagaattgtgaaagtacttgtaaagaaaaacctaccatacgatttatgtttcaactaaacatttcaagaattaatagtcaaagtttcaaaagttattttttaagataatggataatatctggtctttacttcaatagaagctacaaccacttattaccaagtttcaaaagtttgacataataaaattaacaccattatatatatttaaacacgtacgttgggagtatagacaatcacgcatgggtggatccaaagacttggagctttgtaacaacaataatcaccgcgtacatatataagatgatcgctagctagcaacttgctatgtgcatgcatggagta

SEQ ID NO: 6708 - DNA, 1501 bp, Oryza sativa
aatagagggtttccaaaatatgtgggtgatttgttgcaaaagaatatttcggttctctgcaatattagatatatacatagtgaaacattgtgagtacactaggtgaaacattttttttggaaaaaaaataaaacgaattcccttaatagagagtttccaaaatatatgggtaatttgttgcaacggagtatgtggtggagacacgtagtaggtagtcagtgacacatcgtggggcccagggcgcacgtgcgcacgcgcgtcatggggggaggggggagcgaccgatttttcccctccctcggcgaccgaggcgtaggataatcgaatacttattgaaatatataaataaaataatgtgaaaaacttaaaaaacatttattgcaaaaaaaaataaaaataaaatatttcgatcagaatatagtcatgtgatatcttattatacagatttaattaaaatgaattaatggtgtaatcgaatcacaaatttgatagatgattattggaaaaaaacatttaaagcttattaaaaaaaatgcatgcatgtgtaggggagagagggcaagagtagtatgtgtgctatcttatgtgagagaaaggttttggtattgaaaaagagacaatatgcatgttggctcataatctgaaaaaagagttgtacggtgcgtccatcgtccaagtgtccgatagtttgcgctggatcggtcgtccgatcgtaagcattttcgataactcgatgatggctccagagcggaggcagtgaagtaaagcttgaatagacgacgggatacataacaacttattttgaaaactttttgttcatacatttcaaccttttattttggataggcgacatgatgcatatgcaaaaaaaaaattattcatggataggtccacttctttttgacttagtaatgtatatgatctcaatccgaaaactatgggcaaatcagtcctccaaagaaaaacaaaaagaaaaaagaaacaaaatgggaaaaacattttgggcctattcagattcatgccattttaaattataccattgtttggtaaaatcgacaaaatttaaggcggtgtttagtttattacgatatattggtcatgtctaaagaatttgacaatatcatatttaatctataattaccaaaacttgataatgtaacgatgcctaattttaaaaaggttaaaaataggtatatatattatttttccttttaactttccatcgccaagccggaggaggacaaacccagcgtggcgcgggcgctgctcctgcctcccacagtcccatggccatccagacccagacccacccgagaccaccaccattatctgtatcttccaccacctcccctctcctcctcccgcacagcgcacacctcgcctctcctctccggtctccaactctccgctgccagcgccaccaccaacaaaccctaatttattcccctccaccgcatctaacacgctagcgcagccagccacagcagcaacgcctcactcc

SEQ ID NO: 6709 - DNA, 756 bp, Oryza sativa
agatttattgtagtagaaaaaagtctcatccaataatagattgtttttttagaatgaagggagtatagatgtgatatcattgttataggatatatcacatctatacaaaattgcgctcctacttatattgggatggatgtactccctacattcagctagaactggatatatgggtctcacatattctattcttgtaaatctggacacgtatagcaacttgtactgaatatgaatatctagtcttacgagtctcaggttgctatctcttggatggaaagagcagtactttctatgtttcatattttaggacattttggcttttttctaattaattttgttttaagtttagtcaagtttataatataaatatagcgatgtttttaacaaaaataaaatatattatcaaaacatatttaatattaattaaactaattttgtgttatatatgttgccaactttttatataaatttggttaaaactttttaaaaaattgaatatggaaaagtcaaagtgacaatagagtgaggtactccacaataaacgtgtggtaccatttccattatcaaatatcagtgagtacaatttatctctccaattcagttaaaagtaacctctagcacattactagttttttaggtgttctttagtcatgacacatctttgtgatgtctatagtaaattacataaaatttaagtgttttatagcaaatttgctagttgcatggatatatgtaattcatttaattatatatagg

SEQ ID NO: 6710 - DNA, 1501 bp, Oryza sativa
taaaatttttacatatttactttagcgacttaaaaaccaatattgaaaaagctactaaaaaccattaaaattagctataaattaagtttttaagtttagatttcgacaacaagcctacttcctctgtccaagaagaatcaacctaggaggaaacacagatgtgacctctcctagggctaggaccatgcacgtggacacatcaatttggaggggttgatccttcttgttttggtggagggagggagtattttggagcggcagcgggccgacgtggggcgggcaacgcggtgacggacggcacgaatcacgacgtccccggagccgttcgtcgcgttgaccggctaagtcagcaccgtacagtaaagaaaaggaaaatctagaaccagcccccctcctcctcctcctcctcatcacctacccacacgtcacccgtggccccacatgtcatacgcgcagaccaggtcatcccacgttcgaaaagaaaaaaagaaaaaaaaatcaaagcacgtcgtcacctctcctctcaccttcctctcgcccgttcaacgacgccaccgccttgcctccgtctatttacctatttagcccccgcccaacccgcccggagacgagacgccaccggagttccccccaccaccgctcgccgccttctccgcctcgcctcgccgccgcgtcgaccgccatggctgaggtacggccccgcgacagaactccttgtttattcgtttggtgttaggggcgcggtcccttcctgcggtcctggagagagaagagagagagagagagagagagagagagagagagagagagagagagagagaggagagggttgatcgataggggtagatggggaggccaagagaggaggattcctcttttttttttttggcgtcgagttgtttgaatatgggggaagaagcgtgttcttttagcttgcgtgtggggttaattagggatctgattatgatctgatgattggccggcgcgctgatcgatcagcttgcttgttcttgcgcgtgcttgtcttggctttccttcatcgtgcttgcaggccagggtatgacttggggatgatgttttgggcgaaatcttgctaggagggcggtatacctttcagagtttcagtagttcaaacaccaactgatggacaagttttagaacttcatggtgggggtcgaaactagcttgatgattttgatttgtgtacgttcttgttgaaacgagtacagattgcggagtaggcccgattggatagttgttgtacctaccttaaatgagccatcttgttggttatggtctgtgagttcaatgatagagcatgattgtccccatctgattattactagttcccttccagaatgaagcataaattcatttaattgttgtcggttacagtaaatcttgattgggaattatgatgtattccgagtaccatgtggcgtgtgcgaagatgtgattgaggacgaatgaggacttagctgatccttgctatttttgtcta

SEQ ID NO: 6711 - DNA, 1501 bp, Oryza sativa
gaacgtacacaaatcaaaatcatcaagctagtttcgacccccaccatgaagttctaaaacttgtccatcagttggtgtttgaactactgaaactctgaaaggtataccgccctcctagcaagatttcgcccaaaacatcatccccaagtcataccctggcctgcaagcacgatgaaggaaagccaagacaagcacgcgcaagaacaagcaagctgatcgatcagcgcgccggccaatcatcagatcataatcagatccctaattaaccccacacgcaagctaaaagaacacgcttcttcccccatattcaaacaactcgacgccaaaaaaaaaaaagaggaatcctcctctcttggcctccccatctacccctatcgatcaaccctctcctctctctctctctctctctctctctctctctctctctctctctctctctcttctctctccaggaccgcaggaagggaccgcgcccctaacaccaaacgaataaacaaggagttctgtcgcggggccgtacctcagccatggcggtcgacgcggcggcgaggcgaggcggagaaggcggcgagcggtggtggggggaactccggtggcgtctcgtctccgggcgggttgggcgggggctaaataggtaaatagacggaggcaaggcggtggcgtcgttgaacgggcgagaggaaggtgagaggagaggtgacgacgtgctttgatttttttttctttttttcttttcgaacgtgggatgacctggtctgcgcgtatgacatgtggggccacgggtgacgtgtgggtaggtgatgaggaggaggaggaggaggggggctggttctagattttccttttctttactgtacggtgctgacttagccggtcaacgcgacgaacggctccggggacgtcgtgattcgtgccgtccgtcaccgcgttgcccgccccacgtcggcccgctgccgctccaaaatactccctccctccaccaaaacaagaaggatcaacccctccaaattgatgtgtccacgtgcatggtcctagccctaggagaggtcacatctgtgtttcctcctaggttgattcttcttggacagaggaagtaggcttgttgtcgaaatctaaacttaaaaacttaatttatagctaattttaatggtttttagtagctttttcaatattggtttttaagtcgctaaagtaaatatgtaaaaattttacttataaattattattttttcactaatacttctttcgtcccgaaaaaccgaatctagtactggatgtgacatatatctagatttgttgtactaggatgccggtgctagattggttttttatgggacagggggagtatgttgttatggttaaatagtcggttgtagggcaaccaataagaactcaaatggtgaatagtctggcaggaagagtagaaagtcctactccgtgtgatcctaacatatttagaattttagctaaaatttgattgtattttgtaagatggaaacaa

SEQ ID NO: 6712 - DNA, 1501 bp, Oryza sativa
tcaattcacgatttaaatacaaagacttgacctagaccatatttgagtcactttgagtttttttaaaacaacttttttgatttaaaaataaaccaatcaaaaaacttatttctaaatcttaatctttgagccaaacaatattgcaagaccaacctctcataatatggtagtgttgtttctcatgcaagtattggcgtgacaaaacattcatgatggaaataagtttttgacatttatttttaaaattaaattcaaaaagaataaaaattctaaatttgagaactaattaatcttataggcaaagggttaacagaagcttagatttatatatatatatatttttcaataatgctgacgtggcgtgctgactcaggaccgaatattcccgtgaccccgtgcagattgggcctttttttgaccggcccacgaggagccaaaccctcgcatttcctcctccgactccgccggcccactcgctcactgcgccgccgctcatcggcgcgacgctccggcggccggcgctcgcgggctccgagccggtcgccgcctccctctgctctcctctccgtcgccctctcctccaggccgccccctccggtgctccaccgtcgccctccctcgctccggcagctcacgctcgggggctggccgccgtcgccctctccggcagggttcaggtatcctaatcctccctaggatcaagggttcgccgattccgattggttgttaaacccagcatcccttccgcgtagaatcctatgaaagttaggagatctattcgaatgcttgtactgttgtacagctgcacctgcattggccattggagatcgaatgtaatgtgatatactattagactgacagcagcatttggtctcaagtgggttaaaatatgtgaaagttagagaaagccgtttttgttgatatgtaacgtttcggggtagcatttgtgcattattatgatgatctgatggagtttaggcttattttccaggggaaaattgagtattcgcttctctttttagggcttctatttttaggggaccttcagggtttgcccctatttttgtatgaattgaggattcgcacctgttttcgtaaaagtagctacaataggctcatatctaggtattttccccattttagtttattttttttctaaaacttaaatacatatacgaaaagactattgtgcactggttttttcacataaggcatctcttatatcactggcctctggggagcactctcttctggagatcacgccgacaacggtcgtgcggggtgaccactagcgttcctgcaggtgcagctgtgcgggtaagtagcaagagtgcctgctgctgctgttcgtgctggtctctaactatgccggcatcgtaactgaccattgcaatacttatcacttatgtagctactagaattagttctcttgatgacacatttgcactgaaatgatcttcttcatttgtgcttcatctttttgacagaattgcatttggta

SEQ ID NO: 6713 - DNA, 1217 bp, Oryza sativa
cagcttgttaatcgaccaggaacatgcaccgtctgtcgccgtacttccgggcgaggcctgcgcgcggcggcatgaacgctcgtaagcgtgaagcgtgggtgtacgtcgccaccgtcgccgccaccaaagctgctggagtgggtcgtccacgactatgagacctgatctagtctgtttagttgaaaccattcacaatccatgggttcaatctatggactgaatccatgttgtactcagaaaatcgtaaccatcaccaaaccaccccaaacctcttttctggtggatccaaaccaatcttcagtccaaccaaagcacacccagatacaaaaccaatccattcaacccattacttgctgcagttggctgccggtttgaacagccgcagccgcagctagtgcctccgaacaagtccattataagcaaaattaatttttcacattttcatgcaactttcctcgaatctctgccatgatttgcatgattttcacgtcgactagaaaaacaaaataatgagcccatacactcaagggttcacctttctgattgagcgtaggatctttgatccaagcgatatgataattttcgtcaaacttcaagaaacttctactctctccgtccgtgaatataagagattttgatattttgtttgcaccgtttgaccattcatcttttttttggaggttattcaaaaatttttgaaattattatttattttatttgtaacttactttattatccaaagtaatttaagcataatttttcattttttatatttatacaaatttttttaataagacaagtggtcaaacgttatattagaatagtgaatatcccttatactcacggatggagggagtatataatctatgtcgaatttgttatttcaaaattatattctcgaaaaccattcgaaatttccctccgaatcttctcccgttccaggtcgaaacctctaaattcgatccaattttgttaaaattttcacggtttcgaatcggttctcgcccaaacaaaaaccttcacatccacatccgcatccactcccagcctggccgaggaggcactgcgcggtgggccccacatggcagcgacgcccccctgaccccactccggaagacacgcgtccgctccacgagtcataggcgaggtctcctccctttttccgccgcgcgtcggccttttcctccttcctaacctagggctccgatttcgccagg

SEQ ID NO: 6714 - DNA, 1501 bp, Oryza sativa
aagaatgaagataatacaagctagacagcgaaatgtaaaaaaataagttccaacctaattcggcaacatatggacttagaatatatatatatatatatatatatatatatatatatatatatatataacgagtttaatgctctaagcatgatgctaattaaggtagcaacttagttcaatccgatccgggtaactttacattcaataaatgtgtagtgtgtagatatttatcttgctccccaacatataatctttattattgtgttgttacttttgtatggatatattagttgtttaataacacattgatgtttgaatcctattgtatctgtcactgctgatgtgcgtgtttcggataaaatgtaatgccaagtcatcaacggcgacatgttgcggaaaaaggttaacttgtttgactaaactaagataaagtgagagctcatatgaagcactatagacaaaaaagaagtttcaacatcttgtggatatttgcatgattgagcgaaaaaaatttcttaaaaatcatggtgtagtcttgaggctgtatcttgggaagttcatgaagacatgcaaccagaagtaaaatcaggggggcaaggatatgtatataatattgcaacgagaaaaacaataatataaacatgattaattaaaaatgagaagttatgcaggggagtgcctatctcaccttaaggaagtggctcttcgaccatccaataaacctttttttttggttctcaaaaaaaaataaaacccttttttttttttttgctatgggtagaaatcaaatttgtgggggcgttttgagatttataatagcacagcttgcagataaactccaagaaacagcaagtccatgaagagttgttctgatgcatatctcatgaaatatatatagctacttctgcgtgcaatttattcacctattttttatttcaatcaattacaaccttcgttcatttaattttaccccgctagctactccctcattcccaaaataagtactctctccatttcaatttataagacgttttgactttggttaaagtcaaactacttcgagtttgactaagtttgtagaagaaaataataatattttcaacccaatataaatttattatgaaaatatattcaattactgatttaatgaaatgaatttggcattataaatattactatatttgtctataaacttagtcaaacttgaagtagtttgactttgacctcaaaacgtcttatgacctgaaacggagggaatatttctagaaactcaaattttgtatacatttataagcatttcttagacattaatttaaatgcatattcctaatttctatttcctcgttttctgtgcgcacgctcctcaaatcgctaaatggtacattttttaaaaaaaatacataggaaaggtgctttaaaaatcatattaatcttttttaagtttgtcaaggttacggataaggtataccctctatccttggatatacggtgggtaccgata

SEQ ID NO: 6715 - DNA, 1501 bp, Oryza sativa
tcggaacgagattgattggagaagtgaactgcaaatgcactccataaaaggaaccaccatctgccagggtgaccagttttttctttttttaagatggtggagagcagtttcttcataagagaatgtgttacccgattttggagccatttttcccaacaagaatctgtcgttggctttgctttggtgcaatgaagtgttgttccaccctaagagaaccatcttttagctccttccagtccatcagacgatggtcaattacataaggaatttcctgcatacatttacccgaacataccatagcagacaattccatcagaatcaagagaaaattaacaatatgccactccatagaggtggctttaacaatatgccacccaataggatgtccttataaagatgccactccatagagcatacccctaaataaaatgccacttttggctgtttagaggttttgattactttgtttatattattttatcagactcctcacgcgaaatgaccgaaatgcccctttcatatcgtttagatccagagtcagattctttctcttctctctctcgatacttctctctcggccggcccgggcatgcggggttgtcgccgccggttccacgccgcccctccggtcaccccctccctgttatggtcacccgtccgtgccccccaccaggcgtcggcgtgcacccggcccagcgtcgcctccccgccgcccccctctgctaggtacaagtcgctgcccccccccccctctcaccacctcgccgccctcccttcccccactcccgccgccccgccgctccccctggtaggtagaagtcgccgccctcccttcccccactcccgccgctcctctgcctccaatgtaacctcggcctctttctcctctcagacagtaaatagaaggttgacaacatgagctcgaaggatttgtcctcgaggtaaaatctttcatatcgctgtacattttatattttcatcgagttagatttctaactcgcttttttctcttgtcgattcaaatcgtttaggttggattcagaactgtctagagtagagatgcagttggttgaatatgggacaagttccatttcagcagtttcagttctagcttcagaatgtctagatagttgtacaagtgtgcctttatgccttgagtatggggtgatttcagaaccagcagctccaactgttggtgtagaacagcaaccttttcagtatgttgattgggataacttggagatagatgaaacgttagatgatgagggaaggattcaggtcatgaatgatgaccaattatacgtactcctaggcttgagggatgaggaaagggcaaaaaaatcggcgcatgctgctggagcgaatggttcaagtaatgctgctggagctgatgattcaagtaatgctgctgaagctgctggagtcactgacggcatcgagggtgcagcaattcctgttgatgattcagtaccgggtgagcttgttataagctatgacaaga

SEQ ID NO: 6716 - DNA, 1501 bp, Oryza sativa
ccccgttgggggcgggacccgtcgggtacccgcccctacgggaacagggacggggtgaaatttcaacctgcggggctgcggggacggggccccggaactatgcgggggcgggggcggggccacaagctcacccgcgggtgacccacggggccccggaatataggatctaaaatatggcatacagcccataatcaaatttaggcccatatagcccaatatatatatacagatcagtaaagagaagccaaccctaaaatcaatcccgtgagtttgtcaccgccgccaccaatctctattctcgttccagtagttttgacttttgacgctatcccacaaatcacgcaacacatcacacgctgcacgctacttcggcgcttcctcacctccacaaatcacgcctcgcgagttggtcccgcaccatcaagcagcggcggtcggcgctcttccacgctgcccgtatcgttgctctcacggacgccgtctccccatcctgccatccgccggcgcctcatgtcgttctcctacctctccagccgccggctcctatgctgttctcctccttctccgaccgttcctctccctccggctgctgcaggttctccacatcattattcccttcctccacccggctgctgcaagtttcccagaccattctttccttcctccggctgctagcagtcgccgctcgcatctgggtgcggggccccggaggggccggggccggggattgattttgccccgttcctcactccggggccggggccgggtgaacccgcaaggatgcgggggcggggccgttcctatccaaccctcacccgccccgccccattgccaaccctagtttagggaggcgatttagttggcccgcccaattttgttagcacactgaatgtttatgttttttgctcttgctaggggagtaggggtttttgcctttttggactaagtagacttctctatggtttttgaaaggatttcccattgactatttgccactcttatgagtggtgctaaattatttgtcactggacccacatgtcatatatatgtgagggcacacatgacatagacaacgagtggcaaaaaaattaattgccatatcttaaaagtggcaagaagttaaatatcccatgcgcatttgtgattaaggagtctagaattattgcttttgaaatgtaaggagatactccctccaaatttgtgcagacatacacgcacatgccacactcacattctcgcaaatacgctctctaacacatactctaagaaacaggaaaacctgtggcatatccgtgatctcgctaaagttctattgaaactttgaagcctacctacatatgcgtaatattaatgggcatcaagatttgaaccctttgtgagaagttatgcacccacaactataccaccacgtcactagttcttactcctttcattttaaactaaccaacatcatatataaatgaaaatgggaaatggaaggggagtgttaaggaagacaaca

SEQ ID NO: 6717 - DNA, 156 bp, Oryza sativa
ctcaccgccctgcccgccgcccaggcccaggcgcccggcgccgtgcgcgaggaggcctggcgccaatgcgccgccaccaccgacaaccaggcccgcctggcctgttttgacacctgggcgcagcaacagcaacccctgaccccgcccccggccagc

SEQ ID NO: 6718 - DNA, 1501 bp, Oryza sativa
ccagtaaaatttgcacaagctttggagcaatgtaattattccaaaattttccctcaaaatctcagttttctctcctcttcctctctctcccttctggacttttcaacaagtacctagcatgcgagaccgaggtcgtcgcttccaagccgacaacgccaccctgcccgcaaatcccgctgcaaggctgcacaaagccgaggccgcctctgcccgatgccctacctcgatgccgcgcctggcaaagtcggcctcgtcgcgagcctcgccaacccggagtcgccgccccctgccactacaagaaatttggccttctatgacaaaattcatatgacaaaacacattttagtcacagtagtgatgcctttatgacaatttttctttggatgacaagcgtttgtgactaagttgtaatttagtcataagaaaatgtcaccatgtgcctttcccattctttgtgacaatagttcatgacaaaagtgaataaatatgattgtcataatttaaaaatcatttgttttttaaaaaagaacaccttggcacagccacgtgagcatgtctaggtggacatgtgggacccatgtgtaagttagaatattaacttgaaaagactaaaaatgtagcgcttcttgcaatgaggagggatcgaacacacgacctctggcatcccaggtaacagacaaaccactgagctaatctttgattcttttcatcttgtagactattgctgggagacataagaatcccaacgcacatctagcaaagaccaacgccgctgccctttccccatcgcggctgctggacccgacgccgccgccactgccctttccccatcgcgcctgctggacccgacgccgccgccctttcccattgctcccgctggagcccaacgccgcaggctgtagccccaccctgtccccaacgtagcgcccggctgttggagctcgacgccgtcgcccttcgcccaacgcggcttctggagcccggcaccgccggctggatcccaagccccaccccatccccaggagctcgatgccagcttgctgcagctccaggacgccgggcttcatgggcacaactgctgggaacgcccccaagagcccgacgccgacgacagtagcccgcccccgcctctaggatctcgacggctgggccggctggctgcagatcctggccgctgggcttcacgggctcaaccgctaggaagcccccaagagctctagcctgggatcactgccgacggcgggtgaggtcgaccagagactgccccatccccttcaattaggaaggaaaggtacatatgagaagaacttatgttttggttttaaattttgaactgaaaccatagatttgaagtgatagaaataggaaaatagcagtctgggcaatgatcagtcattgattcaatgcttgtcttatttcaatatgtaacagatggaaagaacttggatgaattgtaagttgtttagcaaggagcatcgggagggggtcactgagttcatgg

SEQ ID NO: 6719 - DNA, 1501 bp, Oryza sativa
actccttcctgccccagatccggcggcgatggcggtgtcggcggcgtcggcaggtgggtccgtcagcggtggcggcggctgatggccggcggtggctccctcctcccctgtcgcctccctcccgccctagatccggcggcgatggatccgtcggcagtggcggcgtcggtggcggccgcggatggatccgccgacagcggcgacggccgagggtgtgtagttttgtgatgtatgtatgtgggatgatttttttggggataaagattggttgaatttttcttgcggtgtgttcatgcgatttgggtgtgccgatgttggaaggtgtgtcccgtatccgattcttagtgcgattgggattcggggggtttcattgaattcccattgtgaagatgattgaattccgattgggaatttttttgggtgggggcatgcgtgtgtgggaaatcggcgacggaccaaaaataatgaaggaagccttacgtattttttttattaggtatatatatatatatatatatatatatatatatatatatatatatatatatatatatatatatatatagaacaaaaaaaaccaatcagttatctgcatctcaaataaaaaggagaaaacatcaaaatttgttcaaattgaaataaaaatcgtaaaacttctttcaattttcaaaaaataatctacacatgcgaaaaatcccagaaaatcaccaaataaagtaaatgaccacattaagctccagtaaaatttgcacaagctttggagcaatgtaattattccaaaattttccctcaaaatctcagttttctctcctcttcctctctctcccttctggacttttcaacaagtacctagcatgcgagaccgaggtcgtcgcttccaagccgacaacgccaccctgcccgcaaatcccgctgcaaggctgcacaaagccgaggccgcctctgcccgatgccctacctcgatgccgcgcctggcaaagtcggcctcgtcgcgagcctcgccaacccggagtcgccgccccctgccactacaagaaatttggccttctatgacaaaattcatatgacaaaacacattttagtcacagtagtgatgcctttatgacaatttttctttggatgacaagcgtttgtgactaagttgtaatttagtcataagaaaatgtcaccatgtgcctttcccattctttgtgacaatagttcatgacaaaagtgaataaatatgattgtcataatttaaaaatcatttgttttttaaaaaagaacaccttggcacagccacgtgagcatgtctaggtggacatgtgggacccatgtgtaagttagaatattaacttgaaaagactaaaaatgtagcgcttcttgcaatgaggagggatcgaacacacgacctctggcatcccaggtaacagacaaaccactgagctaatctttgattcttttcatcttgtagactattgctgggagacataagaatcccaacgcacatctagcaaagacc

SEQ ID NO: 6720 - DNA, 1501 bp, Oryza sativa
tttggattttctacgcatcattgcatttttgcatatttaaattaaaattgagaaaaacaaaacatgtgtatatgtgtttgtgtgtgtatatatatatatatatatactagcaaaggtgcccgtgcgttgcaacgggaagtgtacagaacaaaaaaattgagaaaaagttaaaaaaaatttacattatgtaattcattaaaatatttggtatttttaagtaggtaggtgtataattaaatcaatttacaagtaaagcaagtgtgaaaaataaaatgacatggttaaatttaatttgattaaattctccatgattagttatgctctttggaatttattggaattatcagagcttaattgctaatttttaataatacaaaaatcatttaacaaattatttaattggaaaaaaaaatcaaaatcctcctttctatgtttgggccgaatatagaaaagtttatattccctcccttttgtctattctatgtgtctggcctgttttctttctccattgaagtctattttgcgtcctccattcggtggcccaataggccggcggcccgacgtgggagcagctggagccgtccgatcgaatggacagtccagattaatcctaagctaaataaaaatacccaaaccctaaccctaggattcatttcccccctccccccgtccctccccccccctcgccgagcgacgacggcggcgccgccgccccccccttcttcccccgagcggctgcggtggcgctgagcagcgaccggcgagcggcgcccccgatcccctctctcaaagcgacggcggcggcgccccccctcctcctctccctctcgggtcggcggcggccggttggtggcggttgcggcggatccgagggtaggggcggcgtcggcggcggttccctccaccccctctagcctccctcctgcggcagatccgccggtggtggcggcggcggcggtagccgcgggtggatccggcggcggcggctcccttctcacctctcgactccttcctgccccagatccggcggcgatggcggtgtcggcggcgtcggcaggtgggtccgtcagcggtggcggcggctgatggccggcggtggctccctcctcccctgtcgcctccctcccgccctagatccggcggcgatggatccgtcggcagtggcggcgtcggtggcggccgcggatggatccgccgacagcggcgacggccgagggtgtgtagttttgtgatgtatgtatgtgggatgatttttttggggataaagattggttgaatttttcttgcggtgtgttcatgcgatttgggtgtgccgatgttggaaggtgtgtcccgtatccgattcttagtgcgattgggattcggggggtttcattgaattcccattgtgaagatgattgaattccgattgggaatttttttgggtgggggcatgcgtgtgtgggaaatcggcgacggaccaaaaataatgaaggaagccttacgtattttttttattagg

SEQ ID NO: 6721 - DNA, 1501 bp, Oryza sativa
aacaagctctgataccacttgttaggaaacgataagcgaacaaacgataaagaaaacaatagatcaatcacagaagacacgagatttaacgtggaaaaccctcccaaagtaggagagaaaaaaccacggacgccagccagcaaaatatcttcactatatctggggtgaggttaccacgccgcacggcggcttacaagaggtatatatatggtggaaccctaaaagggatgacgatccgttttgctccggcccaagcctcccggcgacgggcctccgctccactacggcagaagctggtctttattaagtgcaaatgaatttggattacaactcaacacagtttgccgtcgttgccgctggtactacccaatgagcaggagccgcatccctgccaaggctgccatcaccgccgccgagaagatgccggagctcggccatcgctgccacttagaagatgccggagcttggcgcgacgtcgaagcagctcgaccaagacaatgtggagaagaagctagagcaagacaaagataatatgatggatgatatgcgagcaaaggagttgctcaaccatgctctgctcatcaaggaacgacgagtttcaggccgtccggaaacaactcatacatgtaactcaattcatcaattttcattcctttctttgtctgatgatcaacatcaataggatgagcgagcgccgacggcagcgcctccgatagttggattggtttttggaaatggtttcagccaaaaatataaaatgggttggttcggtttgggggaaatgttattttggttgaattggtttgggtttcagaacacggtgggtggattggtttggtctggggaagcagctgtgattcgaatggttaggtttggatatggagtggattcaagaccattagcaggcttgctccggctcgaagacagcagcggctctcgatctggcaacgtgcaacaacagcactctaccgcccgttggcttgaacagcggcggatgcactctccggcgcattgcatcgatgataacggcagtccaagctgggcgggacctcgcatcatgcatctcgctgtttcattctcctatgttccctttatcgctctgctactccattgaggtgtaggtcaattttccccaattttttttatgtgcaaattcaaattttgtttgaaatttcgtatgaaatttccggaaaaaaaatccaaaattttagaaatttcgtaatttcgctgacccttaaaattttcctctttccgatagatcaaaccctgcctgtacctctcgacgtcgccctattgatgatccacagttcaacgtgagactctggggcaaaaacgagatctaacaccaaacctacggcatcccacgggtttgaggatacaatgcagtctcctatgttagctcgaacacaagatcacacacacacaatggaagtatttgtctcggcactgcacaccagcagcaaatgtacacacgcacactgctgcacttctattcaccaca

SEQ ID NO: 6722 - DNA, 1501 bp, Oryza sativa
atgaccaatggttctccatgatgtatccaccgagtgtatgtgttagacatcccgtacataagtaagtcatcctccacacgtcctttatattgatgtaaccgattcaaacacttacgacatgggcataatatcttctgactgccactcaaatttttacaaacaaagtccatgaactcagtgaccccctcccgatgctccttgctaaacaacttacaattcatccaagttctttccatctgttacatattgaaataagacaagcattgaatcaatgactgatcattgcccagactgctattttcctatttctatcacttcaaatctatggtttcagttcaaaatttaaaaccaaaacataagttcttctcatatgtacctttccttcctaattgaaggggatggggcagtctctggtcgacctcacccgccgtcggcagtgatcccaggctagagctcttgggggcttcctagcggttgagcccgtgaagcccagcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggatggggtggggcttgggatccagccggcggtgccgggctccagaagccgcgttgggcgaagggcgacggcgtcgagctccaacagccgggcgctacgttggggacagggtggggctacagcctgcggcgttgggctccagcgggagcaatgggaaagggcggcggcgtcgggtccagcaggcgcgatggggaaagggcagtggcggcggcgtcgggtccagcagccgcgatggggaaagggcagcggcgttggtctttgctagatgtgcgttgggattcttatgtctcccagcaatagtctacaagatgaaaagaatcaaagattagctcagtggtttgtctgttacctgggatgccagaggtcgtgtgttcgatccctcctcattgcaagaagcgctacatttttagtcttttcaagttaatattctaacttacacatgggtcccacatgtccacctagacatgctcacgtggctgtgccaaggtgttcttttttaaaaaacaaatgatttttaaattatgacaatcatatttattcacttttgtcatgaactattgtcacaaagaatgggaaaggcacatggtgacattttcttatgactaaattacaacttagtcacaaacgcttgtcatccaaagaaaaattgtcataaaggcatcactactgtgactaaaatgtgttttgtcatatgaattttgtcatagaaggccaaatttcttgtagtggcagggggcggcgactccgggttggcgaggctcgcgacgaggccgactttgccaggcgcggcatcgaggtagggcatcgggcagaggcggcctcggctttgtgcagccttgcagcgggatttgc

SEQ ID NO: 6723 - DNA, 1501 bp, Oryza sativa
taattctagtagctacataagtgataagtattgcaatggtcagttacgatgccggcatagttagagaccagcacgaacagcagcagcaggcactcttgctacttacccgcacagctgcacctgcaggaacgctagtggtcaccccgcacgaccgttgtcggcgtgatctccagaagagagtgctccccagaggccagtgatataagagatgccttatgtgaaaaaaccagtgcacaatagtcttttcgtatatgtatttaagttttagaaaaaaaataaactaaaatggggaaaatacctagatatgagcctattgtagctacttttacgaaaacaggtgcgaatcctcaattcatacaaaaataggggcaaaccctgaaggtcccctaaaaatagaagccctaaaaagagaagcgaatactcaattttcccctggaaaataagcctaaactccatcagatcatcataataatgcacaaatgctaccccgaaacgttacatatcaacaaaaacggctttctctaactttcacatattttaacccacttgagaccaaatgctgctgtcagtctaatagtatatcacattacattcgatctccaatggccaatgcaggtgcagctgtacaacagtacaagcattcgaatagatctcctaactttcataggattctacgcggaagggatgctgggtttaacaaccaatcggaatcggcgaacccttgatcctagggaggattaggatacctgaaccctgccggagagggcgacggcggccagcccccgagcgtgagctgccggagcgagggagggcgacggtggagcaccggagggggcggcctggaggagagggcgacggagaggagagcagagggaggcggcgaccggctcggagcccgcgagcgccggccgccggagcgtcgcgccgatgagcggcggcgcagtgagcgagtgggccggcggagtcggaggaggaaatgcgagggtttggctcctcgtgggccggtcaaaaaaaggcccaatctgcacggggtcacgggaatattcggtcctgagtcagcacgccacgtcagcattattgaaaaatatatatatatataaatctaagcttctgttaaccctttgcctataagattaattagttctcaaatttagaatttttattctttttgaatttaattttaaaaataaatgtcaaaaacttatttccatcatgaatgttttgtcacgccaatacttgcatgagaaacaacactaccatattatgagaggttggtcttgcaatattgtttggctcaaagattaagatttagaaataagttttttgattggtttatttttaaatcaaaaaagttgttttaaaaaaactcaaagtgactcaaatatggtctaggtcaagtctttgtatttaaatcgtgaattgaaaaggactttctctaaatctttttatataaatcatggagctaatccgtaaacaacttccatgcatgttgcactttcaa

SEQ ID NO: 6724 - DNA, 1501 bp, Oryza sativa
tgcagtgccgagacaaatacttccattgtgtgtgtgtgatcttgtgttcgagctaacataggagactgcattgtatcctcaaacccgtgggatgccgtaggtttggtgttagatctcgtttttgccccagagtctcacgttgaactgtggatcatcaatagggcgacgtcgagaggtacaggcagggtttgatctatcggaaagaggaaaattttaagggtcagcgaaattacgaaatttctaaaattttggattttttttccggaaatttcatacgaaatttcaaacaaaatttgaatttgcacataaaaaaaattggggaaaattgacctacacctcaatggagtagcagagcgataaagggaacataggagaatgaaacagcgagatgcatgatgcgaggtcccgcccagcttggactgccgttatcatcgatgcaatgcgccggagagtgcatccgccgctgttcaagccaacgggcggtagagtgctgttgttgcacgttgccagatcgagagccgctgctgtcttcgagccggagcaagcctgctaatggtcttgaatccactccatatccaaacctaaccattcgaatcacagctgcttccccagaccaaaccaatccacccaccgtgttctgaaacccaaaccaattcaaccaaaataacatttcccccaaaccgaaccaacccattttatatttttggctgaaaccatttccaaaaaccaatccaactatcggaggcgctgccgtcggcgctcgctcatcctattgatgttgatcatcagacaaagaaaggaatgaaaattgatgaattgagttacatgtatgagttgtttccggacggcctgaaactcgtcgttccttgatgagcagagcatggttgagcaactcctttgctcgcatatcatccatcatattatctttgtcttgctctagcttcttctccacattgtcttggtcgagctgcttcgacgtcgcgccaagctccggcatcttctaagtggcagcgatggccgagctccggcatcttctcggcggcggtgatggcagccttggcagggatgcggctcctgctcattgggtagtaccagcggcaacgacggcaaactgtgttgagttgtaatccaaattcatttgcacttaataaagaccagcttctgccgtagtggagcggaggcccgtcgccgggaggcttgggccggagcaaaacggatcgtcatcccttttagggttccaccatatatatacctcttgtaagccgccgtgcggcgtggtaacctcaccccagatatagtgaagatattttgctggctggcgtccgtggttttttctctcctactttgggagggttttccacgttaaatctcgtgtcttctgtgattgatctattgttttctttatcgtttgttcgcttatcgtttcctaacaagtggtatcagagcttgttcccacattagggtttcacgatggcatcgatgaagtatgatctaccgctgc

SEQ ID NO: 6725 - DNA, 867 bp, Oryza sativa
aaatgatttcaactgaaaaagtcatcaacaacaaagttgtataactcagcaatatctataacttttattttggtaatttcttcatccgacaaagtaataagagatacgtacattttgtgaacaatgttacaaatcattttaccgaatgaagaaatgacccaaataaaagttataaatcctgatgagttatgccactttgttattgatgattttttcagttgaaatcatttagtacctgtaaatgttgtttgaagttgtcataatttaaaattcaaattcaaaactgttcaaacaaagtcatataaaaaaatgaccataacaaaagttgtagatgttgataagttatacaactttgttgttgacagcttttccatttgaaatcatttactacccgaaaaattatttgaatttcttatattttaaaattcaaattttatatagttcaattaaacttggatggagaaatgaccaaaagaaaattggtagatctcaatgagttctacaactttacttttgacaactttttcacataagttcatttagctgtgatgtagcaggtaggacccgatttgcttcgttcttgatgtggacgtgatttcattgtcgacttactgttctatgctgctgcagcgagctgtctagaagtactattttcattatagggcaacatgtgctatatatacagatagttgtatttcgtgcttttgatacaatgttgttagtgtatataagtaacttcagattttctatctccattttgctgaaaaatgtttctttatttgtgtttatgcaatatctgtttctgcatttttgtgagagccatgtgagattgatcatacgcctcattgtggttacgtagttgcagga

SEQ ID NO: 6726 - DNA, 1070 bp, Oryza sativa
cgtgatatgactaaaaggtacttcctccatggatatgacacattctagtactataaatataaaataggatatgtcacattcatccagtacgaggtttcttttctaggagggagtaacttctattatcattaagaaaatgtactatcaaaattttcaatgtgatgcaatagttgatcacgcatctacattctattgtatactgttcgacaccaacatttatttaaattattactccaagcctggctataataaaatagaactcatatatatttgacatcaattctagttgtatatatttttaagggataatgtaaatatgtgaagagacggtaggtgtgtttttaatgtataatccatagtccctaaccgtttcttctatagttcttgaactatatgaatgtaatttcatgtatgtctaagtaatgaaaatgtgctgttcagttttaggggcaaaatattcaccaaaacttgtcggaaaaaccagtcgagggttacggagccatcggaaatggcatatttacaaacgaaaagtaatttgtgaataaaatttttatatacgtgttttcagcgatttaaaaataaaaactgaaaaaacttcgataaaaaaaatcttaaaatcactaaatttaagattaaaaatttaaattttagataatataaatgtaaacataagtggaaagacgaggtctcaagctttatcccgccttcaatctgcctcgattggattgcttccgattgctcaaacccaaatctccactataaacctgtccgtataataaatcctagtcgttcccggtttgccacaaccacaaaatcaaacttatggtgtagcaaccagacacgagacggagaaagatcccagcagcgtctgaatcctgaggacggaatcccaccacgggcacggcccacgcagatccccctctccgccgccgcgtgcccgtcccgtcctcctctcctctcctcaccgtcactcaccacccgccacacgtaacttttcccccacttgcctactcttcgtctcttcctttccttttccccttctccgatcgcgcggccatccccaccaacca

SEQ ID NO: 6727 - DNA, 260 bp, Oryza sativa
cccgccgggtgggtgtcgccggccaccgcgcccccacagcaagggccgccggccaccgcccctcccgtcgcgcgggcgtcgccggccaccgcccctcccaccgtgcgggccaccggtcgccgctcctcttgccgcgcgggctttgccggccatctccctcctgatgccactctagctggcactcttccatctacaagggtgttttagacatttggaaccacacataacgtgaaaatgaaggaaacctaacgggaggggca

SEQ ID NO: 6728 - DNA, 1501 bp, Oryza sativa
cgtaaaacgatgttcgcattaacgcgtgattaattaaatattagctatttttttaaaaaaagattaatatgatttttttaagcaactttcgtatagaaactttttaaaaaaacacattgtttagtagtttgaaaagcgtacgcgtggaaaatgagtgtgtggagttgggaaccctgaggaacgaacatagcatatatttttttccatgcatctgaataacgtacctgaagattggttttttattttaagtccagtggtattgaaaagcagggaaccactaattcgatcacttcgagacaatatctatcagagattcatgaatttccctcaaactcgatctaattgaggttctgtttatttcagcggtgaaaagttttagcgtatcacatcggatatacggacacacatttgaagtattaaacgtagtctaataacgaaacaaattatagatttcacctgaaaactgcgagattatttttttaagcataattaatccgtcattagcaaatgtttatggtagcaccacattatcaaatgatgatgcaattaggcttaaaatattcgtctcgtaatttacacgtaatttgtgtaattagtttttttctatatttaatactctatacatgtgtccaaatatttgatatgatatggtgaaaagtttttgcgtgggaactacatggggcctgagtgttttgtgtcaaagctcgttattgcattttatgttcgatcatgcaccctacatcttcgttgcaaatcgaaataaagaaaatcacaaagacctcagcgtgcattccgtttacacacatgagaaattttattattcttgagatatttcaataaataaatttccgtacctgctaacattgaagatattgacaagtaccaaattttatataaaaaatgtgatacatcctaatacgttttgaataaccgtgaaatcaccctacaaacatactcctctcacacgctaaaagaagagcagcagcacggggcgtgactagctacgcactctactactcccttcgggctgataatacccctccaggctgataatacttgtcgttttagacaagagtaaagttaaactttaaaatctttgattatgaagcatttttaaaatatttatctttcaaatatggttactacatgtatagaatagtcttaaaacgtatttcaataaaatcatatactccctccgtactcgtaaagaaagtcaattatgataatgtttaagtcaaaccttgagaatataaatcataaataactcttaagttattaagtttgaaaatataaaaattatataaatagatttgtattaaaaaatactttcataaaagtatacatatatcatttaaatattatagaaacaataagttaaagttgtgttttggaaaccatatcgttgttcaaaacgatttcttatacaagtacggagagagtatttgttaacacttttatatatattataataaaaaataatggttaaatttgttttttcaga

SEQ ID NO: 6729 - DNA, 1501 bp, Oryza sativa
tgggagaaagaaaacggataaaccaaatgggaaaaattattcataagatttattgtgtctacatttcacaaagtagatggtattttgtatagggaataaaattttcagaaaacttgatccttttgcaagtgtcctaagttacaatctaattctctctatcaaaactacagtagaaaaaaaacaaatgccacaccactatagtgatctctatatccaaacacaaaaaagaaaaaccacaagaccatggccctatttggaagattagcccatggctaattttgagagctaatgtttactcttgaattggtaggctaaacattagtctatggtgatatgtatggattcatgagctaatttagggctaaaaggtggagagaaagtagagaggagagagagagggtgatagggttgccttttgatggtcctcacagaaaattagccccattagcatcccttgtaggggctaatgttttgaggtggggctaattcactttagccacaaattagtctacctgtttggatccttggaggctaattcaggactaaaagatggggggggctaataattagcccatggaaccaaacagggcccatctcgcatctatctctttccacccaactaaacgtgcactaacatcccatgtgagttcacggtggatgaaggttaaagttgggcgcgaaaaaacataagtgcatgattaattgagttttaactattacaaatttagaaaaaacatatctgttttatatttttaagtaatttctatatataaaactgtttacacgaaaaatatcgttgaatccttggaatgaaaaaatgaaggaatagaaaaaacacatgattataataggaatggaaatgtaaaacaaaagattgtaaaacacataaatgatcatttgattggacagtaggaaaaacacaggaattagatgagagatatagactcaaaagaaaatttccctcttgctaagtttcctgcaaagtctctataagattgtcaatttcttaggaattttaaaggattagatatgattcaatcctttgattcaaaggcttttataaatatcctctaaaatcctatatacctatacaaatcatccccactactacaattctctgcttcctggtgcttccacgtcaccctttttatccccaccgttggataagcatcgagcgcttccttctttccgcatcgctcctctcctcccctctcccgcatcgctacacgccggccccaccttctctcccgcatcgctcccctcctcccatctcccgcatcgctactcgccggccccacctcctctcccgcatcgctcccctcctctcctctcccacatcgcgctgctccgccggcccacgcgcatcgactcccttctcctgcatcgctcctcccctctcccacatatcgcgcagccgcccccccccccaccgaatacacgccgcaccgcatccacgctgcattccactttaccttctcctcttgcgccactttttagcctc

SEQ ID NO: 6730 - DNA, 1501 bp, Oryza sativa
taggtaaagtatagctaaaaaattttcttgactgagtttctgggcacccctataagatactctatctctacccctgggggcaacatagaaaggggacaagagatgggagggaaaaaatgtggcaaccatggttagatgcgttttaaacattttcaacaatttatattgtttctatcttctactcaactaaaaatgaatattttaacaaaatggctaaatagttgatgatagattttttttgtcaaaatcatgcatattactaatgttgagatttgcttcacgattcgtactccagcgaccctagctattctcctccaactctggtggtaccttcttctctagccttggtgaccccgacgaaggcaatgatgttagggtttagggtcctggtttaggatagggtgggaggaggagagggatgatcgtcgggcttagtggggtggcggtaggtggtgggcatgagtaggcaagacaccggcgatagctttgaagccgcgggggatggaggagggtggtagtctggtaggccgacattggtagctagaacaaaacaagcatttggttaggaggcggcgactggtgatggtggatcgggcggaagagagccgctagagacccggaagacgataggatgggagacctcgccgatggcgttatcccttacagccaggcgacgaggttaggcagtgctgcgtggggcggaagtggcacagatcgagcgttggtgagagggcagcagcgtgaagggatgttgggaggagaaggatgaaaaggaaggggttttgtggttagtttgcctagcatgtatcttaaaagcaaatcgaaaggtctacaatttgcaagatttttaggggtattttcaatcaaacagtatatatagacagacccatattttaatacacatacaagatatctagtaacaaatattctaagagtatcttttctgatgatctgacttttaccatactccctctataaaaaaaagccaacctcaacgttgtccaaatttgttgtactcatatcttagtgcgatgttgtttttttggacggagcgagtagaagttaataaatcaaccaaagccacgatgtcttcgtgtaaaatttacctcaggagaaaatcatggtcgagttctacacggccaaagtcatctgcctaaaatgggcctaaagctactactccctccgtatttaatgtacgacggcgttaactttttaatcaacgtttgactttgaccactcgttttattcaaaatttttatgcaaatataaaaatacttatgtcatgcttaaagaacatttgatgataaatcaaattacaataaaataaattataattacataatttttttaataagacaaaatatcaaatatttgttaaaaagttaacggcgtcatactgagtgagtactattttgctgggctaatcaatctcttcctccggtccgccgcatcaccgttcctcccggcggaagcagcggccaacaccggagcgcagcaagca

SEQ ID NO: 6731 - DNA, 949 bp, Oryza sativa
cattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggaatatattgcagtgaaaacgacgctatataattgacaatctgaaggcaacctcttcatatcttctttcccactagcacacaacacacgaaaatggaagcgccattctttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcaga

SEQ ID NO: 6732 - DNA, 874 bp, Oryza sativa
tgtatgcaaagtgctatatattagctcggttctttattagttgacgtcccgcaactcttgctacgtctatatttcaatatagagcctggtcactcatgtttggacgtatctacagttcatgtatgaatattagatcattcggtttaccgtttaaacaattataattttatcattaggttgtaattgattttgaagatttttaaaaaatacaaccaaaatccatatcgtgaaactgtctctctctccatatatatttatacttatattaattaggcactttaatttttacatcatattatcatcaccttagatcttaatctgttttaatattatgggcattgtttaagctgatccaaggggctctaggaaagcccatttaaagttggttgcgaccaccaatccaatttgtcacgctcgtcctagttgggcactttgactcctatattaaccgggaagatttttgtcattggttcaatgaatcatgttattatagatcttaatttgttttaatattatatggtctttgaagtgaatccaagtgcccatttagagttagttgtgaccacccattcaacctatcacggccgtacgtttctcatccccatcgtacctaagccgacagctatgtatatggtgtaggatcgagatgtcgactaggaggggggtgaataggcgatttaaaactaaataacacctaatcaaatctaacctaagttgctaagcttggtgagggtgaattctaactaagcaactaagttatgttttgtaaacctagggtgatagtggctcaaatatatctctaggaaagtaaatcacgctcctatgtcgatgttttgcaatcctagggtgatatgatctcaagtgtgtctctaga

SEQ ID NO: 6733 - DNA, 1501 bp, Oryza sativa
tccggaactccggattttgtgcaacctgttccaaaccattaaatgcacatttaaggccccttttattcgcaaggtagaaaaaaaaaacagagaaatagaaaaaacatagaattctaacaggaagtgaagtgtaaaacagagaattacaaaacacaggaaaaacacaggaatggtcgtttaaaaggagcgcaggaaaacgcataaatcagatgagagagatagactcaaaggaaatttactcaaagaggttggagctcttgctaaattttctccaaaatccacatgcaatgtgtcattccataggaatttcataggatttggaaagcttcaatcctttgaatcaaaagccaaatagaaaaattttctatagaatttgaatcatataaaattctatataaatcctttgattcaaagagacccttagatttatgaatgctaaggttttttttaaaaaaaattgggcaataactaagtgatgaagaaatagagattatgagaggatcttaacgagtaacgaaagtttttttttttatgaatgctaagtcatattttggacttttggcactacgacgatcaatcgggaaagaagggggaatcattcgagatacacactgcaatatgtgaggttcataagctaaaaaaaaaacttaggatgcgtttgaatcagatcatgagctgagctttttaacgacatgaaaaacagacgagtcattacaatataattagttaaggatcaacgattacaaatttaaaacggactgctaaaaatatgtcgatattttttttgcctaatctcagtcggttttaccgtgcgtacgattgctctacgtgactacacgagactacatgtcttaggttgtgcttgttcggaccgttcgatttcttctcaaaatcatctcctatactgctcatgcttttgctttttaacttttccaatgtagtaagatttaaatttacaccccacttacacatgtaattactatatgtaattttgagacttgcatataaaattttggaacttatacattataaatacactaaatttacatatataatttatgaacttataatgtaaatacatgttaactattttttgtgaaaaatatgacaccataaatatagctactctcatttaaaaaataaaattatttcaattttttaaagaaaacttttatataaaagaatatttaaaaagacgtaccgtttatgcttatagaaagtgagatagtagctctggttacatattgtataggaacgctctctctttccctctatgtgtcttttgtacccgttttctactttttttgtttcatattattaaacgttttagattttaaatacatttcatataagtgattagatttatatgtacgtaattaatttagatgagtgatgaagataccaaaccgtcttaatgtatggaggaagtagtttgtacctcttcactgcacgtaatagtcgacgttgttgagctgcacataattcaacgttaaggaactcc

SEQ ID NO: 6734 - DNA, 1074 bp, Oryza sativa
gaccccgaaaatgttcccaccccggtaattcgatcctcttcttctcccggcgagttttcctttttccctcgcagcggttaacttccgtcgcaatttgtcgtcgtcggccctttccctttataatccgtccggtagcttcactcctcctcgacccgcttgtcgctccggtggtattccctcctcccccggtgcctcgccccgccccgccgacgggcgccactgtcccctgtccatttcggccagcttttgtcttccctcctctcgccatccgacgcggcccccaattaggcgccacgtcggctagaccaagtcaacccgccagcctcgtccccgctcgcgtgcgctcggtccacggaaagcctaccggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgca

SEQ ID NO: 6735 - DNA, 158 bp, Oryza sativa
catcatccacctcccaatcacagtcaccgggggatgaggccccctcctcgtcgtgtcagtcatcagtgtctgggcatcgccggctgaccggaggaagggtgggtccaggaaggcagcagcttcgccagtgtccggtcgcatgaatcaggtgcgtgagt

SEQ ID NO: 6736 - DNA, 1501 bp, Oryza sativa
ctgagaatagaactacttttccagatttgtgcaagagaaaattagcaagaaaacgcgcaggaagctgaagaatttcatactaatcgtaacagtagagcataaagatagatctatcagggcaggcaggaagaacacatgaacaaagcatactagcatatattcgagggatcaaggcgtgaaaaaaaattatacctcctgctcgtcgccctcgacttcctcctcttcctcttcgtcatcgtcgtcgtcgtcgtcatcatcatcgtcgtcgtcatcgtcgtcgccgccatccccctcctcgccgtcctcctcatcctcctcgtcggagatctctacgacggtgtgccccgccgcgcccttctccccctcctcggcgtcctcctcctcgtcgtccccctcctcctctccatccccctcctcgtcgccgtcgccctcttccccatctaccgcctcctcctcgacctcctcctccccgttcaccacctcttcctcctccaccgccgcctcctccgccttcttggccgccgccgctgcagcagcagcggccttcttccgggcaagctccgccgcccgctcgtccccctcctccacctcgaccgccggcttcatctcaagaagcgaatcaaaaaaaatcaagaagaagaaagaaatctctccctttgctttggtttggtgctgtggcggcggaaaaatcaggggaaaatttggggcgaatttgtaagcggcgcggggaagaacagggggcggggcggggcggatgcctgcggggagatcctggccgtccgagacaagaacagtcacgcggatcgatgacgtggcggacgatcggacggctgcgggggatcggttcgtgccttcgtggagggggaggactccggagtccggagacggggtaggaggagaacgctagggctgacgtcagcgtgagggagattcttttttcccaagaaaataaaaaaaaactctggattcacgctctcttctaaattctgattatagtaaaataaggccctgtttctttgagggactttaagaagaagtccccccacttaagtccctaaaagtccctagagaaacaaacaggagggactaaaaagtccctaatagggtattttccagaagtcccaaatggaggtgcttattgggaatatggtcattgtgcagtgcatttaatgaacttaagtcccttttagtccctataaccaaacagccatgaacttaattgattagtcctaagactaaaataagtccctaggacttatggatccaaacaccacctaaaatcagttggtatacattaagatttagatttatcgcccaaaaataacctgttgcatttttttatttactttcttagaatgtaaacatcccggcaaatgacctcatggtctaccaaaaatatttctcctaattaaacttctctttaaacaagaatttttaaagatagaattgtacagagttttctaaaatacatgtgtgtgtgtgtatatatatatatatagga

SEQ ID NO: 6737 - DNA, 1501 bp, Oryza sativa
accactactcactaagccatgcagcacccacgtacatatagctagctctccagaccatgcaacacacacatatgcatatagataaacatgctgaaattaagaaacaacaagattaatttctaacaatgaccgggcggctggacgacccggcgagcggcaccatccccgtggagacccctgtggtcgccggtcctgtccttctgggctaccgccaccgccaccgccgggcacgaccatcccgggctacttctcgacggctgggcactcgagtgaatgcctcatctccctccctctcctgccttcgcctcccgcgaaagctgatgctccgttgcggtcgtcaatggccacggcgctctccgctctgcaccgagggagcgacggaggtctgtgctgacgccggcttaggaagaaaagaggagagggcagctgacatgtgggccccatgtactattttatttatttttttgctgactaggatgtcacgtcaacaaaaccaccaatatatactgccataaaaacttgagtatacggtttgtgtaagtttagaggtacacatttctgattttgtagttaagggactttaaaaaatctcgatgttaagttgagggatctccggtgaacttattccttaaccggagttccttaacgttgaattatgtgcagctcaacaacgtcgactattacgtgcagtgaagaggtacaaactacttcctccatacattaagacggtttggtatcttcatcactcatctaaattaattacgtacatataaatctaatcacttatatgaaatgtatttaaaatctaaaacgtttaataatatgaaacaaaaaaagtagaaaacgggtacaaaagacacatagagggaaagagagagcgttcctatacaatatgtaaccagagctactatctcactttctataagcataaacggtacgtctttttaaatattcttttatataaaagttttctttaaaaaattgaaataattttattttttaaatgagagtagctatatttatggtgtcatatttttcacaaaaaatagttaacatgtatttacattataagttcataaattatatatgtaaatttagtgtatttataatgtataagttccaaaattttatatgcaagtctcaaaattacatatagtaattacatgtgtaagtggggtgtaaatttaaatcttactacattggaaaagttaaaaagcaaaagcatgagcagtataggagatgattttgagaagaaatcgaacggtccgaacaagcacaacctaagacatgtagtctcgtgtagtcacgtagagcaatcgtacgcacggtaaaaccgactgagattaggcaaaaaaaatatcgacatatttttagcagtccgttttaaatttgtaatcgttgatccttaactaattatattgtaatgactcgtctgtttttcatgtcgttaaaaagctcagctcatgatctgattcaaacgcatcctaagttttttttttag

SEQ ID NO: 6738 - DNA, 787 bp, Oryza sativa
ctcaaaatcccttatattatgggacggagggagtacaacatatctatacaacttcacaaaatcttaggttcacacttaactcacatgttgagatataaaaaagataaatttagcatatgaatagtagtgtcctgttcacatctaaatttgtctttttgttctcgatgtgtagagcaaatttgaacttgattttggtgtaccagtagatatcattctactctacattgtcaacttttttttagaattttttaaactatttatatcaaatttggaaaaaaaagtacacgagaaaatatcccctcaagatattagaatccattctttttttttaacagggtaactgatgctaaccgtgcatacattacatggtcaccgcttatgacggcagtctatttcctgcaaggctgcaactacgcctgccggtgttgcattgttaactaggctagatcaattcaagttgctgtattgcttgattgctgccatcaaaattgtctgttgagtttgtgtactgtggagttcccagccagctgatctggtgccctgttttctgcttgaggtgatgcatgcaactgttcctactcccatgttggttgcaagggacccaacaagcaagataaatttcactacatttttggtcgatattctattgtacacggttttctcattatataaaagatgtgcacgcatattatcttctttctaaaatattcttttaaaaatctgctatttataatatgtttatattcctagtatccgagtattaataggtactaaatttttcactaga

SEQ ID NO: 6739 - DNA, 872 bp, Oryza sativa
gcgggggaatatggctccatgggcaatcttgtcattttgaaatcacctcttttgacccggaaataataaaataatgcgaccggtgtcctatggccaattacacattttttgtagtgtccatcagccgtgtcacgttttcacggtgtctctcagccaattacacgttttttgcgtttcttgtagcaaattttgccaaataattaatagctaaaactggttcagtgaaataaataatatgaaacgaagggagtaaagtatattctacgaactgttggcggtcacaagatttctatacacttgaagacatattcgtgagacccaccagcaaaaaatctctatcagctcaaaagacaattgaccgtcatgagtctcgtttttgtgataggggaggcacatgtcactgcttgaggctacaggcagtgggtgcgtgatgttgtcgtgctcggattggaaactgaatttttatacgtgattgtttccgtttcacgtgggcggaagagtttgacgcttgcaggggacatggatacggaccaacaattcacatgtcggatgaaaaattgtgtgagacacacttttctacgatgcacggcaaaaacactatgaatgttttaagtagataaagatatacaaccatatacgtcgtattttgtaagcaaatttggtaggattgatatatagatatattataacctacctctcagtatttttcatatttttttaccaccgtatacatatatttcaaagcagtaagcatgatttaaacatcgtggtttcaaatttcaaacaatagtcatgaaaatttttaaaaatattttagagctttgataatggtgttatgtctggccctgcaaaatatcagctttagaatatga

SEQ ID NO: 6740 - DNA, 823 bp, Oryza sativa
ataagctacgataaaaaaacaaattaaactattgctagtcaatataaattcagaagttaaatttaattttatatttttctgaagtgatttattagatattaatctatgctgttaatttttttctataaatatctttacctattataaaagtttaagatatttttgccagattatttggtccgtcaattagaatcccaatcgtttccgtcgtcgtttttttttcagcctaatcatatgtttcctttttttgttctcatgaccgtaacgcatcgtcgcctactattcgtttttttcgtgtctccttttttttcgactcgttttgtcgtgttttttttgctgtttttatccgggttctttttcttcgttgtttgttttttcccgattcggtttttttgctaggtttctttttcgcttttttcaaccggtttttttatctcatccgatctgttgcatgcttctgtcgccggaccaaacccttacgccgccgccacttcgatctgtctccccatgcgttttctccttgaactgattgcaaaaattgattctccactcctctctcatcatttttctcatgatttctcctttcgattcggttttaaatatctagatttatcagtcactaattatggtcggccgacctttttatcccaattttgtgaattcattttgattttgggaaaaccaaaagaggatattgagtgtataagttgagagataaaaaaaaagattcgaccgaatttaatagggattgctcgcaatcttcctccacgcccgctgattccacccctctctttaaaccaccaccgccgaattccctcacagc

SEQ ID NO: 6741 - DNA, 480 bp, Oryza sativa
acccgtgcggttcacatagagataggataaaacgagtcgatttgtgtggaaaaagaagaaaatggcgcgtgctttgacgctttgtagcattgaccctccttcctagggtcttttcctgcaaattccaaattggagcacatgattttggtgcatgagtatctaaaaacatcagtagtattctatattcttaagtcttaaccccgtagaaatcaacgtatcaacactcaagatcttaccactgtacaacctggctccataacgtgtgatttgttgggctcagaagcaatagcagctgttattggatggtttcgcagtacaaacgcccatgcttttatccatccgcgctcgtccgagcacgtctcattaactaactcactcactcaagtgaggtcaaattacagaagctcaagtcaaatgcttatctaatctgccgatactgtcgccggatgatgccattacaccccttcactatcacgcaga

SEQ ID NO: 6742 - DNA, 1501 bp, Oryza sativa
tgcaggtgggggcatgtattgtaggtaatgtgatagggccagcgacaccagcgtgtgtgcgggggcgggggcggggggagcgaccgatttttcctcccccgcccggtcgcctgaaggccatcattatcctcttttatatcttgcaattgagtcaccgcgaaaatacaatccgactccagaatacatggtttatgaatccattccgcgctttagtgccagcccctctcggcgctctagctagtaactctacctcctctgcagttgcgaaatgtctgacgaacttccatgaaaacaggcagcaccgccgctgtatggtctcggaccaccacccaattactgcttatctggtctctgcaaaaaaagagtgccatcaacaatggattttttttggaaataatacaaatttaatgacaatttataaaaatgtgttgatggtctgaaatcgtaaatttagtactctattaaacaacagttattagacaaacattcgacagagttcaaaatattaagaacttgggatgtgtgtgcatgcaggtgggaccttaggagttcgatagaccacctgcatcatataatacttgctttccaactaacctttcatttaaagttttcgtatcatttaaaggactttaaactttaaatgtatatatattttgaagaaacagttatgaaaaagaacacttctagcatttaaagtttatcagaataaaattatatatgagtactacttcccctcaaatcatttctcatacaaatttctttgagaaaatctcttgtatacccctgaattttaagctaatcctatcaaggcccctgaattttgcttatttcattgtataccccaaaatttgattttgatcccttccatgcccctgccgtcagttgaccgttagttgacagtctaatttctataaaaatgattattttaccatttggatgaacatagaaattattaattatattattaaaaatgtaaaagtttgtcgcatgagactattatagttatgagtttgttgtgctatgcattatttatcaaaaaatttatttttagataatgaaataaaaaatatgtatttatttttttaaaaaagtcataaaaaagaggagcattcctataaagatagaacgaccaatgctcacaatatattttttttatgaatgctcctgacaaaaaaaatccattgtccaattaaaatttcaaataaaaactttaatttattacatttgtgttatttttaaaatttatgtcaaaattttctgcactaattatttagtctcattagtttcataaaatgcacgtactgtgcactcaaataaaattttcaatcgtttttcacgcttatattcaaacctaaagcatcaagggtaaaaaaatacatttgcaaacaaacataatagtggaatgaaggaaaatgtaacggtaggggcatgaaagggatcaagttaaaattttaggggtatagaaaggatcgagtaaattttagggttattgatgtgacca

SEQ ID NO: 6743 - DNA, 1216 bp, Oryza sativa
atggctaaatgctcctggtttaaagtactcccaatctagttggaaaatgcacatggagcaaaaagctactgatacttgtccaatcaagggaaacgctccagtcttaggggaaaaaaggaaaaaaaactttgtttgtgccgttaatggtaaaattggaaaaaaacgcatgttaggacttgggaatggcgcactaacaagttttctgtgaaaaaaaaagttacaaaggaatggagggataagagttttatatcttgagcatcaaatgattttttttaaaggtagtatggtgcggacaacaaaatattttttctaatgctaaaatgtatttttgtgaaagtgtcgctggaaattttttgcccctgcttcacaaactaaccgaggagcgaggagtgaggaccggtggctgagctagggtggtcgagttcgtgcaaagaccaatgagccacggagttcaaccccttgacgatgtacaaataactaactaagttgtcacacatggtcattttctatcttttaggtagaatatgtcaatatttattctccccaacctctcattctactcatgcaatacttctttatgcatccatcgcttgtactaagattctctctctgaatttcggatatttattcagaataaacaaaacaccgtttgatacaacttttactttgatgtttttgtcccatagagctataactctatcaaacactttcaaaatcttagataacatataacgaagctatcgctccgttgctaaaaaattacaatacgaggatggagggatattctcaccactcatcagctccgcttcattctcctaattctcctaggagctgtatcaaacggttgagtcttttacattaaaaccagaaaccttcacgaattttaatttataatcgagcaatacacacatttctctgtatttttcccctccttttgaagtggtagactcttctaatttaagaagcttgaagcaatttttattttgaaaataaactttcctaatttatgcaggtggaatttcagatacgttacgtacgtaccgtattccttcaacactctataaatacatgtacaacactcacgctatcccagctgcaagcgacaagctcgagtacgtagctagagcaagccagctacgtaagcgcgcgtcgcgtcgcgtcgcgcgccatggtgttcggcgcgggcgccggcggcggcgggagaccgtggccgcgg

SEQ ID NO: 6744 - DNA, 621 bp, Oryza sativa
acccctcggggagataaaaggcggggaggtctcgtcaccctcaggcccgacccaagggtgaccgcggctacccaaacctctagtcatgataccctcggccccatgtcatcgacaagtactacctttgtttcaggttataagactttctagcattgcgtactactaatctaaaatcccttttattaatctattcttgttctatatcctttataaacaaatattcctagagaataacctgacaataaactaataaaatcctacaaaagcataaaagatggccactttgaatctttgattatgttgcacctcaaaaaaatatatatcatatattaccctaaaaaaaccatacacttttccaatttcagacagccaaaagaagagagagtgagagtctgagagacagcccattcagaggttagttagagttgggccgagcccatatcatctcctatataaatggcccttccgagcgaacctccgccccctccgaaaccctaacgccacccgcgccgccatccccgagcaccaccaaccccaccccccgagcgagcggagcggagaacgcgaggcgaggcgaagcaaacatggcggcggctgcggtgtacggcgccggcggcgcga

SEQ ID NO: 6745 - DNA, 1501 bp, Oryza sativa
aaaacttacagcgtaaatatattaaaattacatatgtaattttgaagatttacgatgtaaatacgtaccgattatttttttatgaaaaatatgacggcatatatatagtccgaaaatatcaaatcacacctcaaacaattaggttaactacagtacaacaaaacaaccatgagtaaaaaaattaccatccatgtaaaacaaaaattacacctgtatctattaaaaattacactgtaaatgtagtgtacttaactatgaaactgcggtgaaagttttaaaaacgttaggtatagcagcaaagtaatcagtcgcttcttgcacagttggtacgatgcacgtcatgttatcccgacatcatgtggttgattccctgctctagcggcattttttttttcactcgaaggcacgcgcacaaatctcaaagtaaatcatacggtgaagaaatcgacagatttttaactgtcgacagatatacagcaattccgttttggttttcatggatcgatggtatatggtattatgtttttttttcctgtgttttgaatcgtcctctcttgctcctgttaaggttggggaaccaatatctccatggtgtcaccatctttgcaagaaggggatagatcgacgcgtcaagaaatcgtttctgttgccatggctcgagtaagcaatacgattgttgcttgcgtacaattttttctttttgcggggtgcgtacaattttttcttgatgcagactagtttcttttcttgtaccctgttttaaaaaaatctcactcctctgtttatatctgttctgttcatgcaccgtgctaaccccgggcttgtcggactggaatcctttgaagaatgaagccccaatgaggcaatgactgtgctagatccaccatgccattcagtgttgcaggtcatgatgctttgagctcgtgattgtgtctgtgtcagcgtaatggatacattcagctatcatatttcctctaaaatattcgtgttttcgttcattggatttactttgttagatttggcggtttggcaatgatgatacaaactttcagcttaccatgccagttctgcttctgagaattcatgacagataaagctgatatagatctgaactgaatgttttcttttgcattatgagtgtgcggcgccgccggggagctgatatagatatcgaggctgtgcggcgccgccgggagttgccgcggttggcgtcgctatgcctgcgggaggtgctcctggtgctgcagcggttcaacgccatcgtcgccgattgctcggtgcgaagccggatgtggctgctgctggagtcggacgagatggaggcggagctgcgggagctcaaccacgacctggccacgctgctcgacctcttgccggtcgtcgagctgggcgccttggcctcgccgacgacatgctcgacgtcctctccctcgtgtcgcgccagtgctggcggtgctcgccggcaccggaggcggtgcaggcgctgaacgcgagcgtgctg

SEQ ID NO: 6746 - DNA, 367 bp, Oryza sativa
cagagcttcaagccttcaatccagttagcccacaactgatccgggcggcttttttttcttaaaaaaaaaaagggacccgggggcctcgtgacgacgtggcttctcccaccaccgtaactcccgccccctcgcagtctccttcccaacaactggtccatacaccaccaacccccatacccccgccgtttcacctaccacactcccggctttcctgcaccgggcgcacccaattcacacccacaaacgcacgcccgcacgcgcgcgcgcgcgctcagagacctccgtcgccgcccgccgcacgccggcgacccaccgcgccgcacgatgccgccgacctcagtgagcccaccaagaacagcgccggggc

SEQ ID NO: 6747 - DNA, 581 bp, Oryza sativa
atgtttgatattcgagctcggtacccggtcttggtccacagctgtgtaagacaaagggtctggcccagatctagcgaggagggctgctggcgttgtctatggctgcggcggcggtggaagagatccagatcatcacccaccgtgctgcccctccaaccatagttattgagaccggactagtaatcgaaccggtgaggctctcggttcgatgattcactggttcaaccgattgaatcggtggtctaatccggttcaataaccgtttaaatatattaattattaattgcaaacacaaggaactaggtagcctagtggttggagagtttactaactcccatatggtcctgggttcaaagcccaccgaagccatattttcgcgaattttcccccaccaacaccttgctcgcgtgtacagcagccacagccatatttttgcgaattttcccccaccaacaccctgttagatttaattgggtaattgatccatttaaattatttaaatcttatatcaattattcctaattggttgatggttgtgtagtgaaggatgcattgttgctgctacggtaatcctatcccga

SEQ ID NO: 6748 - DNA, 1501 bp, Oryza sativa
gagatgtaggcttcggctgaagttagttaataattatcgtgtgttgctatattgtcatctgacgtgtcttggctgatcaatgactgaagtaatcgataaggttagtcgttgttcctctatatcgaccaaacttttataacattgtgagtgatgagtccatgtagtttgaatgtgtgattgagatccattgtattttggttattttttgtctttatattttcttctgagttctgaatgaggtggcaactaggaagagtaaacattttttttatttcaccagtgatgggtggtgttgagtgcacccgtttcccattatccagacttacaacgggcatcaaaccaaccaatcgcaggtgactcacatgtgatggatggtaataacactcttcatacgtgccaacctcatcaatgaccgatctttttctactgcccatcagagatagtgttccatcatagatgaggctgagttatcactgaccattcatctatgacgagaggggtctacccgtcacaaacgactttatcgagcgtagtagtttgcgccattggccatcatcaacgttgaccatcgaactcgacccaccaatggcgcaaacctcaactgtggggcgtagcccagcgcatggtcatcgaacttggcaaggacagcgagcaaagtcctgcaggactcactttggccaacggtgtttcctttgccttgcctaccatggcttttacagaggatacggtgtgattagaagcttaattaattaggaaaactagagacgtcgctcatgcccattcccaggcaaacttgccaatataatctccacgacctgcattcttagagatgcgtgagccccactacctcaggagtgggaagtttatgactgcatgtcattgatcgatatcctccgaagatccaaaacataccagtcttaacacgtctcactcatatgttgctatgtactacggagtattatttattcggaactttattctcgtggccactcagtcgattatcagatcaaggtaattgtgcaaaaaaactaaattaattatctcaatgatctacattaacagctagatggtctcaagctaaatataaaaaaagaatactgccggattggatcgattaatatcgagttatatattatgctatgtaatctccacagcacgagacttgatccatatttaccaagttgtttgattcttctgaaactcatgtgattgtgaagtttaagttcaatggagtgcggtgtttgtgcagataaataaattcaacaacaccaagactaagttttaacaacatatatagaaacaatatatttcggttttaagtaccccatggaagagttggggctagctagtgccagatagttgatgcactagtataaatccagaggcagcaacacgagttaatttccatccatccatagacgcatcacataatcatctatctctccctcagggcaactaatttcacaagcacacgttcttccatttccattgaccatgcctg

SEQ ID NO: 6749 - DNA, 1501 bp, Oryza sativa
tgctgactccacttattacaaatgatatttacagaatattgggggtttgtttcgaacttacaagttcagcaagcataggaactccatgtacgcttgcttgtcatagtctgccggatcaagaactacgacggtttggtccgttggatagacgaggaatagtatatagtgattgctgcgaacacggattattaaattatgtaagacatatttgaatgtgcggttattaatatgtgaacggaacgaacaggtagttgcttacccaaagtgataggggaccatgatgactcgtttgtcagagtgagagagcattgagtgggccaagtaatttgccacctcggccatctttctcttatgcaaacattcgacgtaatcttttttctcctcgtctatcttattctttagtaccgtactattctccgatatccgcacagtgtgggtcgtctcgcaaaccatcattgggtttacgtatgcaattgaggcccccattctttgggcgtctacccattgtgacatgaggaaatttggaagttagaaagactatgatgccccttattaaatgatgtataggtaagagtggaagggcagtagagggtaaaatagcgagaaatttgaatgaaaagtgattaatgggaccattagtactctattgtgacaattgttttgggataaattcaaatcctagaaatataattattttgggacagatgtagtaagaaagaacatccgaataggcaaactggaaacctaaggagaattcatgaggaaaaaagtttgaagagctagcaaaatcattagtgaagtatcttccttgtcagtctatttcagcgacatcttttaggccgatgttgggcgtatcagctgcgcctggcttgaatgaggagaggaaggacccgacctctagctctttacttttactgcccttgtaagggcgttgagaccatagcgtgttacacaaaagcgccaggaaagacgaatatgtgtgctcagcagcattctagtagcaaaaaaacattttttttcaaacctttgcacgcctccgttaccttttgggaggcctacgccgaaatagtgtgagttactcgctcgttatttttgtgcaggattgactaaacagctttcgtagtgcccattttcgttgattggcgagttaatacaggaaaagaaaaggctgtaccaatcatgagtagtaaagcggtaccagtgaattttttgctttttcagtgaagtactcttgcttaacttttgtccataaatcccgtgtaagcagtaaatctcgtaattctcaataggccccctttctgttaagtgaagtgaggcggggtcgccgaacgaacgacgttagtttacttgcacgcaattaattatcatctttgaccacgagccattctagacagtgccgtcggcaaagcattttttaatggttttggtagttcaatttcacgtcatgaaagattagatagcaaccggtataggctctagttttcctagagggggttaaacc

SEQ ID NO: 6750 - DNA, 1501 bp, Oryza sativa
actgcagccacagcccttgcaacggcgtcgagacgactcctgcgactgcgacgatgactcctgcggctgcggctgcgactactcctgcgaccgcagcgataactcctgcagcgctggtgaggacacctgtgggggccacgcttccagaacgattgaggatctgcatctgcctgcggccgtgcggccgtgcggcggatagggtcgaccttcacctcgacttttttctcccgtgcagtgcagcggcgctagatgcaggagaagggaaagcgagagatatcgaggcgcgcacgctatttggaccacacgcgatagctccccatcgtacccctcagcaatcaacggccggatggagactggtgcctcatggtaccagtaccgcgtgctacaaaagtgaggacgggagaaaaactctaattacgtatattgtaattatagtgtgtaatataattatatctcaaatataaaatatattgtaattatagtgtgtaatataattatatcttaaatattttatatttggaagttttatgacgtgttttgagctgatagcccacgcaccgggactgttatctgccaacccacgaggtcacagctcatctgtagtcttgtttttacctgttcagacagtcacgtgatccattcatccaaggtagtaggaagataaattctccatccctcccatcaaatatcaatataatcttaacacattcaaattcatagtattacaatgtatcatatctaatattgttgagtttttataagatggaaagagtacaagtgagatagacgagataatatagactagcctattgaaaacttttactttgccgtacatgtagtattagttttttattgaaaataattgaagctaagcattgaccaaatttctctcgagatgttacgtataaggatcccatataatctaggagttcttgctaattaactactccctcattaatagaatataaaaagttttaggattggacacggttattaagaaaatagatagaagtgagtggtagagggttataattagatgagtagtgaagataggtggaaaaagtgaacggtggagggttgtgattggttgggaagagaatgttgatcgagaagttattatattttgggacagatcctgagggctattttgggacggaggaagtatagtattcctctgcaacagtatattgatgaacagtgtttggcaatttggaccactgcgttttgatgcacggggattaatactactactgctaaagttaatttcagttatactggcggttgcaggtgatctccattttcgtcatgtcacacgcatgcaggcaccacaccaacatgatcaaatccaatttcccaatctccattcttgattgggagtaagcagtccactccaacagacacaattttatacattcacacacagtgcttcgttgttttatatacatatagttgcaaatatcccagtttcttccacactattgcttgtcaaccccagtagtgc

SEQ ID NO: 6751 - DNA, 498 bp, Oryza sativa
cctcttcttcctcctccgtaaaaatccagagagcaccactgccaactgcatgcgtaatgcatattcctaacacgtgtggccgtcatgaaaatcaccatttttcgttggtctcataatttaagagttgatataatatcatacttagcctgaaaaagctgtacttttttatgggctttcatgactgattcaattatagtatatcgagtgaggatgacaagtcagtgccactacatgatctaccgtagtatatttaagtcattaagtgcaccgagaaggaagagtagttcgatgtttgtgttacctatctctctacctcttattcaagttctgtccaaaatcacagtcaaaatttctgccagtgacggctcatcatctacttaattatcttcttcttcttcttcttcctcggttctcctcatcctgaagaaactgtagctaagctgcccattatcatcctctctctgtgattgtttggtgtgtcgcttcttcgatgtcagg

SEQ ID NO: 6752 - DNA, 361 bp, Oryza sativa
gaatgattgatagttaatgatacatcgttcatcgttataggttgatagaggattggtgattgatcgtatatatagatactcattagattgagtatggttctcttcgtcatactctctctaacattatgaatcgatgttggtcaatgacgaatagtatgattgatatacgtcattatctaggcggtatttgtataatgacatgtgcgtcgatcgtcatcatcgtcgatgtgatgttgtaatagtagttatgatatcgagctcgtagtatgtattcgtgagcgtgttttatgataatgtattatttatatgtggtagtattatattattttgacacgtgttttctcgttttttattttcaagc

SEQ ID NO: 6753 - DNA, 774 bp, Oryza sativa
ccgatgattgtacattgcagattcgagctcggtacctacttcatgagtcgaggagacccattatatcttcggtgatgcctgccttgaacgtcagcagcgcgtcccgctcccgcggtgagcagccggccgccgtcgccacgttgccgtgggcgggcgccggacggcgtgtggcgccgcgtggcagcgcggccaccgccgcctccacttcatggttggtcgtggccaaggcggcgacggcgaggacgctgaggatcaagagagcggcggtggtagtgggacgcatggtggattggtggactagtaagaaccgggggggtctgtatctgagtgtgcgagtgtatcgtatacgtatcgttgttgtttttactgtagtcgacgggtgcgtgtgtgccgtgccgtgccgtggccgccgggacgcgcgtgggcgtggccatgtatacgctgcaaacaacagtagcgacgggccgtacagggacagctttcgttggcccattgtagtgagggcagaacgttactgcctggatcgtgcggcccattagtatggcctaccagaatctggatctccaccaattaaaaccagccacggaagtcgcgcattcgcggaaatttttttatttttaaattttttttattaaaagttttacaaaaataatttttcatttttgaaaattgacagaagtggtcgcctaccgccctctgggagggtgatttttaaaaatcgccatcccaaagggcggcgaaagtgacgtggcagatggccgttcgctctcaggc

SEQ ID NO: 6754 - DNA, 1501 bp, Oryza sativa
tttgattatatcggggtatgtatccctaaactgttaaaaaaaattgtatttgacggcaaatccccgtgcattaatttacagggtgcgcgacggctattccattcgcgaggcccacgccgctcttgactactacaatgccaatcatacggtaattaagtgtatatgaatttactactagtatttaatgtttatgaatcacttgcttaattatatagatgaaaagtgaattgatatattattgatctttcgctacgtaattatttagatgtgtgtctgatcgatatgatttattttataattaatttcagggagcggagtatgaactcgtcaagccattgatggcggcctgcgttttcttcaagcgtcgcatgtggtaccacgttagcttgttggcgcgcaggaaggatcagaccactgcaccacccatcgaatacttcttcgccgagctacgcgagggcgcatccgactccttcatcgttgaagcatgcaccatgatcggtaagctttccgtgtgttaatttctttctaataacaatgcttaataatttgatgaatgtctccatcaatcaatgtgtctaagaaaatcggccaatcatcctaaattcctaattcagcttaattgatatgttttctctctgtcagaaaatccgcaaagctgctccgggaacaagtgttcactttgccctactcgctatgagatcgtgcaccctagcgaagaggagcttttgtgtggaaaggaaggagatgtcaaggactttctgcggttgaggaatttgtccccgttgccgttcacatgccccgtcacagtgcctgaaattgaaattgtggttgaaaaatagtaactactagcaaattagcaactgctcgcaaacattcttagcgacctgtttatttgcacatctgacagctggacacgatcgatacatagatcggtgtatcatgagggtgccccggctttgtggttaatctcgggcatgtagtggcctctatgatgccctttgtaatattaaaacttattttttctctcctcataagctattaacacgtcaggcaaagttctttgatatcttttcaaaaaggaatatatcaattcaaattcaggtatcatcaaacaaattctaatcgtagctgtgcttaggtgtgcccctcttcttagtaacaattcctctttttattttagctttaagatacaagtgagacgatccattaatccacctacagattgaataaatggatttgcgggtccacccacttactcccttatttgcccatctgttttgggtacgtgtctgctctccttaaaacttatttcttgtcatgctctaaaaatctttaataacccacaagtcagtacaactgtttacagtgcataagaacagctcgcaggcattcgaaagttaaaacttaaaaatgttgtgacaactcggcgattactcacagaaatctcaacatatgagctagtactagaaaacaatccatgggcgattgctaatcaggtagt

SEQ ID NO: 6755 - DNA, 611 bp, Oryza sativa
tcaatatttagggacacaggaagtatactatagcactgttgatagctttgtgaacttacctgacggccggccaacgacggcggtgcgggcggcggcggcagcggcgatggtcgccatggctccggctatctccttgcttagctagcaagaggcacacagcacactacactctgctggtctctaggtgagatgcaacgagtgacagcaggagtgtggctcgcgaatcgtgtttagttcttctggtctggttatccatgcgtggcgtggtgtcgtggtctatcacctctgagcgaatgggcgtccgccacctggacgcggtagatttccgttgaaaagtaagcgggcgtttgcaccggtgaagtgcaactcctgccactatcttagattcagaaatgtaacggtgggtgtcaggtacaggaccacagatccaaatcctgaagaaccagccaaccaggtgagcatgtaccaatcagagtatcagaacgtagtagtatatatatgtgccaggaggttgcacggcgtccgacatgccaacatggacattggctcaacgaacaaactatatatcttgacacaagtgtttcgatgggaagtgtcattgagtttttttc

SEQ ID NO: 6756 - DNA, 1027 bp, Oryza sativa
agatggtccccttttctttttcttttttcctttattttctcccgaatcaagtaggcaaatcccaaatcaatccccaaatcaaagtaacatcccaaattcacatcatcatatccacatcccaaatcataaagttacttatacaaacaaatcaaatacatcataatatcctaaaaaattactcaaatacaacacagatctaaacaatgaatcacaaatatgtacatctcagtgaatcacaaatttgaaaaaaaaaagaaaaaacaatgtcgctgccgccgctcgccacgactgccgggcgcccccctccccccagcgcctgccgggaaggaggggggaggaggaaggggaggaaggggaggagttgaaggagagcggatgtggaagagagttagagaggatagatctgaggagagggggagatattcgtctgcccaagttgtaactgtggaggagaggataagtgatagggattatatactacgtgttcaattttagtcccggttggtattaccaaccggtataccaaccgggactgaagatcctcggcctcctgaaatacatctgacaagggatgaaccgggactaaagatcaaaatttttataaccgggactaaaaactatctttagtctcggttctttttggaaccgggactattgtggattttgccagaccgatcaaagatggtttctccaccagtgtaatttaatttgtgggcgttgcttagagaagggtcattctttgtctgtttgtgttgggccctttcggtgccgaatttgtaagagttcgggtcatgcggcctgtttctgtagctcaaagaaatctccctctgagggtaaattgccaaagtctgtttctaccccccccctcgcattaatgcagatgctacggtcctaaactcccggggtaattgcaatcttgtttggagacctaaaaagctagcgctggttatctcgtagccttctcgccttctccaatctactgttgagaatattgttcaagcctccccagcccaaagttccttgccaa

SEQ ID NO: 6757 - DNA, 169 bp, Oryza sativa
agaaacggccgggagccctctctctctctccacctcccccacttcgccggcctcgcccgccaatcccggccacgtcccgccccctcaagcctacataaagcacccccggcccctcctctctctttttcacattgccatcgaccgctcccgtgcaccccatcgccctagc

SEQ ID NO: 6758 - DNA, 563 bp, Oryza sativa
aatcctttcaccaagtttagatatatttaaacatgaaaatgtttatttcaaaattatttgttcttctgatattttaattgcatgctatttatatcagaatactacagaacgatatactgttctaacggaatagttgacatcatcatgatgtcagcatggtacctaggtagcaggatctagtaccatgcagtatcatgtctggtatcattggcaccaaatatgatacctatgggtattgtgtctggtaccacggtaccagatctagtacctatctagtatcaaaaatatcagatctaactaagataccgtgctaatgtcgttatacataatctattctgttggaatggtatagtgttctgcagtagccttctatttatatagacatgtacatatgtcagacattatatgtttgtaccaaatattcaaacttttataccaggaggtcaaaaactagaacctgtttttatagtgcattgtgaacttatcatatatggagcatattgaaagggcacagcttcttttctgcaaatctgatatatttcttctataattccaactgcagg

SEQ ID NO: 6759 - DNA, 1501 bp, Oryza sativa
tgtattttccttttttattggtggggcccacctaccatatacactataacctcctcttcccctcttccactctctcttctctagccgtcgggtacgtcgagtggcggcgggcggtcggcgcgcccggcagcacactggggcgggtggtggggcggcggcggcgggtcgacgagcgtgtggcgcgacatggcaatgtctctcctcatcctcggcttctccctctgcgtgtcgtcgcctggcttcgagtggcgggcagtggcggcgttcatggggacgttctcgctggggttcaggctgggagggttgcgctaggtctcaccatcgatgcgtcaagggggcagatgcttgttgtggccgcccacaactccggtttcatcatgggcagcacttagccggctccggtggcagcggcggcggtggcaagggcgatgggatgtggagcgtggcggctgcggtggcgcggagctccgacacgctggcgttgctgcaaccgccctcttccccttccttgtgcggagcccactgactggatccccctcattgtctcgtacccccacccaccgcccgaccccgcacgccactgtctgccgcccgaacgagccacgcctcccccatcggccgctcgagctacctcctcctctgtcggctactgtcacgccccgaaccagtcccgaccggaactagcccgtgacgccccaaattaacctgttaatcgataccagtcccaggaaacagtgctggtatcacagggagacagaatatcacagcaacagaggtctctttattatggagtagaagtacagtcatgttgggctgcggacagatcccgagctcacaactgcattacagtaggaaagcggaagccaggacttggaccaatcatcataggcgcgacttgggaactaggtcgaaaccctaaaactcgtcgtagccggcttgctcctgaaagaactcctcatcagcaggatccgcttcatcttcttcagcaactggggggggaattatttatatagagcaagggtgagtacgggagtactcagcaagccaggggaaataagtgtttaatgcaggcttcaaagaagggctgtttgtttttgcaattgattttatttgaactcttttctaaaacactaggtgagtgcttctcaaacgacacggatgagacagtgcgtctcgtccggtcggagtatgtgcaatgtatcagtctttaaaattgaaacaaggttggcacccagtcaacagattttcaaacggccacccgggccaacaacttttcaaacggccacccgggccaacaacttcttcaaacggccacccgggcctagctgatcccgtcagctgctgatttttcaaacatcgaacccattattctcaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 6760 - DNA, 1501 bp, Oryza sativa
tggcaacaagcattttgcttagcgcattagtggttttagcttgcgcaaaaacgagatccttcaaggagggctggttagaaaagttaccgttgttgttacctccttgataatatgggcgtggttggttccacccctgacctccttgtggacggtacccattgttgcccatgtacatcgcctcctcacgggtttctgggcagtcattcccagagtgacccgtgccgccgcagacctcacacgtaacgtgtgagtccaaggccttgacggtgccttgtggccttttgtcgtggtcgtccaatcgcttcatgaggaggtccagcttggcagcaagcaactccatctccttgacggtatgcatgcctcactgacgggtctggagtcgttcctcgctccaacccatgttggagaccatcttctgtattagatcaacggctccttgaaccattttagagaagaaagctcctctagctaccacgtctaggtgatcgcgggacattggggtgagtccattgtaaaagttttgtaggatcagccagtcgtacatcccatgatgagggcaggcggccacgtactcctgcagtcgttcccatgcttcaggaatagacttgtccctcgtctgttggaaactggaaattcgtccacgaagggcattggtttttcccatcagaaataatatcgagaggaatgccgtagagcatttgtcccaggtattgacagcagcacggttggcatagaaccacttcttcactctcccgagaagggagaacggaaacagccgcagcctgacggtgtcgggactgacgcccttgatggtgtacgtgctacagatctccaggaactgttgcagatgagcattggcatcctcattaggcttgccacaaaacgggctagcctacgccatcgtgacgaggctggacttcaagtcaaaatccacatctcccatgttgatctgcggcccaatggctacattgtcagcagagggaacagcgaactcgtggagagtcttgttaattagccgtagtcatgaatgtcggtggcgctggtacggctggtttctctgtcggtagagttttctgcggagcagtgacttgcggcctgacgctccggaagaaagcttctgaatcttctttgaagttttctggcaagttgaaaccagtcatgcactaccctgttttcacaacaaaagtgaaaacaaccaaggttagcttgcaaaggaaaatgattatacagaggtaaatataaagtattagttcaggtaatctctattatgaatcttccccagtaacggcaccagaaatgcttgttggtatttcataacgtcattactagaaatataactcccagcaatggcgcagaaatactaatggtatattatggttacagagttcatccgcaagcgcacggatataccattgtagcatttcacccgagagtattccaagggtatcgtatttattttatcccgtgggaagatcatgtagagaggacttgactaatagtt

SEQ ID NO: 6761 - DNA, 1501 bp, Oryza sativa
gccaactaatgcgctggttagcccaaagtgacctataaattcctatattatgattgcattaaatcaaatcacttacgagctatcaagtatcaatcatcgagcgaagccaaggagacctctttcaactgctccgccaaccacccttgaacaatccagtttatctaaatccctgatccctgatgaggttaattgacaggtctagattaggtctatataggtatagattaggtacatatactccctccgtccaaaaaaagataaaccctggtttccgtgcccaatatttgaccgtccgtcttatttaaaaaaattatgaaaaaaataaaaagacaagtcacgcataaaatattaagcatgttttatcatctaacagcaatgaaaatacgaattataaaaaaatttcatataagacggacagtcaaaattggacacggaaagccagggtttgtctttttttggacggagggagtacatccttataaccatagtgtttccatatatcaatcacaacagtagacatagcgttatatcactccaaagagggcacgaagctatgtaaaaataagtctctacgtttttaacttgcatatcacgggaggagagtaaacaaaacataatcgacgtatatattttaatatattcaaatgtttatcgacaaaagttacaaccgcaagaatatcaattctcaaaactattaaggagaatcaatatggctgtgtttgttacttcttgttggaagcaaatccctttcgcatgaaaaacagagcgatccattaaaatataattaattaaatattagctaatttttttttaaaaatggatcaatatgatttttttcaagcaactttcacatatatatatatatatatatatatatatatatatatatatatatatatatatatatatatatatatatatatatattgtcagggttatggataccacatacccaatagtaatcgactaagctcagcagagcccaccatataccatgtcttatatggaatcaaacctcatatatagaaggagttccggataaggaatgatgaatagagttctatatggaaacgacaaggactactcatatcgtatccatatttatctccctagttctacttggacaatgggttatctgtgggtataaatacaagccccctaggagaagaggggacagacccaccacaatctacgacgccacaaagccacaagccaatacgccgtcagatctcgacatcagatattagtctagccataccccatccggtacctacggaggccggcaagagggatccagcgtcgtctctgatctcgccgagtactgattcgaggaggaagactaccctgtcgtcgactacgagttgattatctagccgtcaagtcgatgacggatagatagattatcccaaatattggatttgtgtgatccagatgaataaagggcaacaccggcttcggccaacaggatgtagggctattacctgtaagatgaggggcccga

SEQ ID NO: 6762 - DNA, 1501 bp, Oryza sativa
gcttataagtctaaataaagaagacctaaacacattttttcataatcttttggatcttaactggatatactttatcaatcttgtatgttctataatggtatcttcgacattataaaaaaagttggctatacaatcaattttttttagataggagtagagctcgtctactactgcgctgcattcaccactgcagatgtaataaaacctcaacaattagctactacctccattccaaaatactcctacacataccaatacaaacactaaaagactagaatatctctactttatccaatcctaagagtaggtacaatagcaggctataagccagctataaacatattttaaagagataaaggaagagggagaagagcagcgggctatagatctgtagccagctgcagcacgaactccaagacgtaatgtgtgtatgacatgtgggaccatatattaataatatagtaaacaactattgtataaattagctattacattggctataaatgatttggagctgatagtgggctataatgttaaacttgctctaatgcaattactactcactttatctactcccaatataattattctctatttttataaaatctgacgcaatgattacttaaaagaacttatttaagctaaatgggaggtgataaaaataaacttaatatgaaacggaggtagcagccaactactggcacataggagtacatattgtcaagtgtctcgtccgttttctcccaggcaaggtcattctttcttttctacaactgtggtgcgtacagtgcagcagcagttgtatgcacttgtgttgatctgctgctaacgagttgttctcgtttggaggtggagaagaagtgagttgtaaatgaaccgacagaacgatggccacaaataaaagcttccatagttgtaaatgaactgccggccggcctgcaaaatgccgggtctcccgcgccgcgcgcgacgatcgagtggataagacgatacgcgcgcggccaatgcatgcaatggatggaaatcggcaatcgagtcgagcgattgaccgaatagtgtgggcgggcgagggaggaagaaatttactgtactccactgaccacttcacaggacagggggcagagaatacagagccgccgccgtgatgatgctgttgctgccgtgccgtctgcatacctgcctcggaaatgagggcatggctgtgccacgcctacgtacgtctggcttcaccgaccattggctatatataggccggctagttagggcaagtttaatgggggatggtaaccccaattttacctacatcatccatccataaaattaaaactaatttatataaatgcattgcatttaatatactgtagtatcacattggctaatttacgagacaaaatttttaagcctaattaattcataattagagaatgtttactgtagcatcacataggctaattatggattaattaggctcaatggattcgtctcgcgaattagtccaaga

SEQ ID NO: 6763 - DNA, 1501 bp, Oryza sativa
catacgcatatacaaactttgcatatgtacgaatacaaactttgtattcatatatctaaaaaaacccaaaaaaacagaagagaaaccaaaaaaaaaggaaaaccaatcttaacagaaacaaaaaaaaaggaaaaaaaacagccaaccgaacagaaacagaaaacacggaaaagcaaaataaaaaaaaagaagggaaaagtctgtctcccgcgcggcgcgtccgccgccccctctccgcgccatagtataaaaactcggaccggagcttgacccggcggacctttcggttcaccggtccgccggtctgaccgatgaaccggcggttcaaccgcgattttttacgtataggtatagtgcatgtttgctagtagtcacaagtgatatacaacctcaacccccagacctgaggtcgattcccaagtatgcacccatttttgccaaaaagttcgaggtaccaatatgatatggaccatactgggcctctcattggcccattacaaaccttcactggtccaaccgtaggcggtttaatctccggttcaacacaaaaccgcccggttcagccggttcacagcggttcgaatgcatgtcggttccggttttttggttcaaccgccggaccggtccggttttttccactatgctccgcgcgcgacacgtgtccagtcgtgcggggaggaacgtgcgctgatcacccaatagccttctcgcagcaatggatcggaggctcggagcggcggaggcaacggcgtcggttgggttgggtgttcgcagatcccgactagcagtaaaattcagcgttccatggtgtatagcgcgtttcacaggggttccccttgggaacttccactgccgctcgatcaggcctttacggcccagatctcgcactcacacatggtaatccgcttccgcaggttcggagttcacggttcacgatgatcattgggaaatgggaagtttatgagcgctcacaatcctgcttagtttatactactatgactctcgcaggcttctatttgggctatcttctgatcttgattttctcctaacttgaaagagaaacaatgtgtagtaaactaaccagtgattgctagtatatggatcatgcggcttatggaaatccgagtgttttttactccatttctctgtttcctccgaaagatattcagttagtcctacacacgcggatcggattgtgtaaagaaaagaaaaaaaaaagaaagaaataaagaactagagctaatccgagtcagatacgctgtgcaagtatacaacatgtatatgcaactgaatacttaaatgatggtgatgtggaggggagaagagaagagagagaagcagtcatcacacctcatacaagactacaagaggcaacatccacacaaactctaagaaataaaaaaaaagaaaagaagaggggttgattggtggcaagtgtattagaccctgtttagatgggactaaaacttttaagtccctatcacatcggatgtttggacac

SEQ ID NO: 6764 - DNA, 1501 bp, Oryza sativa; identical to SEQ ID NO: 1600

SEQ ID NO: 6765 - DNA, 484 bp, Oryza sativa
taaattagtctatgtttagcctacgtaggcgccacgtcagccaaaaccacctccaaaaacaccgagggatattgtttgcacctattttaatagtcggagaagtcgatatacccagttttgtggttggaggatatgaattatactcgggctatagttgagggagtcaaagtaatttttttccctttcaaataggaactagctattgggctgtcgacaggttttgaggcccaaaactcattttttgcacctcacgatctgcaatcaatgggtcacagcaaaataaaattgtctaaataagaatctttataacaacatgtttttttcctgtcgatccaggcattgtaacagaaacaaaaatgtctaaataagaatctttataacaacatttttttttctgtcgatccagacagcgtaacaaaaacaaaaaatcgagaaaacatggggtcggagaattaaacttcgacccccagcctccaggttgcta

SEQ ID NO: 6766 - DNA, 1501 bp, Oryza sativa
caaggttgtttacattatgacgaaatgaagagaaggaacgcacctactgcgaagagctcaacaactacttcctccaaatttccactcaccaactgatcaccaccaattcacttgtgcagtgccacctacccaatttcattccagtggcgtggtacgtaggttccgcatgtcagtgtgacaatcgtacggactgccatgtgtattgtgttcaggtaggtgcactggtcgtggtctcaccatctctcctccagtcgtacggcgccacgtaggcagtacacgtagacggccttcttcctcctccctcgagttgagttggttggtgagagtgagacaccgacggaacggaaggagaaccacgccgcttggatttttcttttttaccttttcaaattttaatttaaaaaataaaaccattttaaaaacttatcttcaaatacaaatcttttaaaaacactaacacgtgacacacagcgggcacgtcacccaaacgggcgtgacaatattgttttgccacaccaatccagctggtgtggacaaaatgttcatatattgaaaataaaatttaaaacaatttatattttttatctatatcattataaaaattgaagatgtttttaccggtattttgttactcatttgtgcatgagtcggtttttaagtttgttcgcttttggaaatacatatccgtatttgagtatgtttttaagttcgttcgttttttgaaatacaaaaggaatcgtaaaataaatctattttaaaaaactcgcatgctaacttgagacgatcgaactgctaattgcagctcataattttccaaaaaaaaatatatccaaacgagttcttatagtagatttcaccttaattaaaacatataaatgttcacccggtacaacgcacgagtatttttataagtaaaattaaaagtttaaaataaataaaaatcccgccaccacggcgcgatggtaaaagggggacgcttctaaacgggccgggcacgggacgatcggccccgaacccggcccatctaaccgctgtaggcccaccgcccaccaatccaactccgtactacgtgaagcgctggatccgcaacccgttaagcagtccacacgactcgactcgactcgcgcactcgccgtggtaggtggcaacccttcttcctcctctatttcttcttcttcctcccttctccgcctcaccacaccaaccgcaccaaccccaaccccgcgcgcgctctcccctctcccctcccaccaaccccaccccatcctcccgacctccacgccgccggcaatggcggcgaccatggcgtccaacgccgcggctgcggcggcggtgtccctggaccaggccgtggcggcgtcggcggcgttctcgtcgcggaagcagctgcggctgcccgccgcggcgcgcggggggatgcgggtgcgggtgcgggcgcgggggcggcgggaggcggtggtggtggcgtccgcgtcgtcgtcgtcggtggcagcgccggcgg

SEQ ID NO: 6767 - DNA, 1501 bp, Oryza sativa
aaaaaagacgtatttgtccttctgagttaatggtcaacccacagtcaactaacgggagtggcatgagagggtgcgcaaatttagactaatgacatataagagaagagccaattttcagtggcatataaggtatcagacaaattttcagtggcatataagcgattctctcttttaagaatctagaataaaaaaactaaactaaatgctagaaaattgaaaaatccagttttttttcaaattatcaaaaggtggttattactagcctcagatgaatcagccagctcgtgacatattcagagtagcatgggttctgtcacctctctgaatctgctaagtacacgaatctgaatcgataacaaatttaatttgttgtccgacatcgactatggtgtgaaatcctacttaagatcgacacgatcaacctccgatcctcttaatcggatcgtgtcgatcagccgccgccacaattgacaattgtgtttagtgatctcggcctaccatatatgtcgccgtcgacaagccggcggccggcggcgccgtctctgttcctcgtctcgtacgacgacgccgatggagggcgacccacgacgacgctgtacaacgtcgccaacggcgtgcaccgcccctgcgacgtcgacgacgagcttctccgcaccaagcggagctgggcgacctcgcatggcagctgggtgctgacctgggacccggcaaccctcgccaccttcctgtggaacccgcaagccgccgccgccgccggcgaggtcacgagcgtcgcgctgccgtcgttcgggcaggcgccgccggccatcaaggcctgctgcgcgatatcaaccggcgagccaaccggcgccggcgggttcacggtggtcatggtcgagaggggcagcaacgtgctgtggtactgccacgcagtggcggagccaggattttaaagttgggtattcccgtctaagcgttgagccgttggccgcttctacccctcgcggctgccggccacccaaccggcctgactgcctgagcttggcggagtggcgggcgccacccgctgcccgccgcggcaatagcctccccctccgtggtagcgcggtccagttctcgccgccagttgccgcctcgccgcgccgccgcctagggtttggaaatggggagcggcgcgagggagccgagccagggagggatgggtcatggagggagagcgagagggggccgtctggaagagtggtggctaagtggatcaactgatgtctgatgggtcatataggccggttgggctgtgtttggatcgaagaattgaggatttaggtgtactaatatatgtacatgtgtatagggctatgtttggatcgaataattgaggatttaggtgcactaatatgtgtacatatgtatatattagaaatatacttgtttttcgataaaaaagttgggtatttccgggaatacccgggaatcatggtagctccgcccatgctgccacgccggcgtcgccgccgcctcgctg

SEQ ID NO: 6768 - DNA, 1501 bp, Oryza sativa
gtcagagatacctgaaagatatggatcatggaccattattgaacgtgtctgcaacaacactggctgcagggcattgaaaaagcagaagaaattaaagggtggttttgatcactcactttgatgtgagacttggaatttttccactgtcattttgtcaaatgtcaaccccttgaagttgcttccccactacttgagctcctctttctctcttttatgttcactgccacttgattgatacttagatcctacaatatactagctaactatagtgtgttgaccttgtctctaccatgcaaattgcaagagtagggaaatatcgaggattttagctagccccccatcacaactttttctcctcctttttatcttttcactttcgaaaacttagaacaaccttcttggataacttcgaacaaccttcttctagaacattctatgaaggcccgcctcgaacgtaggaaggaaatatttcattttgatgtggatatgaaaattgacttattcggaattgaaggttggaagattaccatattccaaacaggtccaattcgaaaggccagaaaatcaccatgtttcatacaagtaaaaaaaggtgggaaattctgaacttacatatttaaaatgagacattacatcatttaactctaaatctaaggcctcgctctttttggattaaccctgatagattgtatatgcattgccacgctttgataactataatttgtccgaaaacttcataaatcagaattgcttaaataaattgttctaagttatttattagatttataatatatagtatttaatccatccctgtaattaaggcgatcatccatcaattttcatcttcaaagaatgggcccgtactagcactcaacaaaaactcctgtataaaaaggaaaaatgaaaaaacaaggagctccccaaggtaccacattatggactaccattatcagatcagattcactaatcacaaccattgcaactctaccattactatctagtattatctccgtcttaaataattacatttctatcatttaaattttatcccaaaaaaatttctgctgacaaaggatccaaatattccttttaatcaagtttaagaatggtaattaagtgggcttattgtctcgaccttccttttaatcaagtttatgtaggtaatgtgtggtcattaaattgggttattgtgttaaattgtgtttgttgctaatctatctttaattctctcaaaatgtaattagtttgggagggaggtagtagcaactagcaactaattactaggtctaaggtgaaaaacacagggacctgcgatgtgggtcccacaccctgtaccaggcccaggcccggcaagcccacgggcgccgcgggcccatccaccaccagcaccaaccacggcgagacctcacgacctcgcccacctctccctatatataccccctcgccatggccgcctcctcgtcaccaccatcaccaaccaccaactacagcaagcttgagc

SEQ ID NO: 6769 - DNA, 1501 bp, Oryza sativa
ctcgacgaacgagacgaacgtggaggaggccgatgaggaagtccaccgcgtccttgcgcgccttcgcgtacagcacgcgacgcgagcgcttgtccaccagcagcttcagctgcggcccggccccggcgggcttcgccggcaccgtcgtgtcgttcgccgtctgcaagcacgtagtgctcctagcaatcaataatgatgtccacatttttattgacgggagcgatcaaggagaagctgacggtgagcccggcggcgacgcaggcgcagcagcagcatctaggcggcggcgaggagcgcacggcggagaatgcggcgtcggtgtagcagccgctgctccggctgaacgcattggctccgggtctgggaacctgctgtcacagccgcggccgtgctcatcgcctccacggaggagaaccccatcacgctgttccgcctgtggctgccgcgctcgctgaagagagaagagagaagaggagaagaacaaaatagagaaaaaaaaaatatgtgcagctgacatgtgggccccacgcatttttttaatttttttgctgactaggatgccacgtcagcaaaaccggacaaaaatactgctgagggacctccggtgaacggtttgagagagtttaggggtacacatttctggttttgtagttaagggatcttaaaaaatctcactgttaagttgagggacctccggtgaccttattccgtgttaaaatggttaatcatgtatgcgaaaagctgtgggcctcaatctacagataatccaaaagcgtgggcctgtggttgtctaaatgggctgaacggccaaaaataccccacacccgttgagcccaccgctcactttatgggccgggcccatccaaaaccctacacacactttacaggtttacagcccaacttatccgtgcaagcgtgcaacccacgccgcttcgagtgggccggccaatctgggcccactcgcccatcggaccgatccgacccaaccatcttcttcctcgcgtcgcctcgccttcttcccgacccgacccgacaccgaccgaccgagccctcgccgcgcgccgcgccgatgccgcaagcctcctcctcctcgccggcgacggcggcggcgccgcctccgccgcagcctgcggcggacccttctccgtcggctgtgccagcttcggaggaggcgctggacccgcagacgccggcgccgccgccgcaggcgcagccggaggccgtgctgaccgccgcgcagaaggcgctccgctccaagccgacgaggccgcccgaagactccgacaagaaggtttacctccctttgcagtggcgtgctcgtccgattcttctcttgtgattttgcgttgaggggtgggggtgctactagggttttgggtggcacaccagtagctatgctcggtgcctcgggtgaatcaaaggaagtagacatcacgcccattcgttagtaagcagtgaacatcttatgaatgttcaattgtgcaatcgagtaaatgactag

SEQ ID NO: 6770 - DNA, 1501 bp, Oryza sativa
acatggcaagcatatcaaaccacaatggtatcctagctatatatagaccgggagtgttctcggtacaattgtatcttctggaattagtacgtaaaagcttgtacttatctaaaaataaataaagaccaaaattgagaatcgaaacacgaagtgcatgcacatgaaaacataattgttttgaagagaagaactggcatgagaaatgaagagcagctagctgacagtgcacaggggcaagtgcaggaacagttggtgcgtactacagtgatagacgacggcagttgattgattaaagtgagtatgagagtcgctttctgcatgatctctcctctcctccatccgcctcatatcagcaatgcagcagcttcttccattagcgcgattgctgtcttgctgacgcggaagggagggagcacgttgcgcggggcgtggcttgtcggggtggcttgcctcgccgtcgaagcacagcagtggggctagagattgaagtggatcgatccgcgaatccacttataaataaaattagtatgtaacctatgaattgatctgcggactgcgggttacatactaatttgggttataagtgggttcacgagttgagtcacttgcatcttaagccgaatcatgatgtagaacatatagattatttacttatttgatctataaataaatgaattcatgggtcgatccagttgaatcttctacttagtggccagcggatatcggccggcattccagcgtacaggaggtcactttccgggccggcggccggcgatgagggaagggggcaacggtacgtgcgtgtatgatatgatagctgccaccaccacggcgactttagaactagctagtatctctctgtccatctgcctgctagctaggatagcccgggcacaatgcttgctcgatcacaaattcacagttcacatggtagttcaactactactcttgaagggggtaaattttcacggaatttttatgggaattagttccattcgtctaaaattatattcttcgttttaggaagctgtagttttttttttctcttttttgcctatgagcgtctccaaagataaacagagaaccaagcaaaacatgaacaaatcctaattacacagtaacttttatagaccgtgaccgtgatagtcatccgtcctaaagaacggatctaaataatctcttaagaatcatcaccggtagaagttgaattcagatgcatcagtaaattcggtgttaaaaggaataaggtcaccggaggtccctcaactaaacagtgagattttctaaggtaccttaactagaaaacaaaaaatgtgtacccctaaactctttcaaaccattcaccgaaggtcccttggcagtatttttgcctagttttgctgacgtggcatcctattcagaaaaaaattaaaaattacgtggggcccacatgtcagctgcactttttttcccttttcttttcttctccttctgtactctcttctctgattctctcttcagc

SEQ ID NO: 6771 - DNA, 1501 bp, Oryza sativa
cagtccatttgtgagagttgtacctagaaaaaaagaacatattcatgccctttagataatattcactataggtagcaaactgagtacttgaggaaatttaacaataagaactgttcacagaaaaaaaaatacttactcgcttgccttcttgccaagccagaaagaaatggttccatagacaattgggaaactgatctccacatccttgagttttttattctgtgcgaaaaaatcagtaaaacaccatgtcaagtaaaaaattgattaaagcttattattaatccataaagtataccaactaactaaaatgaagcatatggtgtaacaaaatcaccctggatgattcacttaggcttcccaaaaaaacagagggtgaagtttgttggatgcttatttatttccttgttttcatacttcaagaaggtgactgtatgtttgatatcatatactagacgactaagcaattaattggtgtgaagaataagacatggtatgatgatgcaaaggaatgtatataaaccacaagctagtaatcagttaaacaatagatattctggtccactgtttctcaattctaactctaaaaatgacaaacagcagagtccgatgcagcttagctaatcggttagataagtcttggattgaatcgtatcctagtcatttactcgattgcacaattgaacattcataagatgttcactgcttactaacgaatgggcgtgatgtctacttcctttgattcacccgaggcaccgagcatagctactggtgtgccacccaaaaccctagtagcacccccacccctcaacgcaaaatcacaagagaagaatcggacgagcacgccactgcaaagggaggtaaaccttcttgtcggagtcttcgggcggcctcgtcggcttggagcggagcgccttctgcgcggcggtcagcacggcctccggctgcgcctgcggcggcggcgccggcgtctgcgggtccagcgcctcctccgaagctggcacagccgacggagaagggtccgccgcaggctgcggcggaggcggcgccgccgccgtcgccggcgaggaggaggaggcttgcggcatcggcgcggcgcgcggcgagggctcggtcggtcggtgtcgggtcgggtcgggaagaaggcgaggcgacgcgaggaagaagatggttgggtcggatcggtccgatgggcgagtgggcccagattggccggcccactcgaagcggcgtgggttgcacgcttgcacggataagttgggctgtaaacctgtaaagtgtgtgtagggttttggatgggcccggcccataaagtgagcggtgggctcaacgggtgtggggtatttttggccgttcagcccatttagacaaccacaggcccacgcttttggattatctgtagattgaggcccacagcttttcgcatacatgattaaccattttaacacggaataaggtcaccggaggtccctcaacttaacagtgagattttttaagatccctt

SEQ ID NO: 6772 - DNA, 1501 bp, Oryza sativa
gccggtgtgagcgagggagcccctcgacgcacgccacccgccgcattcggcgtacgaccaccccgagtacgagccggcgtccgacgaggccagcgacaagctccgtccaggcgacgagctcgtgcaccgcaggttcctcttcggccccgacgacgtcgccgcgttgcgcgaccagctccccacgcacctcggccccggtgctcgcgtttccttctcctcgagtccccgggcccagaccgccgcttttcgccgcctacagccgccgatgctgcccttccgcctgctccggccgcgtgccgccgcccgctgccgctcgcccgccgcttgccgccgttgcagccgtgctctcccactgaccaccacccctccacctgctccagccgcgctcgcccgctacttgccgcgtcggcgtcggcaaccgctagctccgagtcttggaacctgccgtcgccaccgcggccgtgctcgtcgcctccacggaggagaaccccgtcatgccgctccgcctgtggctgccgcgcttgctgaagagagaatcagagaagagagtacagaaggagaagaaaagaaaagggaaaaaaagtgcagctgacatgtgggccccacgtaatttttaatttttttctgaataggatgccacgtcagcaaaactaggcaaaaatactgccaagggaccttcggtgaatggtttgaaagagtttaggggtacacattttttgttttctagttaaggtaccttagaaaatctcactgtttagttgagggacctccggtgaccttattccttttaacaccgaatttactgatgcatctgaattcaacttctaccggtgatgattcttaagagattatttagatccgttctttaggacggatgactatcacggtcacggtctataaaagttactgtgtaattaggatttgttcatgttttgcttggttctctgtttatctttggagacgctcataggcaaaaaagagaaaaaaaaaactacagcttcctaaaacgaagaatataattttagacgaatggaactaattcccataaaaattccgtgaaaatttacccccttcaagagtagtagttgaactaccatgtgaactgtgaatttgtgatcgagcaagcattgtgcccgggctatcctagctagcaggcagatggacagagagatactagctagttctaaagtcgccgtggtggtggcagctatcatatcatacacgcacgtaccgttgcccccttccctcatcgccggccgccggcccggaaagtgacctcctgtacgctggaatgccggccgatatccgctggccactaagtagaagattcaactggatcgacccatgaattcatttatttatagatcaaataagtaaataatctatatgttctacatcatgattcggcttaagatgcaagtgactcaactcgtgaacccacttataacccaaattagtatgtaacccgcagtccgcagatcaattcataggttacatacta

SEQ ID NO: 6773 - DNA, 1501 bp, Oryza sativa
gtgagcgaaatttctcacaattttaagttatctaaagcctagagatctccaaaacaaaataagtaccagtagcgtatgtggactgtggagcatacgtatcgtgtgtaaacacttctgttacagcacaaatatgcggttagcccgctcttaataaaatcggttggtgtgaacactcacagatactcaagaggaacacaatacggtaatacccggtgacatcaacccaacttcccaagcatatgcatcatgcttaccttgttacttatgctgtggaaggaaggtgaccttgctgttctctttcagaggaaaggcaaaaaaatgatcagtgaaggaatggtgatcggcaagtgaggtcaacacatccatggggccttttaacgcaacgtgtacccagtaaaattataaaatactccatcccctttatattataagtcgttaactttttttctagtcaaattttattaagtttagctagatttacataaaaattagtaacatcttaaaaatcaaattaatttcattaaatctaacattgaatatattttctaacattaaatatacggaattgctattcatctgttgatagatttttttgataatatgtttgttttgtgtaaaaaatattaaagaagtttaattagaaaaaagtgattataatatgtaagctttctgttgttcaaaagggcaaaatttggtggctttcctgaccaaagcagagcaccaagagccaggaagaaaaagcacgagatcctgaagaagaaaccagtcaaccaactcgtgcacattacatttccatgccaatgcttcggctttagtgacgcaagagcttaccatgccgtcgacctagtcgccgccgccgtggagcccacacaccttatcaattggagtatatattactgccttgattagctcagctgtcagctcgactcacatttcatcaccgacaagcagaagtgatctgatcaggagcacaaaaaaaatcatctgacactcgatcgaatttttacctttctttgatcagcattgtcattctcatcatctcagggtaagtgttatgccattgccaatgccactctgaacatgtccatttgggttcttgatcattgattcaatttttgttggcatgtatttcaggggaaggatcatattcatcgttgttgtcgacgatgatgatgagtagtagtgccgatcatttcagcaacaataataataatcaggcgatgtacttggagcaagatgaagatttctcccagatgatcatggagctgtgtgattttgatgcgagtagcacgacgcaagctcgccatggcggcgaagcagcagcagcagcagctgggaacgcgagggcggtgctgacgtacctgacatttctggagcagaagatcggccacctccgcggcataatctcgtcgacgccgaacccgccgccgcagatcgtcgccgccgagctcagctgcatcgtcgtgcagctcgtctccatctccaagaacctcgccgcggc

SEQ ID NO: 6774 - DNA, 1501 bp, Oryza sativa
cggccatctgcgagctccagtacccgtcgtcccactccgcctggttgctccgccgccctcgccccattccacctgccttctctgcccgccgccgcctcactgccgcgccgccgctccgcttcgcctcgtcgtcgccccactatgcttgccgccgtgcttgaggtcgtcctcttcgatctcccccgtgctcccgccgccaccgcccttcccttctgccttgtgtccgcctgagcgccgctccgctgtccgccctccgcccaccgtccgcccacgcgccactccatcgcctgctgcccgcgcgtggcttctccctccgccggcgccgtgaagaggagagaggaagagaggtgaggggaggggaagaagaggctgacgcgtggggcccacgtgggtcccacgctgagtcagctgccacatcggacaaaaccggactcaaaaccgccgaggacctaggttgcactggtttcgtaagttgggggacgccggatatctcgtatcgtggttaggggacaattttgaaactcgatgacaagttgagggacctccggtgtactttttcttgtacaaatatactttactactacgtggatacgaccctacaacttcttcggcccatatgaagtgtacgtagtcaaagtccatatacataaagtttacatatattctttctatataaaaagtctatttatagaaattttctaaggatattattcatttaaaaaacattcctttagcattttgttatttctgcactaaactttgtaagtatgatgtaatttctatataaagtttacatatacaaagtctatatatatatatgtataaaaaatctccctacatatataggaagttttcacgaaaactttttatatagaaaatttccgttaaaaagataaaaaaactagaaatttttttatagcaaatcccaaaaactatatataacaaaaaaaatctgagaaataaatagaagtgaaaaaaaaaacagaaatgcttgatacttgcaacatattacagaagaatctcgtaaaaagaaggaaaaagaaaattgaaaacggaagaaaatgacgtttatccgatttctccttccgtcgaccgattcgccggatcaactaatggcgaatactcgtgcactactttttcgataatttgctacttacctcacctgatggagtgatggacggtaaaaaacaaggaaagaaagaaatcactggctcgtgtaaattcacgcataatgctcatggctacactttgagacggagaaaatatatatgtaggtaccgtatattaatagtaagcgattattatattatatattatataatagtagtacatatagttgacgtgaatggataattcgaggtaaatgcatgcccatatatctgggagatgtcagatcatgttgctgatggtgtgcaattttacgtgttccgttttccgttagtttttgtttgtctctcttccctgtaacttggctacggcccaacaacttagttcggcccac

SEQ ID NO: 6775 - DNA, 1501 bp, Oryza sativa
attcgcgcgcggttcctccctcctgtgcgtgcgtgcgtgctctctctctctctctctctctcgtcctcgaatttatctgttgttttttactactagtgtctagtacttgtgatttcaatcggctgctatgctcgttacttgcttcttcattcatagaccatatagtccctacctctctggatggatgaaattgtgtgagtaattgcttgtgctctggtgtcaaagggaaaggaattcagtcgcgtgctacagactacagagagctcttttgatcggaagccaatgaagtaatggagggtatataacctggggggggggggggggttgtgcgagagttcatctagattgaaatctgactcagaatttgcggccccatttatctccttaggaaatttctgagcaccaagaccatcaaattcccccttctgtcacctgtatataagtgtctgcctttcctccatgccattaactgttttagccatttgattgatatgcaggatgttggcgaaatccccatcattgcctttcttaactgctactgaaactgctgcgatcagcctctctccaagcgtaagatgctccactttgtccggtgatggccattcatgttgtgtttttccagagattctcaccttcatttcctgccatgctgaatcgacaaattatatagttttgcactgttaatattgagcatgtgcgcctttcagtgtcggactatatttattggcactctttatatgaacgtgcgccccacataaggattaaatgtcttgttcagtgaaaaaaaaatattgtgccagctgactacttatgtatcatatactatgacaccatatgaatttgatgaaatggcctctcaaatgcgtttaatgaaacagatgtgcgtggggttcttcagtcatccagtggttagatacttagatatacctttacacctcgacacgttcagcaaattcagactgcatttaagtatttattttggttaggtccctggcagcattctcattgatttgatgttcaatactagatgcttttctcaaacatcatttaccaattctccatttgttcaaaaatctatgttttcagtgaagggccatgtactgtgtttctgcacttggagttatgtaataagttatgcggtgttttatacttttattatgttacctctagtttgtaacaagcttgatatctccattaggagttctctatttctatatgtctatcttttttttccttgaaaaaactggttcactatatcacattcagttccagcttgcttcagattgatttaatgtattttgatgaattttgagtgattcatgttttgtgtagtgtgatctctttagttcaccaaatgcgagattttccaagaagaaatatggaggaagattaactatccagccaaacattgaatttggaaaaactcaaaatagtaggactcagagaaaatggaggacattctccgctgatcaagctcaagctaccgttgtcgatgctggtg

SEQ ID NO: 6776 - DNA, 1501 bp, Oryza sativa
ttgatgcttttgctttgtacccgtttatcgtaagggcacggcaaagccgcgctaagttttctagtttttttttctatagatggccaaataggccgcccggaccgacacggcctgacctacacgcagggctaggccgtgcccactcacttgctgcaccatcagcccaggcacagcccaataagacttgggtcgtgccgggccgacccgaagacatgaaagcctacggtgctccttcttgaaaaaactttggctccctaatctctttgtgccgtctcttatatgtttggaataagtttattttgcattcctcgtctctttgggacataccttatatggctagaataagtttatttttggctccctcaactacttaactctctaatcgttggactgggtcataccggattggcctatcatgccgaggcagaggcccaaacatggtctaattaaaggtcgtgctgtgcttggactgggccaaaatctcgtgccatgagccgggccatcgggcctcaggtctttcggtttaccgtgggacctattctacagtaccctgcaggtaataaacgctaaagaactttgaaaaaaggtactacctccgtctcaaattagtagtcgctttaactttttttcttataacgtttgatctttcatcttatttgaaaaattagtgtaaatataaaaacgaagaagtcataattaaagtattttaaataataaagcaaatcacaaataaaataaataaaaattccataatttttttgaataagacgaaaaatcaaaaattaaaaaaaaaaaactcaaagcgataagaattctaggacggaggtagtaactgtgtcggtatatatattttagaatggagtcaaaacattttttttccgacttatcgagttgaaaacataggccgaatccgagtcctaggtccaagtccgaatgcgttggtgcttgtgatcacagtcctgatcactagaacccaatgacattctgatggccgaattccgatagcttctcggcgttcacgaagcccaacggcacgtacagcctgttggagttaatttatttctagaacataccagcctactctctaactctctctactactcatgaaacaaaagtcaaggagcaagtccttcctctgtgaaatttctagagtagtgtagacaataatatgttctttgtgagttctagtattttcatgcatgtaccagtactagttgtgttcagaaaagttcctagccatcctataaataggcagctatgtcctagatgtgatgctgctgtccaacaatcaatgtaacgtgcaatacttgagcaaagcataaccagtttgtgaaacaaacacagagcttctctcctctgttctccttctctgttccattgctagcaaaataatcaacaacaacaactggtatcagagcgcccaggttcgagtagggcgtgacggagtagcacggcgtatcggtattgtcaattgaagctacaagtatggcttcaagttcgg

SEQ ID NO: 6777 - DNA, 1501 bp, Oryza sativa; identical to SEQ ID NO: 2767

SEQ ID NO: 6778 - DNA, 1501 bp, Oryza sativa
ggtggtaatagggagatcggccatcagatgaagatgatgcactgccggctgttgcagtggcgcttcgcaaatgccaaggcagaagccgtcagcaagaacaagctgtctattttcgaggtatatatatatcaagaatgcaccgttcacatcaatattataagtacccacacttataatttgtgagcctatataataactaaaatttgttcagtttggtgacatacctagtttgttggatttcagcccaaactctcagcgtcgaacacctgcagctcagtgaacagtgaaattctcaagtattcgacgaaatgaaaacgagcctaatagtgttttttcttaatgtgttaacaaaatttgcagtggttaattttttttcccaaattgagatacatggtatacctgcatatgcttaaatgtacgtatgtatgtgctttaggccgcctttggaaattaaacatcaattcatcaaatggtatattatgtcgttatgttttattttactcctaacctatgtgtatataggtggaattcatgggtgcatgggctaggatatcagagctgcaaggtaaagtggcaaggaggcgtgtacaactcgagaaagagaagctcaaaatcaagttgaattccgtactttcttctcaggttgatacataggagtacatgtttttgttcagttcgatatttgtccgtcaaaattgatcctttagtgattacttctctgacattatgatgcatccatgccatggtgaatatgtgcagatgagaggtttggaaagctgggggcagctggagagcaagcatgctgtggctttggattctaccgtagtttgcacccaggcagccatttgtaagctccctcttaccaatggcgcaaaggtttgtatttttttttcatttaaagctctatttcttaaaaatatgcacttccaacataaaaagacgttgatgaatacacttaggttgtgttcggtaggggagttgggaactctccctccaaacacgtaaaacgagatggttcattagcacgtgattaattaagtattagctattttttctgaaaaatagattaatatgattttttaaagcaacttttgtatagaattttttttgaaaaaacacaccgtttagcagtttgtgaagcatgtgcgtggaaaacagaggaggtgtagttgtgaacacaagctgccaaacgcacccttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 6779 - DNA, 1501 bp, Oryza sativa
ttattttaccattacgggtgctctgagtatctactactcatacaaaaaaatatatgaatatctactattttcatctcataaaaaaaataacctactagtgaatgtgaaacattttattaatataaaaacatatccaggtttatatagtattagaatatatcatatttgatactaagttgatttttatacaacagaggaagtacatatgtccaggacttaccaaatcgtttgggatagggttaccgtcacaccacggtttgaccgttaccgcgagttataccctggtttcaaaaattaaaaaaggttattgcacatcataaccatgatatatcagcacggttttgtaaatcctctctctatctctatggaatactactcttccaatttttccattacatcaaaactttcctatacatataaattttcaacttttccatcacatcgttccaatttcaaccaaacttttaattttggcgtgaactaaatgcaccctcaatctactatgggtcaagtagagacatgccctataaatatcaacatatttagaaatacgataattaccatattataagaaactgtaattttcacaagaatacggtaaatacggaaacgaacggtaaaacagtaaaactatttccgtttttattttcatatatttttttatcgattatcattttcatatagctcgactgatagaaagtcaaaaacggaccctccctacttgtactccgtacgttgtagtacgagtacactcctacgtctctctctttctccgtgtcttcgggcgtggatggtgtgcgctagctatagtagagctccgggataagtgcggcgtcgcagatggcagagacggggtgatatcgcagcggtctgcctcgaccagtcagtccatctagtcgagcctcagcctgaacctgccgccctgtcacacacagcgcttcgcaccagccgctcactcattggctactcgctgtactccacccctttgcatgccttcgcatctgttctcgtgcacacacgccctttccacccctatattcgttccatcatcatagcctagcttaaccagcatctcgttgcaatctcaggaggtgttttgattcaggagcttgaaattttaacgtgttacagtgcattggatatcggatattatgttcagatactaataaaaaattaattacagaattgattaataaaccacgaaacaaatttattaagtctaattaatctgttactcataaattattaaatcatggagtaattaggattaaaaattttgtctcgtaaatttagtcgttatatgtgtaatagatgtttttagcctatatttaatactttatatatgtgtttaaacgtttgatatgatagggtgaaaaattacgggcgggatcgcctcagattatctcagccatatcctatataacctatgctagctgctcttctagtccaactggtagagtgttgtgaatagccagttcagttcatcagttgataggagcca

SEQ ID NO: 6780 - DNA, 339 bp, Oryza sativa
  unsure (1)..(339): unsure at all n locations
tgatcatcgttatcactggggggatactttgggatttattattcatacatcacatatactcattcaacttttanggataatatgttttatgaacactttcncntccncnccccnccnccggttttgattgcttgtacgctcggttcccacaaagatngaagngtccaacttcaggaaagcacaggtgaggatgctataacaacaatagagcatatcggccaatttattgaacaatgtggtaaggctggtagggatggggggctaaaaatgaaggggggggggctttccttgtcaaaatatgcatttaaatggatttgaacactggcttcttaattaatt

SEQ ID NO: 6781 - DNA, 1501 bp, Oryza sativa
ccggcacgtgggccccactggcagagacacaaggcgggagggggtgcggctaacaagcaggccccacgggcgcggctccaagggggggcgagacgccggcctggcccggcatcaagccggccggcctgccatggcaagggcggcggcgcgcgcgtcgctggcgacggcaaccggcggcggaagacggcggcgcgaaggcggcggcgcatggcagaagcggcggctcgacccggctcggctaggagggagagggaggggaaaagaggaggagggatgcctcaccgtgagttggccggtgcggggaaggacgacggcgaacggcgatggcgactaccggggaacgacggtgaacggcgatgacctccgagacaccctaagagagggaaattgagagaggggagggagagagggagtccacggcgagcagcaaccgtggccgatggcggcggttatggagagactcactggcgcacgaccgaagcggccttcgatggcggaactcggcggaggaggggtggaccaggtggagctcggcctcgcgaacccgacggcggcgacggctcggtgcggtggctaccctaacggcggctagaggcggccggagcaacgaaaaaggcgacggcgggtgggagcgcggtgtgggagcgatggggagcacgggagaggccggtggaaaaaaggaaaatgtggaggaggacgcggggacgaattatataggggcggagaggtcgggaacagccgggagtggctcgatttcgcacgagttagtgggggaagttggaggtggggagagagagagagagtggcgggattcgaagtcgaatcccgcccatttttggggcgcgcgagggcgggagacccagggaaagccggtgacatgggctcagcgcgcggagtggggcgaaaagggcgcggaagaaccgaagggggtgggcccggcggtttcggcggctgttgccgtcgtggggcgggcggccggaggaaggggatgaccccgacaggtggggcccacctgtcggcgtcctagagagaggagggaggggcgcatgggccggcccaagaaggaaaagggcgcgcgcggcggtggggtggactgggccgacggcccaagaagaggaaaaaggagggaaaagaaaaagaaaaggaagaaagggtttttcctgggattaaaaattgcatgtgctcaattttaattggttaaaattatttctagggctctgaaaattccactaaaaatcttgttagtaaatttcgacatgtagaactcaagaaaaattccacatgccaattccgattattatttgcattggtttattagggtttactcttgcttttacaccgatattttcttgggaccatttataaattcaatttaggtttgggaggagaacttcagggtgtgacaatgcggctctcactcgtcgatgactaaatctcaatcgttgtcagggttacgggtcaggcataccctctacccttcgatatacgttacgtatcaaca

SEQ ID NO: 6782 - DNA, 1501 bp, Oryza sativa
ttgactcggacttcttttcatgtggcgttgacgtggcgcttaggtggcattagaaataaaaaaatatacgtggaactcatttgtcattcaccaaaagtatgggtggaacccactgatatgtggggcccacataaatcatcctctcccccctctctcttccgttggcgagctgcggccgtgggacgggggtcagcggcggagatgttccggcgaaacagaaacgacgagtaggagcggtgtggcgacgaggagcagccgcggagcatgattccggcggcggcgggcgggtgcctttctctgagctgtggcgcagataccggagaaattctatatcagttgattcatctcaccgatgattgtcatgcaggcgtcaccgctgtatatctcggagatggccaagatcctctgtacatctcgctgattatcaaatattatcaagcttagttactaactaatggcagatttaatttaattgtatagtaagagctgtacctggatgttggattggagttatggcaggctgaggcggcgcgagtcagaaaagcagtagccgatgtcggcgtggacggacacccaaagcagctcgtcgtgataattgatgctggtcgcttcctcctgcgcccccgcacgcgttccacctcttcctccacccggtccaccgtgtcctccacgcctgcctcaccccgtgcgccgccacggcgcgctacctcgaggccgaccggcctccaccgcgtcatcgccatctccgccgcaggaatcatgctccgcggctgctcctcgtcgccacaccgcttgaagaaggaaggagagcaagagacaaggggtcgtcgtcgcagcagctccagcgcccgccctcccgcccgccgccgggtgcgctagcaacggctccgcggggaggggtgggggaggccgacgacaacccgcgggggaggggcgttggtgatgccgtctgtgacggcggccaaggcggtggccggcggcgagtcggcgcagactccatcgtccgtggagaggagagaagggaggaggaagacggggaggagaggattatgtgggctccacataacagtgactcccacatttttcctgtgtgtatgacaaatgggtcccaaatattttttatttctaatgtcacgtaagcgccacgtggaaagaagaccgagccaacaccgttacgtaggtgccacgtcagcgaaaccgcgctctaaaaccacccagggagtcaaattgtaccgatttcgagagttagggggtcgagatatccagttttgtagtttggggtcacggattagatttcgaccacttttgagggtcaaaaattgaacttattcccctccttgggcccaattgcagcccaactcggcctacgcacatgcgcggatgtcatgttatatcaactcggcctatcgatcgaacagtccgaatcaacgacgaggcagaagagatcgccggcgagccatcgcggcggcggatatggctcgcacggcggaggagaagtcac

SEQ ID NO: 6783 - DNA, 348 bp, Oryza sativa
tatgggtatatatattgggagaggtcttgagaggttggttgatgtatccgcatatagttaatacaataaagctgtgatgcccctccctatccgtgttcatctactatatgattgtgtgcatgagattgtcgtcttctactccggatcaacgaatagaccactagttatttaacaattatgtcatcttcgcaaacttttggagaagataatttgttttgaaacgagaactacgacgagccgaacatcatcctctgcctccatcaaaccctgcctcacatgagcacccaccagtgcctatagcaggttggcacgaggagctgatctgagctcccatctgaacctgacagc

SEQ ID NO: 6784 - DNA, 1501 bp, Oryza sativa
aattgtcttgtttgcagttgtaatcaagatttttcaaggcttacaattccagttcgaaatttcgtcccctccactaagcaaatatctcacctgaactttttgagttttctatttgttggatttgaccaaacctagtctacgaagatgctcatagggataaggtttgagtgagtgcgttcataggggtgagtgcgtgcgttgtgagtgactgcgttgcactgtgtaatttaaaaaaatatattaaaattcagttaaaattagttaaaattttaaattatttcgtgagaaaaatgttccgaaattttaaaattttggtgaccactgaaattacgaaatgtcgttgggaaggatgaacacgggtaaagattaaggatatatgatggaaatctccttctttagttaacagctaatcagtcttttgtattttttttcttttggagtcaatagctaatcattttcagagcagcaagatcatgtcactttgatgaggcgatttggccgatgaatctgtcgtggcacggcttgctgcgattagtactccgctgttccgtcctgcgtgactacatcgattcggcctgctctttccgtaaaaaaaaaaaaatctaatctccatatgaatatggacacgcaaaatctaattctatatatatgcgtgtctagatttatatttagaattggatttatttttagatggagggagtatgtcccttatggaccgacgagtctagttcgcaggcattcgcccgtccagtgttgtggataacggttggtacggccgtatattcggacgttaaaactgtggcgcttacctctccgtcacgttttagcaaaacggtgcacattagtcgtttcaggacgtataatcaccgtcgttagcgactaatcagctgtatctgactaatcgaccgaataaacgggcctaatcacgtgacaagacctagcccagccagcccacgataactatactggcccattaattgtgtaacctagcactatatatactggcccattaattgtgtaacctagcactatatagctaacagaacgtcatttgcaatcccaaaatactcgcagctcatgatgttacacttgatgatgattcttcggagtaactcatatcttatttgggaccttgttttagtgtcacttatatagtgttacctgcttttggtatttctttatgcattacgaaccaaacctatcactatttgatgcacaactatgagtgttcagacctatattttactatatgtcgagttaatgtcatgttatccttatttttatttaagaataataggtatatatatatgtagttatatgcatttatatgtcaaaaataataagctattatgagttatgtacatatatttgtccaaaacgttaaatttccgtcaaattccgattattcgtccatactccgattaatcgtttagcggtaccctccccgtccgacatccgtattccgtcatccacaacactgcgcccgtcacgaacgcctcca

SEQ ID NO: 6785 - DNA, 881 bp, Oryza sativa
aactttgtttctaacagcttgaaattgattttgacaatatgacaaatataagcatcatttgtaaatacttaatgatttcaaatggaaatatggtcaacaacaaagttgatcctctcatcaagatctacaacttttatttggttacttcttcatccgataaagtgatagttatattattcacaaaaatcacatttctctcatctggtttataaatatcaacacagatatgtcaattttataaacattggtactatcactttgtcggatgaagaagtgaccaaaataaaagttacagatcttgattagctgtacaagttagctgtttatggctttcccatttaaagtcatgtaatatttacaaatgctgtttacatttgtcatattgttaaaatcaatttcaagctgttagaaacaaaattatatagataaatgaccaaaataaaagttgtagatcttgatgagaggatcaattttgttgttgaccatatttcgatttgaaatcatttactatcagaaaatgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcccgtcacagatgagtcttccgtgacgggcctgaatgtcatctcaatcgggcattagtatggagcccgtcaccgatgagtcatctgtgacgggctctacggcaaagcccgattgagatgactcatcactctaatataactagggtttctcagatcggatcaaaaatttttctaagtcccgctacagtttcccgcctccttaga

SEQ ID NO: 6786 - DNA, 1501 bp, Oryza sativa
accctccaagatccatccttctttttcaccaacaatgcaggagaagaaaatgcactggtactatgttggatcaccccgttgtgtaacatttcttgaacttgcctttcaatttcatccttctgcctaggagtatgtctgtagggtctaacaaacactggtccagaatttggaagcaagggaatgtgatgatcacagtaacgttttggtggtaacccttttggttcctagaagacttccctaaattcctccaatagagactgtaccgcagcaggaatttcttgaaaagattgctcagtgttcttatccagttgaactagatacatgattccaccagatttagccaatccattcaattgatcaggagcaataggaaaacaactctctgtgttagaatgaatgccttgtaatctgattacagaatttcccaacttaaattccagccacttttgcaaccaatccactttcattgggctgaactgctctagccagtccattcccaatattacatcataggctcccaatgctaacagtctgaaatcacttttgaaattgatgccttgggtcaaccaatcacagccaagtatatgcaatgaacaagagagatgccccccatatgcaatcttaactctgactggttctgtcattgctttaactccagacaaccttaatccaagctgatgatcaacaaatgaatgagtgcttccagagtcgatcagcatcaacacttcaataccctgaacccaccctctcaatctgatagagtgacttgattcagtgccattaacagcctgaggtgaaatagccataagtgtatcgttttcctggaattcatatgcttcatgatcagacaacaaagtgacatgcaagacatccatcaattcctgtacaacatgcagctgaattgaagatgcacatttatgatccttgctccatttttctccgcagacaaaacaaagtaccttcgatcttctataagacttgagagctgccagcctttcagcttcctttgactgagcgacttgatcagcgcttctcctgtcttgtgataaaaatggaggtccaccccttgtagttggaggtaaaggaagtggcatagcccctttatgagagcccttctgatagctagtggtatcaaccctcttggattcttttggtttatcaccttccaaagcttcttcctgtaaaaaggcaagagtacaagcagcatccaagtcgccaggcctttggagtaacatagctgatttaatttcatgtttcaatccttctacgaacttagtgacaaagtaaactggtttaagagaagggtcataggccatcatttgatgcataatgcaatcaaactgctctacataatctgctactaatcctgattgactgattttaatccattgcctaataagagcttgttgcctatctctgttaaacctactgcaaaccttatcacaaagttcaccccaagttatcccttccaactgagacctaacagcttgcagtcagaaag

SEQ ID NO: 6787 - DNA, 1162 bp, Oryza sativa
cgattgtggctgcaagcatctctgcccttaagcgtgtcttcccaggaagcctcggctgctctccaggggggtctatttttttccccaccggatgattcatcccccagcttctctttctgcatgcagtccacacgcttcctccgtcgatccatccagcgccgccgccggcatcgccgtctcccttgcccagtgtgtttttgcgccttctttggcttagctgtggacggccgcggtcttctgctcggtgatttcgtctccaccatctccattccatctgtccacggccgtcgccatccacgagctgcagcagcctctcctctcccagtgacagtccactcagttgcgccaccaccgacgaccttttgcttgaccggttggttctccggtggccatcgccatcacgtgagggagcaatgccctctttttcccacggcagtcctggcaagaaaatccttctatccccactgttgtacagaagaaacccttaggccccttggaaatgtcgttctttgatttattatgtaccaccatgacagatttcccttgacctgtatttttaatggtgcaagttacttattgtcaagcatgtgattcaataatccctactaattaagcattttctaattgaatttgacctgctacagtggttatgggatagttgcctgctgccccaagtccacaacatacacatattaaaggtgtccatatttagattcatgcttagctttccataatactccattgtgtactcatctgctggctttatgattttgttttgccattttgtataaatatctaggagtggtttggtgattgggatggatgtggtgcctgacactctaacaccaacaccattttctcagctaactaacttagggacaaatgagacagagaacaggctaggtgctactcctacgcattattcgcatattcaactttctttgcattttctcaattctcaactacagttttcttacgttgagcggaaaacttattgatgatttatttctttgtcttctaggtgctcctaacagtgaaagctctaatcataccatatcttttatctcaactcctgaaatagggatctccatgtcagtgtttcgtcatccatttcgatgacctattaacaggaggcttgcatttaaccctgtcaatcctgcta

SEQ ID NO: 6788 - DNA, 346 bp, Oryza sativa
cctccctctcccagatccggcccctacgaggagagggcaggacggtgtcggtagcagacaccaccctccctcccagatccgacccgaggtgggaggggggcggcggtggccaccgcatgcaaaggagttcgccggcgacaacggcgttgtttttttctaaaaaaagttaacatgttcattgatgttaacttgcaagttgaagctgtgaatttgaatccaatgctttgtgttgatgtatggatgtttgtgattggattttgttttctggatgagatttatgagaatttgtgatttgtgatttgaaacctagggaggggtggggctagcgggaatttttttggcgcta

SEQ ID NO: 6789 - DNA, 1501 bp, Oryza sativa
tagtggtactactcaccactgcgcatgcggtgcctgtctgtaaacaagtagtagtagtacaagctgatttggaaacagcaatgcgaaacgacgatatcacgtacggttcccaatcgtttcgatactagatgggtatcccgcacgttgcttcgggagaattgtgtgataatatagtagatataagttctaaaattttctttattatctattgtatgattttttttcatgtatttatataatttttacctttatcaattatccatagattataaataaatgtctgggttgtatagtgtgcttttttaggggtgtcggtgacatgggaccgggagtatcatgacttagagacttgaggcagacacgatcacccacgtggcctaacccactcggggggaggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggagaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagatgggggatttatttttttcggatccagaacgaccagagagggagagagtaagagctctctggttctccagcttttttgtagcttcttcatacatagatccacaaaaacacaggagtagggtattacgcttctcagcggcccgaacctgtatacatcgcccgtgtcttgtgtgtttcctttctcgcgaaccttccacacacagactaggagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcaacccaa

SEQ ID NO: 6790 - DNA, 1501 bp, Oryza sativa
gcggcgcggcgctgcatgagaaggagatggccaggagggagaggagtatgagggggaggcggaggctaaccatggctgaaacccttcgtctcctgctccggctcgtgcacgacgaaacgaggggagtgtgcgagctggtggctcagggctggtatatttgtactgacctgtagtagagtcgctgtttttctcgacttctggatttgcacgtgcgtttggctggtggttagtggtactactcaccactgcgcatgcggtgcctgtctgtaaacaagtagtagtagtacaagctgatttggaaacagcaatgcgaaacgacgatatcacgtacggttcccaatcgtttcgatactagatgggtatcccgcacgttgcttcgggagaattgtgtgataatatagtagatataagttctaaaattttctttattatctattgtatgattttttttcatgtatttatataatttttacctttatcaattatccatagattataaataaatgtctgggttgtatagtgtgcttttttaggggtgtcggtgacatgggaccgggagtatcatgacttagagacttgaggcagacacgatcacccacgtggcctaacccactcggggggaggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggagaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagatgggggatttatttttttcggatccagaacgaccagagagggagagagtaagagctctctggttctccagcttttttgtagcttcttcatacatagatccacaaaaacacaggagtagggtattacgcttctcagcggcccgaacctgtatacat

SEQ ID NO: 6791 - DNA, 1501 bp, Oryza sativa
aaaaagaaacatgattcaaaaatcgtaagtacttaatccatctccttctcaaaagtttgtgaatagttttttaagatacgttaagaaaaatagaacccttaaattattataaaataacattatctaaactttagtttgcccttaatctatgagacaaaatttctgaacaaacaatagtcttacctttcaataatataagtgcccgcgcatacgcgcgggccaccttcctagttagtagaatatgaaaccacgaaaatttagattatatggcacccttgaaaaccacaaaataaaactccactaggaatggtctaagggaactcgaagagggtatcagagtgacacataggacaagatcatatttctctaatctatttatcccatgatgcgaagtgactctaggggtgaattccatttttcatgtcaactcttaaaatttttcgcttcaatccacacattttttttaatttacagagtaatccaacattttatgttggaattaatgaatgggccttagcccactcgaagattaattctttggaaaatcacaaaagcccacctcatgggatggcatgcatgtggagtttagtaccgccttgcttattctaggagagggggacctccttaaaagggaggatgccctcctagtcgcttgaagcatgtgtggtggagagaagaggggaaacatacgcgcgcgctcgctcacctcgcctggccgggccgggccgggcagggcaggcggcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaagatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacaaaaaatcaatctagggtttgcctcctactctgtactgcaccgtcgctcatagactactccatcccgctcgccggcgtgcaccggcgatcgggagagtaggtctccggaacctctgccttcgacgttctgcaccgggagaaggcggcaataaggtttttgggaagcgtttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatatcatgatttatttatggaatagattaaatcattatatgtctataatctcaacaatccaaaaaccttattataggcactgtgattttacta

SEQ ID NO: 6792 - DNA, 1501 bp, Oryza sativa
gtttgctaaaccaaggttttaaggtagatggcattgcaaaatgcctgtgattaattgttctgataaaaagctattgagctgaagtcaagaggtaggttcttacctctgtgtttgaattctgaaaaacactgcatctgaccatctgacaaagctagctgaagatgacagatccatctgtaactttgcacattagtttgcacctgacattgtcttaatgtgttgtagatgtcggaagcatcaacaggacgagcatgctggatgatctcaggaagaacctagacaaaaggtggccttgggtaattgccatctttgctgctttagattcagctttgttcagagttcagtgatgtgatgcagctgttggaagcatcaacaccagcaagatgagcgatgctgaagtgtttacttttgtttctattccggtttgaaatacaatttcaatgaagcttgattatttattcttctgtacttgcaaatggtttgccttgcgtatatatagagtatgcaaaatgttagcttgaagcaatatatactgtgggaaacatgtagttgtacatggttatataattagcaatatatgattccattcttttgattgtctgaatcatatatttgatctgtattgttaaatatagccgtagcgttagcacatgcaaattactagttagagatgaagtgagaagggcatatttgttgaatggtccaaatagagcacctggacatgtttttcctaggacattagatggtaagatttggagatcctttcaacagaattggttcgatttgattgcttggaacatagtgtggaaaaggatgctgcattttgtggtatgttacttattttagttaacatttgtttacttctaccatttatgcattactaattgaggacatatccggtgaaaatgagcattttactggttagtcgaaagtcaaggtacgtcttttataagtatgcttttttatttaatcatgtaagtgttacatttgacttgataatggtatgtgccttattttagcattatcaatttagacttagactatcagtccagcctatcctcaatttttgtcctagattcgacactggcgagggcaacgaagtcatttttacacacaatattttgtgtactgcctactgatttcagtttgcatcttgcttcaactaagcccttgaagcccttgatttttttttcttcttgaagtgcagcttgatgatttatcatgtgctgatgaaaacatctaagccatgtttaatgtgctaaagatgaaaaaatctgtaaggcttgaaaacctagtgttggatagaaattcattttcccaaacagtacagaacatatatactttgccattccttgtttatgctgacgggtagaaataactgtgaacgatgggggccgccatattgcatgtaactgcctcattacttgttctctatttctgctgctgcaaatctgtgtactctatagcttaacttcgatgttattatatttgttggtataga

SEQ ID NO: 6793 - DNA, 1501 bp, Oryza sativa
aaaaacgaattggtgcctcttctttgctttagtcgtccttgtatggttaaatagaaatcatattgttttgattaaaaatatatagattctacataagtgatttttaattttttttatggattctttctcggtacagttttagtctttaacacaatcagagacgagaggataccgaggacatgctgccgcgttcaatggacgtcatctgggacgtgtggtggaaagaagccagaggcacacggtcgcgctcagtggccgcctggagaggggaaaattgaggcgacgagccgacgagagtggggactgcatgcagagcatatgccatccgcccgcgccaatagaaatcatggtagaaacgattggtcccaaggttaaccaagtttattggcttgccccacccccaaaaaaaaaagtttattagcttggcacatggtaattttttttggacttcctttttggtaacactcggtatcactactggagaaatccatctttatcggtcgatcagatttcacagttgtcccggttggattaaaaatcaggactagaaacatatttagtcccgatttaaaagctcaggggtactttttgaacaccaaccgggactacagatatatctatagtcccggttggtaatatcaacagggaaaaaagatctaacatacgctttactcccggttgactaaaagatctatttgtagtcccggttggtaacaccaaccggaaaaaaagatcgacatacacggagaggtgtgcgcgcggatcagatcgacatatctcctcctcctctccttttaactcctctcctcctctcctcacacactatctcttcctctccttctcctctccctctcctctcctttaactcctatcttcctctcctcctctccctcccccctcctccccatctgcagcggcggcgtgcggcggcgcaccgggctgcctcgcggagggccaggcggcctcgcgggggcgcggcggcaggcggcacgccgaggcggcggcctacgcggcaggcggtgcggcagcgggagtaggcgccggatttaggttttttttctctttttttttaagatttgtgattcggattgagatgtatttgatttgtgtgtgatgtgaatatgtgatgtatttgtgatgaattttgtagaagttgtgatgtaatttttttttaagattttgtgatgtatttggagatgatcgatttgaggatttggaggtaataatcaatttgagattttacaattcggggatgattgatttgggattttgggggcgggatggagtgaaatcaatatattaaaaacaatgaagaaaagaaaagaataaaggagcaaccggatttaggctgactctatctttactaaagaggctatatatttaaaaatagatttttactcccggttatttcacccgggactaaaaataacgatctttagtcccggattcgtagtaccggttggaaaaccaggactatataggttacgaaccgggaataaaa

SEQ ID NO: 6794 - DNA, 1501 bp, Oryza sativa
gatatatctgtagtcccggttggtgttcaaaaagtacccctgagcttttaaatcgggactaaatatgtttctagtcctgatttttaatccaaccgggacaactgtgaaatctgatcgaccgataaagatggatttctccagtagtgataccgagtgttaccaaaaaggaagtccaaaaaaaattaccatgtgccaagctaataaacttttttttttgggggtggggcaagccaataaacttggttaaccttgggaccaatcgtttctaccatgatttctattggcgcgggcggatggcatatgctctgcatgcagtccccactctcgtcggctcgtcgcctcaattttcccctctccaggcggccactgagcgcgaccgtgtgcctctggcttctttccaccacacgtcccagatgacgtccattgaacgcggcagcatgtcctcggtatcctctcgtctctgattgtgttaaagactaaaactgtaccgagaaagaatccataaaaaaaattaaaaatcacttatgtagaatctatatatttttaatcaaaacaatatgatttctatttaaccatacaaggacgactaaagcaaagaagaggcaccaattcgttttttatatccatgtcgattccccatcaatcaatacctaatatgtggtttgcttgtgtagtggtgcacatatgtgtcctctgtataatagaaaaaaatactagtgcaaattaatacttgaagaagaagctacagtaataaaagtcaagaaacaagaatagatgtcattccaaagaaaagatacacgagacagatacaaaacacacttgaacagtactagatagagttttgcaaattgcaattaaaatcgtacgtgcaaaaataagaggacagtattattttagcaaaacggattgtatatataaacatgtacatctatctcagttgaatgaagtacccatcaatcaattcttaatgtggtttgcttctgtatgaacatatgtgtttctccatataattgaaaatataatacttcgaattaatactttaagaaaaaaagtacaaaaatactcactctatttcatgttacaaattgttttgactttttttctagtcaaacttttctatgtatggctaagtttatagacaaatatagtacattttaaacataaaataaacatattatcaaaatatattcaatgatagatttaataaaactaatttggtgtttaaaatgttgctaattttttataaacttagttaaacttaacaaagtaaaaaagtcgaagcgacttatagtataaaacagaggaagtaaaagttaagaaaagagaacatagttgcagacaaaaacgatttttttatctataataattaattatcccaaaaattaaatatttagtaaatcaggtgcggacgctagagccaacggcgtccagatgtggacgctgtagcgaacggcgtccagcgcaagtccaacccaacatgatcaggctggagcatctagcc

SEQ ID NO: 6795 - DNA, 221 bp, Oryza sativa
ctcggtacccgtatatagaaggagttctggatgaaggaaagcaaatgaagttgtatatggaaacgaaaaggactactcggatcgtatccatgcttatctccctagttctatttggacaagagggcatctatgagtataaatacaagaccccctaggaggagaggggttaagccccaagcccaagatcaacatagatgattacaagccaacacatgccaaga

SEQ ID NO: 6796 - DNA, 575 bp, Oryza sativa
aaagatcatatacatataggatcaattcagagtttgccgcaaggatagattgatatagcacaccaaaccttctgaaattgtcgtggcttactagaataatttcgtgcatatattatttatttattaaaaaaatgcttagcaggagctctttccattcactaaagaaagaatcatatagaatagagctggttacaatcagaacaccaaagagagaataatataggattatttctgggctccgttcgtcatgtatcttaacatttttgtcttgagcataccataacctcaccttttcttttttatggaatttcctgtcttttttgtttactctactgatagattgcatctactgagattacaatacactgaaaagccttttctctattaccatttaccaaagcacatatttatagatgggagttgtctgaataagatccttcttgttttagtatccactataacaatcataacaggaatccaacctaatgcttgtgttttgtcttgcttgagcacgcgtcatattttgtccaatatatggaaatagctaatcatctcctttattttacttctttaga

SEQ ID NO: 6797 - DNA, 1501 bp, Oryza sativa
ctgaactaaatgggagaaagcgatcaagaggtcaaccaactcaccttgggatttacctgtgatgatttggtaactgaaagattcagacatgtagtagcctttgtacatcgcttttctcatcatttgaagttgaaggatcattgcttagcttgtgatgtgtctcctatcggcctcctcaacaacggtttggatcaacagacgcgcgcactgcagccaatgcagattctcgtccacaccctgttgcttccagtagtatcaagtatcaatgaggaaggatatggatctgctgataagatcaccaagaactgcagaaaggaaggtctccatggtgaactgttataaatcatagagggaaaagaggtgtttcaggccgtactgcaggagcaagacttacggcaatcaggcatgtttcttaaatagattagcgacaaggaattgtgatgtggacacattgaaatcattggaggctgctatctagatacaatgattctacaaaggcactgctaggccggggcattgagggcaagtgattgtggatttcagaacgtgtattagcagtttaccacttagcactgcaagagagcttggtggcctaatctcactggaccgacactagtgcaccaatcgaactttttattaagtcatactccctccgtcctaaaaaaaaaaagacgacctcctagtacaacaaatcactaggttgcctttttttgggatgggggagtagagggtaaacatgtacaaagtcagcaacaatgttactaattacagcccccaaacccagcccacactcggcagtcggcactgagacctggactactcaacagttacatcgaatcatattgtaatttactgaggaaagtaccccaagcagccattcatccccaatatcgatagccaactcgtcaggagatctccctacatgctaagcgtttagagagcacgacatttaggacaacaaaatcaatctatccaatcaacctatccgatgagaacatggaaatcacaacaaatccaccaaccaacggctacctacctagctatgctatttacccatcacggcggcgtggaagtcaggcggcggggaggaggacggggccggcggcgcaaaccggctcggcatgcaggtccgcggcggggatcgcgcgggcggagagtatgggcggcagggactccacgcgcagaagcaaccactgccggcgccgggaccacagcgccgccgcggacgcccgcgccgcgcgcccgccggcggagatagcgcccgcagccatcgccggatttcccagcaggacgcggcgagggagagagagaccaaccgggcctttgagtgacgggtgggcttgggaatagatgcagcttgtggaccaaattgtgggcttggatttttaatggttcgtgggctgaataccacgccaagaaggggttttggattgaagggtttttttagtaactgaacaaattcctgaaaaaatcgtgctttttgagaagtactccctccatc

SEQ ID NO: 6798 - DNA, 1501 bp, Oryza sativa
tgcacaaattcaattttccctgcacctgctggcacgccatttccgtcatgatcccgaatcacaaatccccagccaccagttttgctagcttcatagaaagcaccatcaatgttcagtctcacctcaccttgaggtggaggtcgccagttttcagtactcgaggatttggctgggttttatcatatctgaccgtatgagtagttggcattacatctcgcttgcccatccaattatgaacatgccctccgtcccatattataagggatttttggtggatatgatatctctatccaaattcatcgtattagaatatgtcacgtccacgaaaaatcccttataatatgggatggagggagtacttctcaaaaagcacgattttttcaggaatttgttcagttactaaaaaaacccttcaatccaaaaccccttcttggcgtggtattcagcccacgaaccattaaaaatccaagcccacaatttggtccacaagctgcatctattcccaagcccacccgtcactcaaaggcccggttggtctctctctccctcgccgcgtcctgctgggaaatccggcgatggctgcgggcgctatctccgccggcgggcgcgcggcgcgggcgtccgcggcggcgctgtggtcccggcgccggcagtggttgcttctgcgcgtggagtccctgccgcccatactctccgcccgcgcgatccccgccgcggacctgcatgccgagccggtttgcgccgccggccccgtcctcctccccgccgcctgacttccacgccgccgtgatgggtaaatagcatagctaggtaggtagccgttggttggtggatttgttgtgatttccatgttctcatcggataggttgattggatagattgattttgttgtcctaaatgtcgtgctctctaaacgcttagcatgtagggagatctcctgacgagttggctatcgatattggggatgaatggctgcttggggtactttcctcagtaaattacaatatgattcgatgtaactgttgagtagtccaggtctcagtgccgactgccgagtgtgggctgggtttgggggctgtaattagtaacattgttgctgactttgtacatgtttaccctctactcccccatcccaaaaaaaggcaacctagtgatttgttgtactaggaggtcgtctttttttttttaggacggagggagtatgacttaataaaaagttcgattggtgcactagtgtcggtccagtgagattaggccaccaagctctcttgcagtgctaagtggtaaactgctaatacacgttctgaaatccacaatcacttgccctcaatgccccggcctagcagtgcctttgtagaatcattgtatctagatagcagcctccaatgatttcaatgtgtccacatcacaattccttgtcgctaatctatttaagaaacatgcctgattgccgtaagtcttgctcctgcagtacggcctgaaacacctcttttccctctat

SEQ ID NO: 6799 - DNA, 1501 bp, Oryza sativa
aacatatttttcaagtatttatttatttttgctaaaaagagttcaaaactaaattatttcaagaacagagatatctattaacttattaaagtaacagaaaaagggaaaactattctaatccctcgaggggatgttccctcgtttgcttaaaaaccatctaaacggttatgaaaaattctggaaaaatttgacaacattcatacaacacatatatacaactccacaaaatattaagtccaaacttaactcacaagtcaagatataaaaaaaggcaaatttagcgtatgaatagtatcgtactgtttatatctaaatttatcttttatgtttcttgatgtgtagatcgaatttgaacatgaattttggtggactagtaggtaccattatactctatattgtcaattgttttcagaatttttcacaactatttgcatcgaatttaaaagaaaaaggtatacgaggggatatcctctcgatggattagaatccactccctagaaaaaggagcctccacgttctctcacggcttagaaattctcatattaatcggagaaaaagaaaaacagtaaggaatattagaagaggagactagagtccatatagaaatacaatttagaaatagttaaaattcggaattaaaaaataagtaatattggaagaggagactagagtccatatagaaatccaatttataaataactgaaattcggaattaaaaaataaagaatattagaagaagagtatagagtccatatagaaatacaattaagatataatagaaatttggaattaaaaataaggaatattagaagtgagtattgagtccatatagaaatacaattaagaaataatagaaattcggaattaaaaataaggaatattagaattagagtatagagtccatataggaatttaaaactaactaaaatttagaataaataaaataaaattaaaaatttagtttagagttcgcataaaaatacaatttacaaataactaaaattcgaaattaaaaaaaacatggaaagaagagtctaaagtcattataggaatacaatttaaaagtaactgaaattcgaaattaaaaattaaagaatattgaaagatgactttagagtccacatagaaatacaattagaaataataaaaattcagaattaaaaataaataatattgggagaaaagcctagagtctatatagaaatacaatttacaggtaatgaaaatccagaatttaaaatatatatataaagacgagtctagtgtctatatgaatataatttacgaataactaaaatttgatattaaaaataattaataactagcacatatataaaatacaatatgaatattacacattagtagtttcgtaaagttagtataaaatttaaaattatgttgtcttcttaatatatttgaataatatattgagaaaacatatatgctattatatgagataaaatgtaatgatgctagccgcgcaatctgcgcgggccaccat

SEQ ID NO: 6800 - DNA, 1501 bp, Oryza sativa
agaaattcccacattaatcggagaaaaaagaaaaaaagaaaaggagagttcaagtaggaatacaatctaaaaatagctgaaattcataaagaagtttccatataagaacccaatacgagattaatcaaaattcgaaataaaaataaaataaaatccaaaattagaaaaagagagagagagagagagttcaagtagaaatacaatttaagaatagctaaaattcggaattaaaaacaaacaatattgaaagaagtttccatataaaaatccaatacgatattaatcaaaattcgaaataaaaataaaataaaatccaaaattacaaaagaaaatgatagtccaagtaggaatacagtgtaaaaatagctaaaattcagaattaaaaataagaaatattgagagaagagtccatataagatcccaataagagattaattaaaattggaaataaaaataaaaatctgaaattaaaaaaaataaagaagagttcaagtagaaatacaatttaaaattagctaaaatataattaaaaataagcaatattgaaagaagaatccatataagaacccaatacgagattaattaaaattcagaataaaaaataaaataatatccaaatttagaaaaattaaaagagagttcaagtatgaatacaattttgaaagaactgaaattcaaaaataaaaaataaaaatattaaaagaacacaatatgatattaattaaaatttaaaaaataaattatgaaattagaaaaataaaaataaaatttcaattaggaatacaatttataaataactaaaatttatgataaaaataaagactattgaaagaaaagaccatctaaaacacatgacgagataaattaagtaacagacctataaaggagtagagtggtggcggttgatacgacatataaaaactgttaataaaacaccaaataaaatcctaatgacgattaaaaggagagacgacaggcaggccgtgaagcaaacgagcaaggcgcttcccgggacttctaaaaagtaaaaaaaaaacccattgataatcatattcgatttttgaaatctcaatgacaataaaaaggagaagcggcgggcggggtgtataggagagccgccaatggttggcgggacttctagaaaataaaaaatgaattccaacaatagttatgttcgatttttagaatcccaattacaataaagagtaggcggcggatgggccgtagaggagtatagtgacatcgtttaacgggacttctaaaaattataaaataataaaaccaacaagacaataaactctaaaaactacaaggtctaatttttaaatcacaatgacaataaagagtaggcggcggactggctgtagaggggcatagtggcatcgtttgatgagacttctaaaaattataaaaaatgaaactacaagtccaatttttaaaggttcgaaacttctaaaaactaaaaaaataatgataattatgttcgattttaaaatctcaa

SEQ ID NO: 6801 - DNA, 414 bp, Oryza sativa
ctccgtttcataatgtaagtcattctagcattttctacattaatattgatgtaaacggaggaagtacgtacgtactccgtagtaattagctagggtgatgggcccggctactaccaattctctgaactcaatatataggttctttgtcaaacatatgggccatgtaaatagggttaatttaccatacatctcagtttggattggcctggcccaaactagtagggaaagaaacagccttggttcttgggagaaggtcaggcctgctagctcaggcttgagctcggtgccactaagctcataaaccaaacgagccgagcccaaactttgtgtgctgggctcgttaagcttggtgcgagggccttgcgatggagctcctcccctaggctcctttagtttatccctatctcctctagc

SEQ ID NO: 6802 - DNA, 1501 bp, Oryza sativa
ttcgtggccacggaaacggaagcagaggccaagagacgtgaccgcgtcggattccttcccgtcacgcgttatcgcgccagagccgcctataaaccgccaccgactccaactgcacgccgctcgcggatttctcccccaaattccaccccccccaaaatccccttctattcggcgaacgcgacggaaaccctagctctccggccgcctccggcgaggactccgcctccgcatccgcatccgcatccgggccagcgacgccggcggaagtcgaccgcccgcccgcgcgcgctcgcccccccccctccccgccatcgcctcgactcggcgccttcctctactccgcccgcctctcgcgttccgactccgggcaggcctccttcgtcgggactcgggactcactcgcgcggggttcgtcttcttcctcctcggcggcgaagggacacgccggccgccgatcgacgcgattccccccgtagatcgattcgatctgtaactctctatctctgtgtattatttgtgtattttgatatctgagggaaaaagtctcagcctctctcgccgaaagaaaaaaaaataattgtgcagaagaggcgagaaggggaaaaaaaacttgatatcaacaccatgggtgttgtgtattacaaatataagagttcaaaggaaactatttctgtgcccgtgccccattcttttgtctctgtttctgaactcaagcagctcatcttgacgagcgacaaacatggccgtggccgcacccgtggccgcggccccagagaagatattgtcctctccaacgcccagaccggcgaaggtagttaactatctgtacaacgcattcgtttatccgtaaccgcatcagtttcctgttaattggcttgaatcactgaaacaaatcattgtatgatcacaaagctgggaattggataatacttggaatagtattttttttcttttgtccatatggattatctttttagcctgtaggataatattggttcatgattttaccaattaggactgagtcagggcattgtacccagcatttcttctcaatgaagaatgctggcatattagcgcctctgtcgattattaattcttgctgtaacctttaggaaagcttaagatacatcataagtaataacaattttgcccattagctattattctgcgtgcatccaagttcccaatattttgctgatgtgaaacaaacttattttatatatcctactcaatgtaactatctaagtttaactaggtcaagtgttgggcaaagtgtcaatccgattattagtaactagtaattattgtaaggtgatcagaattaggaattgaacgttcttgcaagatatgaattaggaatctagatatgtgttagttctattaggcactcctatgtgttgatcatattctgttgttcggttgatctgaatgcaatattgggactcataccaatgctattcagatgtttttaatgatctttatgctttgtcaatataatgat

SEQ ID NO: 6803 - DNA, 377 bp, Oryza sativa
ccacccaggctggtgagttgtggttgccgcggagtgtttagatctgatattcgtcgtgagatgtttatactgaatgatacttagttttgtatgatgagtttttttttactatggtttagtggttgtgattggattgtatgttgctacttgctaggagattattcttgtagttctttttgctcaatcttggagttaggaacatgtcggctgtaaactttgttgctatgatctgtaaaggcgtgagctttgcattgctggaaagtagaatttattcccctcttaaaacctgctgttcgaatcttcgatcagtttttagaatttattcctgcaaacaccactggttctgatttcagcgcctgaattgtatttgtttcagc

SEQ ID NO: 6804 - DNA, 1501 bp, Oryza sativa
gatcgattaaacatgctctatagtactcttaagtcaccacagtcaccacgtatgatattttaaaactttgaaaaaattgaaattcaaagaaaaaataaagtatatatatctatccacttaatttgatgacacattatttttaactattagaatacctttctctttataaaaaaacttaagccaccacatgtcatgtcttaaatatccttagaatgagaaaacaacaaatcataggttctcacttagattatttacaaagattaaaaaaaacaatgtaccctccacctccctctccaatcacatgcacataacactattgcattgcgaaccctttctcatatctgattcgagttctatgctattcatttctctccagtctcctccctattttcagctactaaactaaagagataaacaaatattaaaaagaccataattttaagctacacttataattttattttatatatcatctaatcgattttagatgatggtttctttttcatataaggtcgccacatgttaccccataaatcctcctaggcctttttaaaccgatgaacctattatttccaaccattagatctatctcatattaaaagacaagcgtgtattcataatacatcatcttccaaaataatatattgcacaactatatatcttcatccaatattattcacgctaggttgcatggagtctcacacacactctacatggaacgttcacatatggattctcaaactaaacaataatattaggctatattaacccatgcatttagtggagccacatatcccacccaattcatccgtcaataaacaatgacaacctatactcaattaaaaaaatcttacttttgaatttacacttaatttgctatttgctatacatgttttctaacacaaaatatgagtacctactttttagatgatgaagaatattataaataattgcttgtagggattaattaaatatggtatgttataaagataactaatagctaggttagaacattataaaagcaatgctaatgaaaataatttatggagaaatcatatattgtagatgttcaacatagtctacgacacatgcccgcgcattcgcgcgagctatcttcctagttaaactaattacgtaattgaactaagtaaaactggattagtctccttccacgtctaaatcctagctccgtcactaatatcgctcctcgtgtctgaacacgtatacattgctttttataaaaaaaaattacacagtacaacgcatatattgcttaacatgactctaattccactcctttcacatgttaacatgtgtaataccatgtgaccgtgtgatgatcgatcgatgatcaccattggcatgtgcatcagcaaaatctcgcacgcacgcacgcacgcgcattggtgtaagctatatatagcccctgatcatctgtgtgcatcttacagtgcagaggagcaagcaattgcacatcactcgacagtccacacagtgcata

SEQ ID NO: 6805 - DNA, 1501 bp, Oryza sativa
taagtgagaacctatgatttgttgttttctcattctaaggatatttaagacatgacatgtggtggcttaagtttttttataaagagaaaggtattctaatagttaaaaataatgtgtcatcaaattaagtggatagatatatatactttattttttctttgaatttcaattttttcaaagttttaaaatatcatacgtggtgactgtggtgacttaagagtactatagagcatgtttaatcgatctttactatgtaaaacgattcaagaatatataagatgcgttgtcatgtttttcaatgtttcgttgttatttggtaatgagattttatttttattgaggtagatttaatgcgttcatctgtttgaattatttatgtctttaaatccaattgttaaaattataactccacttatttaaataaaaattgatcaaattatgagtccgccaatttaattgaaaattgatggttagatttgttttcttcataatttttttttataattaaaattgttatttataaaataggaaggtgagagaaagaattattggagacggagaaagtgtatgtatgtatacttacgtgcgtagggtggtgtgaagggtgggctagtggggagaggatagttgtgccggtgggagagaggcgatggatgtggattgtgatttttttaaggaaaaaaagataaatataatagttgaaaaatagatggtttaccaatttattataataccatgtggcggtttggtagtgtttataggcgtaccacgtggaagtataggagtgtttgtattttttttagtttatattttttttatttttaaatggtaattaggatgacatgccctagaaattattcttttccgtagaagtttaccacggttgaatcattaagttttttaaagacaccatggatctaaatttagatgtgtttgcaaatttgatgattatttagggtgcttgttgtttagccagtaaaaagataaatcgtctagtagagcttagcaggatgaaaacacgtgcacacccttatttgtagcagacctcatgctaattgcattgataatccctagcaagaataggttagcctatttggataaccaaattaaagcaagcagcacacacgttgaaaacctattcaatgttttgatttatctgcatcgttgtggtttattatataacttagaaacaattatgatcacttaagtttttttagatggggttgctaggtactccctcattccctaaatatttgacgccgttgacttttttaaatatattagaccgttcgtcttattcaaaaacttacttttgtgaaatgtgtaaaactatatgtatacatatataaaagtatatttaacaataaatcaaatgataggaaaagaattaataattacttaaattttttgaataagacgaacggtcaaacatttttaaaaaagtcaacggtgtcaaatattttagaatgtagggagtataaaataggagagggaggaggag

SEQ ID NO: 6806 - DNA, 1501 bp, Oryza sativa
taccatggtaaattatcctttgtaaaacattatcaggtcacaggagtggcatcaagaagcggcacttccaccacaccgatgacacgttccgcgaccacccagagctcgccgtgcgcgaccagccgtcgctcgagacgcgccaggacatactagcgaccgtcgtgccagagctcgccgcggaggccgcggcgagtgcgatcaccgagtggggccgcccggcgagtgacgtcacccacctactccggcatgcgcatgcccggaggtgacctccggcttgcgtccctcctcggcctccgccgttcagtgcagcgcacgtcgatgtacttccacgggtgctccgcagccgccgccgtgctccgcgtcgcaaaggacctcgccgagaacaaccccggcgcgcgcgtgctcgtcgtcagcgccgagctcagcctcaccctgttccgcgcgccccaggaggggcatgtcgacacgatcgtcgggcaggcgctgttcggcgatggcgcgggcgccgtcatcgtcggcgctggcggggatgagcgccaggtgttctagatggtgtccgccgcgcagacggtgctgcccgaaagcgagggcggcgccgaagggcagctcaacgcgtccggcttggtgttccgcccttcgttcgagctcccggcgatggtgcgcgacaacatcgagcagtgcttggccgagggagtcggcaagcatgtcgcccatggcggctggaacgacctcttctgggcggtgcaccccggcgggaggaagatcctggacgtcgtggaggaccggctcgcgctggcgccggggaagctggatgcatcccggcatgtcctgagcgagtacgggaacatgtctggcgcgtcgattatcttcgtcctcgacgagctccgacgacggggcgacatgccgtcgggagggctaggcgtgatgctggggatcgggccggggatctccatcgagacgatgttactgcgtgtggcggcagcttgaagggagctcaaggagggaataattaactatttgccactcttacaagtggtgataaaagatttgccactggacccaataaaaaatttgtcactggattcacatgttgtagacaacgagttgcaaataattaattgacacatcttaagagtggcaaaaagttaaatgaactaaatgtattttttgaatttgagtaaattcgttttttatttttatttttgcgagagagtaaattcgtaaattggttttagagcttgaagaccaaaaaagctcatacaaaatcgtacaaacgagaggatacatttttgaaacatgaggtctaataaaatatttgagaactttgaaatacatgtatatactagatgatacaccgcacgtttgatgcggaacgttgtctataaatatacgtgagacagggaactaagcaactgtgaactgaaaaaaacttaggagggaatataaagatgttcagcaagtgcttatcaggttttatttgctgaaacatgcggatcaccga

SEQ ID NO: 6807 - DNA, 307 bp, Oryza sativa
cacctattcatctttcaacatatttatagttttaaatcttgcagaaattttaaccaatagatatagcccgtcttaatttttttttaaaagagagataaaaagttgttgtaaaatctaatgttacttagtgtagatgtaggttggatatacataaatatgaatcttaatgtaagattttacaaccgaaaaactgaaagatagaggttcaaaaatttgtcgcaagtgaaacatcaaaatcgtttttataaggaaaaagtacgaattactccccctcgaactatcgtggtcaactaaattacccccgtaa

SEQ ID NO: 6808 - DNA, 1501 bp, Oryza sativa
ttaatagttatatcatcaatatgtatagtacttcttgtaattttgctttgtgtaattatagtacttattgtaatattagttaggaacaagtatgaattaccccacccccaactatcgtggtcgaccgaattaccccctaaactcgaaaaccagacatcattcaccctcaactttcaatatcggacaaattacccccctcgaccctatcgagagctgttttgtcctacgtggcgtatgcgtggcaatcaagtcagcattttatttattaaaaaaatgtgggacccacctgccatactcctgttccctcttcctctctctcttctctgattctctctctcgctcttcttctctctctcttggcatgctcacggcggtgcaatgatggcggcggacggcgtggtcgacgcgcacggcggtgtgggcgacggtgggtgggggcggtcggcgcggagctgcgaacggtaggggagagggacacggaggcggcggcggtgcgggacccagaggcggtggggggaggcgaagccggagccaggtatgtcattgccgtactcgacgctgaagggcctggaggtgcaggcggcctagaagagggccttgagctggaggtgggtggggttcttgggcagtgcggcgtgcctcgagggctcgaactcgggcaccttggcgcagaacgcctccagggtgtagcgctccccgctctcccacactcggcggctggcggcacggcggttcttggtggagaggccgacctgctggaggcacgtggggaaggtcggggaggggttggcggcattggaggaggcggcggatggtgtcatcctcggggggctggaggagcaagggcacgatcttgcaaatgccgttgcgggacgcctcgggcttgatcctgaggatgtaggcgatggggtcggcgaactccaccagcgtcgggtggtactccggcgccacgggcagggtctgcagccactctggcggctccaccgccgctgcctttgtgtcccgcgtagcctccgcctccgcgtccctctctgccgccgtccgcgccgaccgcaccgacccactgtcggccgcactgccgtgcacgccgaccgcgctgtctgccaccatccccgcaccgccgtgcgcatgccgagagagagagaggaagagcgacagagaggaagaggagaagaggagtatgacaggtgggtcccatattttttaataaataagatgctgactggattgctaattcgtactttttccaattagttaacaagagtttaattggaaaaaaaaagaactcagtatagtctctatattgtatcatcaagtaagagtaactcattctagtttcacaaaactgcttgtattttgattagtctatatctaagaacgtgtatcacaaaaccatatatttaacaatagttttatcataaaactataacttttgtaaccttaatatgttatggatataaactctattttttgataatttcatcactaaatctatagtttt

SEQ ID NO: 6809 - DNA, 1501 bp, Oryza sativa
cctatagtattgaaatcctccaaaattcctatgtttttcctctaattcaaaggggccctaaatggttagggtacagtgatggattcttcggattggaagaaatttggagggattatgaaggaactaaaccaaatcaggtaaaaattttataaaatgtttaagtcacaatatactttgatagcatggaatcttttaagtatctatgtgcatatttttgacaaagacgagtggttgaagtttgaagataaataattatattgtcagtcggagtcggagtatttagagcaagtttaatagtatagccaactactagctccaaatcatttatagtcaacttaatagccaattcatacaatagttacttactacaatattaatacttgatctcacctgtcatacacacattgcatcttcgagtctgtgctgcagctggctgcaaatctgtagtccgctgctcttctttctcgtattttatctctttaaaatatgtttacagctaacttatagtgttctttgtacctgctcttaaaaacagagtatctggagtattacaccttacagtccatttatctccttgtgtgcacaagatcctaggtagactgttcatctctacctgatttatgtcatattaaatagtgttgtcgaatggacaactgcgtcatgccgaaaggcgtggttctctcaacagtggttggaagtaaaaaaacaattgtattgcttagtaaaaatttttggatccccctattacatgactctaaggggctatttatagctctgttacaggttcccccttaggggtttaggctttacaggggaatttacatggttacccttatgatagagacattattgggtgtaaatagtgtcctttgcatgtatgggcccctattggaccaaatggatcggcccatttacttgacgaaacctccagaaagcataatggcccgcggggcctctttatgatggggtttggtatttggcgaagcctacgccttcgtgccatggccttcgccttgtcgtcatcgcccctgcggccctccgacgaggtccttgtccagcgaaccccgatgggcggcattcacccgtctggttcctttctcaatccttcgccgattgcctctggtccgatcttctcgcctaagttcttggtttcggcaggttaggccgaaggcccttcgtggtatgcctccaacaaatagtatgttacttcctccgtttcatattataagactttctagcattgctcatattcatatatatgttaatgaatctagacatatatgtgtacctagattcattaacatctatatgaatgtgggtaatgctaaaaagtcttataacctgaaacagaggtagtagttaatagttatatcatcaatatgtatagtacttcttgtaattttgctttgtgtaattatagtacttattgtaatattagttaggaacaagtatgaattaccccacccccaactatcgtggtcgaccgaattaccccctaaac

SEQ ID NO: 6810 - DNA, 1501 bp, Oryza sativa
tagtctcttgcacaccgatgaactatcgattcttgaagctatatattgcctatacgtaaaccatactctcttttttttactgaatgaaccggatgcagatggttaaataagtttaggtggtctaaaatgatacaaaagtaaaaatacctatttcaaagtgaaaggtaaaggtagtccaaattaaaaatttagtaataaaaagctaatcaaaatgtaattaactcatttatatattacggaaaaaaatcgtgaatttataaatacaaaaatcttatgacgttaaactatataaattgagaaattaatggtcagaattacgaatgttttgacttttaaaacgaccgagagagcacaaaatttacttgaaatcaaagagagaataaatttatttattggagcaaaaccatttccttctctcctgcctccttgggctcatctctctctctctcactcttctccctcttctcaccaccagacgccatcaaacccctacctcccgcggcggcggcggcggcggcggccggcggcgagctccggacagacagaggagggcgcgagcggagagggcgaggagggaaggagggagggaggcgacaggcatggggaccctcgggcgcgcgatctacacggtggggaagtggatccgcggcacggggcaggccatggaccgcctcggatccaccatccagggcggcctccgcgtcgaggagcagcgtaagcaccagcatcttcccccccgctctcccttcccccctcgttaactaccgcgcaccacctgctcgtcttcgttttcctcctcctccggagaggagaggaggaggatcgggcctgcgaggtcgaaatcgtttcgatttcgttgtcaaagtctttggcccaatattgggagagttcgtcgctctagttgttgattaattggtactagcagccgtacacattcttcacaacccctttgtggtttggttgttattgggaaggggaaacgggttccttccttcgtgtgtattcaagtatcgtcgtcggtgattcgtcaagtgctgcatttgaagttttcgattagtgattctcgtctgtgtatcgaaacagcagcaagtaaatcaaagatttcacttgcacataattgttattattgtggttatactgaccaattggaatgtcgcattggcatgccgatttcgagtgtttattttctgttccctagcatcatgaagaatgccattttcccctctagctctagttggggtgtgttgctgtagttggttctgattaatcatcaccattctgcaacaggcaaatggccagaaattagcgtagatatgaatataggcacattatgacgagggggggcatcttttgttattttttcgggtgttgtgcatttagcttgatagatcagtttacaacttcgctaagtgtatgacttcttcacttagatacatgaattttatgcctgatcctgagtaacatgttagcgttttttgtatgccattgtcagtttcaaggc

SEQ ID NO: 6811 - DNA, 1501 bp, Oryza sativa
atgtttctaaacattcgatgtgagtcacgtgacagggcgtaaaattttgccagggatctgtcaggcctaaaatatcttgaatgattgaaccagttctaaccagaacaagtccgcacgatcacgtggatctagcaattttcgaggcatgtgcgtgtttattaaaaaagaaaagaaaaaactatgcttatataatacgtagtactatgtgagaaggacaatgtcaaaaggtacaatgaattgaacttgattaattaaaccataaacttggaacgatggcatgatggccggagagcttaatttgtcatatgggttatgcgaccccactaatcaccaattaattattcatttcctagtgatcatcattatactttcgtacaaaaaattctccacttcaagtaaggtattccctcagaacaaaatccataaagtaaaaaaggtatgcataataatttatgaaatttatcgatatctctaagaacatttaagccaaaaaggaggaggacaaaaataattaaaaaacaataaattacaaaccgtttgtgcgaacacactaatcaccaattgaaaatcattattcatttcgtaatgatcatcattagactttactatccactccaagtaaggcatttccccggaacaaaataaaatgcataaagttaaaaagaaatttaagtatgcataataattaataaaatctatcaatatctgagaacatttaataagccaagaaggagaagaacataaaataaatgaacaatagaaataaatgacaaaccgtttaggaaaaaaaaccgtgagaaaaaagaatactaaaaaaataattaaaaataccgtgagagtaatttggaggggaagtttccgaccacggttgtcttcttcctcccctctcctctgcccaagaaaaagatagataatcatcactcatcagcatgctccccccacatgccctaacaatccaaaattccattccaatttgcaaaagagagccaaaattaatcatcaaaagccggttcttttgatccccaatccatcctcacatggagcaaaaatctaatatttgcttgtgacctcacctggaaaatcccctcgcaaagaatccacccaagaaaggggagagaaaaaaaagagagcaatcaatcaatcaatcaatccctcccattgcttcacatttcttccttcccttttgcctccataaacctcccctaaagctcctatttttaccccccaaatcgcccaagaatcgccctacccgagagcccttgatccaagatccaatcttttctttcccttttttatttttaatttttttgcgttggtgtgtgttgttcaatccaaatccctataggaggcgagagagagagagagagagagatagagagagagagagagagagagagagagaaaaggttcgaaatttttgatcggaaaatgcagcctgacccgcagccgcatgggcgggggagggagaaggcggcgggggcgggcccgcggctcccgccgc

SEQ ID NO: 6812 - DNA, 1501 bp, Oryza sativa
atatatatatatatatatatatatatatatatatatatatttctattgcattatttaaatgaggtctaattccaaaattaacctagataattttggaggctttgagggttctaaaattaattaaaatatcctaatgtggccattattattacaatagcacattgaacaaacttatttgtataacaatgtattttacgtggatttatttattctataaatataaattgagactcggtacaacattaatctaattgtttaattaaacattaacatattcttatttatatataaagcttaatttatttatatgaccattattttatatgagtgattttcatgtcatgaggaactcggtgaaatgttctaagtatcaatctatatattccggtgaattacttatttataaacacgatcattatagtcgtgatcatttcatgtgttcttatatttcaaaagttcaaaattttagtgatttttattgttaggaattttcaggatgttacacaaccgtataggcaaagacaccagtcggcaacggcggaggcaagccgatggtgatgttctgactgatccattcttgaatcttaggagataagcttaaagtcatgaatccccattatacatatctggatctagatcctgcagaacaaacatataggatgagtagtatatgatgtaaatacagtacttgaggaaaattcaagtattttaagatgtttataaatatgtatttctcctcttgtcaattttaatttccccgagcaaatgactccttacgtttaaacactctgcccgactagtcatagcccccacacaccgggagttggccaaagcacttcccagacatgcatatgagtgacttgagttcatcattaatggaacagagtttcacggatcagaatttactactcgggtaattttgcaattgttaagagcataaaacaaatcatcttatctctatgctgttgatttcttccaagtaattcttagcaccttgcgttactcggtccatccaacgagcctccgggtgctaggaatcggcccaaaggcaactatccatcgacaaaccaaacggaaagcataggaagatagaactccataactcgatcgacactttatttttactcggattatttcacaagcaatcaagatagatattatgaaaattattgaaaaaatatgatataacatctgtagcccccgactcactgctcaatggagaaccgattgatgtagtgaggcagaggataaggaaattatcatataaagaaaaaaactaatgatgacttagcttttcagtatttcccttgatgacgacagagatggccaatgtgggaaaaagttcatccatcaatagcgatgaaaacaccaaccatggaggcagctgatgcatctataaatctactccaaaatcacagagttgagcatataggagcaattagcaaacaatgccagcatataagtccatctgaccaaactatatatattgcgtgcaaacagg

SEQ ID NO: 6813 - DNA, 1430 bp, Oryza sativa
catgtgagaaaaagtcaacggcgtcatcttttaaaaaacggaggtagtataagcctagctcgtatataaaataggtttacataagtgacaatggttttctaactttttattattattattttatctttgttatctcccaatgctcttggctatttgttccttttttccctatttccatcatggaaatgaatattatatatatatatatatatatatatatatatatatatatatatatatatatatatatatatatagcttgtttgaatggaagaggagatgaatgatgatgtcctccattgagttatgagtagtgttatttgcatgatggatgtgggggaaatggtaggtgaaactcaaccatggcagctgagctcatcgttgtacttgcatgacgacaacatgacgtatctgaaggcaccttgatgaatgattcagcgttattttctgctagtaacacaatacagtattaaagtaagtattgataatgaatatgttatactacgcatctacacccatctcattgattacaaatatgatgcgtgttcttctcgaatgaatagaagaatggattaaggcgatatgcttctttcagcttccaacgatgtgttttttataaacactttaatttttttcaaaaaatgttttagataattttttaagtttatagtagttaattcatttgtgttgtatccatcaagagtgattgcaaaatcttgagctaatcagctattcatttgtacccgcatgtttatttttttttctatcccgttgacagtggtatgttaatttcctctagcatgggtcactgagatctgagcgttctaccaagcaagcccacatgtattccttgataagggtctgatggtagacttcgagcttcatctctttttgagttaaaactcaaccaaatagtttcagagccccattgtttcgcttatttgtgaaataaaccaaacacatatttacggacgaaaagaaatttgtaaataaaacttttatatacgtgttcttagcgatctaaaagcaaggctgaaaaataaatttcgataaaaaaaaacccccaaaatcagctccaaatttaaggttgaaaattcaaattttggctgataaatctaagcataagcgaaaacatgaggtcctcagcgttaaaaaaaggaagcggagcgggcttgagtactcttacaaaaaaaaatttagagagatggagtaaagtttagactactctacaagtacaccctaaatccaactctaatagttaaacttagaagttagagctctactaaggtggtgtttgaatgtgctgaagataaggatgaagatgaagattaagtgtttcacgtaaaacgaggttgtaataacgtgtaattaattgatctaaattatatagcatatatgataatttgacgatttacataaacaaaattaga

SEQ ID NO: 6814 - DNA, 1501 bp, Oryza sativa
ggaacgcaccgagtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttgcaggtctcccgacgtggctgatccccacgggctgggtgatccgggttagtaatgtcgtgtgggtaaagtgtaccccctctgcagaggttaacaaactgttcgaacagccgtgcccacggtcatcggcggatgtgaggtgattcctagcgtagttttgtttgactactgcttgtgaaattgctgttgtgaaactgggttcgatgtttggaaaatcagcagctgacgggatcagctaggcccgggtggccgtttgaaaagttgttggcccgggtggccgtttgaaaagctgttggccgggtgccagccctgtttcaagatctaaagactgatacattgcacataccccgaccggacgagacgcactgtctcatccgtgtcgtttgagaagcactcacttagttgcttttagaaaagagttcaaataaaatcaattgcaaaaacaacagcctttccttgaagcctgcattaaacacttatttcccctggcttgctgagtactcccgtactcacccttgctctatataaataaccccccccagttgctgaagaagatgaagcggatcctgctgatgaggagttcttccaggagcaagccggctacgatgagttttagggtttcggcctagttcccaagtcgcgcctgtgattgtatggtccaagtcctggcttccgctttccttttgtaatgcagttgtgagctcgggatctgtccgcagcccaacatgactgtacttctactctataataaagagacctccgttgctgtgatattctgtctccctgtgataccagcactgtttcctgggactggtatcgattaacaggttaaattggagcgtcacgggctagttccggtcgggactagttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggcagtgaacgccagcttcagttcccacgggtttggtgagagtcaccacgtcgcccagcttcgtgacctctcccgtttccttggcttctcgtgtcccgagtacacggggtactccgtggaccgtgttccccctcactg

SEQ ID NO: 6815 - DNA, 1495 bp, Oryza sativa
accgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcacggagcgggtactgccaatgcgaggttatcgaaaagctttgccgtgacgcgtctcatgtgttgggacgaggctcatgtgttgggcaatcgcggagtgcgggtaaagtgtacatccactgcagtgtgagtaaaccaaatctattcaaatagtcgtgctcgcggttattgagcaccgggacatgtattacacttggctagactctaaattctttaacttgtgtgggatgggatattgcatgatgatttttatgctgatggagccacttcctgagaggcgggaacgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgataatttgagactacgcctgcggggttatgatgtaataattcgtattagacactcgtgtatgtgcacttggtatttcagctatgaattcgtgtgtaccagactacttgatccagggaaatggtactgtttacacgattgattcctgttataaaaacaggggtccacagagctggtatcagagccatacaaccgtaggaaaagaccaaaaggcgccccaccccttttctaagttggccaagggagaaattcccatttagtaatactttcaaaaataaaaacgctatgtttacaaaactcggtacaattttcatcttactcttaactattttctttacaaaacaagttttactctcaactaactttgggtttttcttaaaattagatggcagatccggattcacccgctacctgggagt

SEQ ID NO: 6816 - DNA, 1501 bp, Oryza sativa
aaaaaaaaaagaccaaagaccgggtacatagccaattttacatgacaactccatgtgattggatgaattacataaaggtcctagcatttttttgagaaggacaaagcaaaagataaaagaagcagttcggtccttctgtccacggttgcttcgttgattctgtagaagatggcagcaaatgcgatcactgcaagctgcagtcgaagaagcctaagcagaatccaatcagggcttcgtagaggttgtggccttggccagcatagaaaaattcagcttcaccctaaaagagcaccgtaagacatgaaacaaaaaattaagccgtaggtttaaattgaaactaaaaagaacaatgaatgatgcacccttacctaagagcaagtttaatagtacagtccactactaccttcaatttatctatagcgaatctaataaccaattcatacaatagttgcttattatactattaatatatagtcccacctgtcataaacacattgtgtcttggagtccgtatgttgatgtaaaaacacgagacctgggagatctgcttaactccagtgcagatccaaaagcttgcctttaggtgtatgagcgtgccagttgatttgatcctgcaatcaacaagaaataaagacaaagagaccgcggttaaatccataaacgatagccgatcggctagttgccgatgacatatcatttatctctaagccgatgtcatatgtggattgatcggcaatcataaataagtaagaaagagctaaatctactcgatcggctatagatattaacaatatataatcattatgtcgatatatgcttaaatcaagtgattgggatagatcggttaccatgccgagacagtataaatcacttagatcgaaatatatattaacaatgagactatatatgtttatagcatagtcgatcagatagatctagcatgtatcggctaatactctaatagtactccatattaagatatcaaagcaagtagaatataccaaacaaaagcctaatatacttaaatgcaacaagatcttaatataaaggcagatttaacgtgtcaatcaagcacataagagaaaagtagttaaatcaggtaagataggctgaaaccccgatgctaccctaatcagcagccaaaagcaagctagagattgagattctaatcacgactcataagatcaaactcaactgatgcagctataagtatgaaaagaatggcaatatctagacaatcaagctgttcaatgtgtcatagagtggtagatatcttatataatctaaatcaatgtcggtatataacctaattggatgccttccagtaacagacgttagccgattgaaggttagatagcgatattgccaaagattatataagatatatgataactcgacgaattacgtaagcaagattagagtatcataaagatggaagcactaatcctgagaacgcaaaccgccataacaagttttacctcttgttgaagatcgaaaccga

SEQ ID NO: 6817 - DNA, 476 bp, Oryza sativa
actagtggatccccgttctattcctatgctttttcctatcctgtgatccgaacaagcccttagcaggcacaaatcatggaagcactagccttttcttaacataatgcatagtatttatgtcctcccaatatggttatagctgaatttaatcgtgcatggtggatcgatagtgcattatatacaattaaccgagcattatgtataaaacatgaccataaattaatcgcaaataattgtaatatcgaaaaacgacacagcggacaaactgtatataaaaaagaaagaaatgcacattttaagaagaaaaaagaaaggcaataattcagaggcagcaaaaatcaaaaacctcactacggtgagaaagatgccatggctggcgacatacatgcacaaaaccgcctcccttcttcttcgcgcgctccctataaataccttcctccccccaacacctcccccctacccatcgccgccataga

SEQ ID NO: 6818 - DNA, 1438 bp, Oryza sativa
gtaggtcgtgctgagtggcctgagcctccgaaagctcaaccatgcgagtcagcactggctgagactcgctgtacggacaagggtacctggcgtctgagtggccagaaggaaggcgtggaagctgccgaaaggcggagcctccgagacggtggctgtagtcatgggccaggcgacgaagcgcagtccaggagaggtcctggtacgcgatctgcagagtgggcctggccacggtgaagtggtgtgggcgaaggccagctccgtgtatacctccacgggggtaaaggtacacagagagctcacagtgagggggaacacggtccacggagtaccccgtgtactcgggacacgagaagccaaggaaacgggagaggtcacgaagctgggcgacgtggtgactctcaccaaacccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaatttaacctgttaatcgataccagtcccaggaaacagtgctggtatcacagggagacagaatatcacagcaacggaggtctctttattatagagtagaagtacagtcatgttgggctgcggacagatcccgagctcacaactgcattacaaaaggaaagcggaagccaggacttggaccatacaatcacaggcgcgacttgggaactaggccgaaaccctaaaactcatcgtagccggcttgctcctggaagaactcctcatcagcaggatccgcttcatcttcttcagcaactggggggggttatttatatagagcaagggtgagtacgggagtactcagcaagccaggggaaataagtgtttaatgcaggcttcaaggaaaggctgttgtttttgcaattgattttatttgaactcttttctaaaagcaactaagtgagtgcttctcaaacgacacggatgagacagtgcgtctcgtccggtcggggtatgtgcaatgtatcagtctttagatcttgaaacagggctggcacccggccaacagcttttcaaacggccacccgggccaacaacttttcaaacggccacccgggcctagctgatcccgtcagctgctgattttccaaacatcgaacccagtttcacaacagcaatttcacaagcagtagtcaaacaaaactacgctaggaatcacctcacatccgccgatgaccgtgggcacggctgttcgaacagtttgttaacctctgcagagggggtacactttacccaca

SEQ ID NO: 6819 - DNA, 221 bp, Oryza sativa
atatttttttcgtcgttttttgccaacattcacataccaaaaatcacagatcgagttttttttctaatattcacaaatccaacattcacatatcacaaatcccagatccaacatcacaaattcatccaaaaattgaactcctaaatcatccaaaaaaaccatatcacatttaaaaattatccccacgcgggtcgccgcctccgcccccgcgccgcatcagg

SEQ ID NO: 6820 - DNA, 1501 bp, Oryza sativa
gaggtgagcatagatttaaccaaggttgttctacccgtcagacccaggttcctccctatctacccagccaggcgtcctaccgactaatcgaagaggggctagaggtgcactttgtgcaatcgaccgagcattagaggtaggcctaaatatttcagcggaaaggctgtccttgtgacttgggattcccccaggatggtgtcgatgtcaagattgtcacacctgattggtgccaccagcgatttctggaagtttgtgcgaaggctcgttgcttctccgaacttctcgagaaggctcgtgggagcatcaataaattgtgttgataaaaaccacggcgcatctgcatagagagaggttcaaaggtgtgcatgcatgcctctcaaactgctgagaatctttagctccgtagctttgcccataatttttttggagtgggtcaattgcaaggatgaagaggagaggggacagtggatcgccctgacagagtccacaaccatggcgaatctcctcccctgggatgccattgagaaggatctttgaatgggaggttacgaggagggcccctagccaatttatccaccgttgcgggaaaccctgatgctgaagcaacgccattaggtaatcccaacgaacgaagtcggaagctttggagatgtcgagcttgaacagcagtgtgggtcgcttgttcctgtggtagcttcgagctaggttgcgcacatacgtgaagttatcgtggttgctctgtccacggatgaaagcgctctggctagtcaaaaccaaggagtgccgccttaggtgtaaggtcagcagcttggagaagatttggttgtttgtttttacaacctattattcattcgtttgtctaagaatcctcattgtcggtgccgagaatgactagaaatgcaggatcactattgttgcccaaaaggtgctcgttgaattcgtgcgtaacccactggttgtccaaacattttatggttatcaattttttttaaatacgtacattcagacaaggatgatacatgtaaaagaactggtcttttattccctatatatagctaggtgcttaattgcgcagtatgaattgcaaaacgattaaaagtacaatctacaatttcaatgctatttcaaatatatgaaaaataatggtttgaaaagaaaactggtgtgtacctgtgcattgatagctgagataccagagtcaacggtccgtaagccaacaccagaagttaagtatggggcagtagttcaaccacaatccatatcattccggatccggctcctctgtctttaggtgataaaggcatacgagcatagtaatatgtgccttgtgctaaagtgggaaacaatgattttgcagtttattgtggtaacaatggcaaacagtaaaagtgttgtatatatgtaccattcatgtgctactgtagtgggctgtagccatcgatatcgttagttcgctgtaaatttgacagctgaaaatattctaaaggcacagcattgtgct

SEQ ID NO: 6821 - DNA, 1146 bp, Oryza sativa
cttcacctacggagtattccaagggtatctaatccaagggaacgtgtgtgattatcttctcgtcaggttcatccaaggatacaaagttaatgtgggcagagggcagagaggatttcctaatgagaaacagtgtatagggaaagcttaactttaatcctaatgcaatacttcaggcactggcaacccgctgttctcagatgtcgctctactacgtacccggacagggaggatttaagtgctcttgagggctatcaccacctctacacccacctcaaacgtattgtgggatacgcagcaaccactagagattaattacccagacactacatcaacgcaattaaaaactactctagtgccgatcaaacactaaaacaatcactataaataaatggactatagtgaacaatgaccccgtatgctaattaggaactaaccaagaagtaattctcactaagcaaaccttaattactcataatgttatttttattaaagcagagtaattaacaagatacaaaagtaagaggagattaccgacaactccgggattcctcagattccttctaccttactatctccctattctaatatacaataaagtacactagagctttttgtaattcagctcatgctttgctgtgtgtgaatgagggagaggaaaggggtatttataggtggagagttaccttgggagagtggagatgctccaagcatcctttgagcatattccttctagcttcatctcctcttgacaagtgtcctctctatgacagtttccaccggtagaaacggccacaaccgtcattgaaatgaggagtacaaccgtcataccgaatatgggctagactgggccagctgggtgttcggtcgaacccctgaaccaggggttcggccgaaccctggttggctcccctggcccacatccttcttcaggatgctaacatgtgggccccactttatggtactccatgttttggctccaaatgattgcacattttatatgttgtagctcaaaaccatgtgagtccatcagcgcaaaatatatttccattctttattctcattctctcccaactttggtggttgatcacctgcatacaaatatacacaaacactcgtgaaaattgttagaaataaatcctaccacta

SEQ ID NO: 6822 - DNA, 1501 bp, Oryza sativa
acaccagtcgctacgtcactgctcttcctctactcgtctcgtgcccttctctacctttccctatccccgaaccctaggccaagctacggtggtggcggcgatgacctagccaggagaaggcgacattggtggcccaactagttttctttttttttttggagggggggagcaggaggcatctatgataggccatctagacaacggcaagctggaccggcagcagagagcaggcctggcgaaggggagcaggcccgatggtggggaggggcccgctcacccacccagtcgtccaccccgctaaccctacgcacgcgcttccttcacccggccgacacccacctcctcctctcaaacaacgacggcagccgatggcctcaccctgcgtcgctgctcctccgagccaccgcccgtgccgctgtctccactgcgctcggctctccctccggctcctccaattgtcaacctggctctacgcgtttcattcttccgcccactgccctctcctctgctgcgctgctgtgcgtgcccaagccacctctctctccattgttttccttcttttctaagtgtgtttatctgttagttctatgttttccttcgactgcttgttgcttctagtgctgctggatttcatcttttattaagatgcctatgtgttgcaacgaataattgagaatgggaaaattaagtccttgaaaacaatacttttaattggttgaagcgcaacctttcatctctgaaaaaacaaaattgtcatgcttagaaaattaaagagttacagtctacatggtacagacgactcccccaaatcctaatattgtggcccacatgtccacgatggttccttttaaaaaaaaacatgtccgtgatggtggtggtggcccaccactactgtcttctaatagtagtatatagattagagggtaacatccaaaaatatatttcagttcttactacattctaattgctgatttatttttttaaaccatactaaatttacttgatgtaatactgtggaaattatggttaccccatatctacatggcggttatattctagctggatatatggtaccaaatatagatagaatatctttatgaggactcgggttagattctaaacttgtatgtcaagaaaatacccgggatcctagtcggttacgattgtattttatctgtaatcccatgttccgttaggatatggactgtactttgtaatatggatcccttctcctatataaggatgggtccgggttcctctcgggacgattctttttctcccagtcatacaatcaataacacactcggtggaatcatccccagacaggagtagggtattacttcttgaataaggaggcctgaacctgtataaaattccttatctctaaacccatccactttcctagcttgatagccacccccttttattattgccgaaatcttgtttcgacagttggcgcgccaggtaggggtagcgtcaagtttttgccaactaagtgcga

SEQ ID NO: 6823 - DNA, 268 bp, Oryza sativa
aaaattacgttaaaagcatttcaaaatcaacttcaaaatcaagttcaaaaattcaaattttggcttattctttggctgtttaggccaaacgatggggctatctgataagatcaattttttttcaaaaaatatcttcagattattggatagagaataatataccgattctgttggactgttggtgatgctctgaatccccgccccgagtcctccttgactatccaaaagcaccgcccgccgccgtcgccgcgacgccgcctagaaaaaa

SEQ ID NO: 6824 - DNA, 1501 bp, Oryza sativa
gagggagagtatgttatacataccaaaaacgactctcgttccacgacatcggtgtataaatactcttgtgtatccggagtttagacattaattattgtgtattttagttgtcagccatttttctttgaaaacatgaagtgggattaagttttaaatcaaaagaaacacgtgacggtgttctggatacctttccggagtatattgttttataccagtactgtgctgtgtgcaggaaataacaccagaagttgaagtggatgtccagtgacgctgctccggtggtccttataatcgtttcagtcatactgatcactatgaactctgaaggcatccatgaaattcggctgttgaacaggtgtgaaaataacgtgtaaccaaacgtggatcggctgttgtacatggcgttgtgaaaacagcagccaaggggaacgcaacctgtcttctccttaatttaccggaacagtgtagtctgttgttttaatggccaactgtggatagtgtaacagtttgagcatcatactactagttattgcacaggaagtagaatggatttctcaagatttgatcatgtgccctctaaactttgtagcctcaaaaaataaatcatgcatgatataccagaaagactacaaaacactacagcgttgggtggtatagtttatgttgctgaaggcgtcgatgacgtactatggtaccaagataccaaatctggtaccaggtttgatactatgataccgtgtttgatgccacatataaagtagtattccgttggttcaaccgtatagcattttgtagtcgtcgtcatggtactctttagtcctctactagaggatgggagttttttttttctcacctatggcaatcatcaattaataaaacccctagtgctaccgtttttctggtttttttgaattttttttggctccttggaatggctgccacattgtcctttgtgcaacagtgctcctcgattgggctagcagaactggtggcacgtggttcgaaggtcagctgctgctccctattcgctatgcgcttcgtaccagtaaacagcatgcatgggcgctatgtcctgtggaaaccgggtatgggcagttaagccatacatgtgaggcacgtacactccctatacaatttttcataaaagtcttggatatggaagttttctttcgtttagggtgaagtaagatcaagctcatgagcttattatcctaggtcggaacaaattagttgatagtgataggatcccctttttgacgtccccatgccccccccccccggtgtggtgtggcggcatgaggatgtcaaaaggaaagggatagagtttttctcgcttttggcgtagcgaggtctgcgcgacgggctattagctcagtggtagagcgcacccctaataattgtgtcgttgtgtctgggctgtgagggctctcagccacatggatagttcaatggcccatcagcgtctgacccgaagatgtggatcatccaagtcacattagca

SEQ ID NO: 6825 - DNA, 772 bp, Oryza sativa
aacagagaagataattctaaaaaaattatatttactcattataaatgacctagtatttgaataatttatttaccctatacacttccatgcagttaaacaaagtatggttttagccgattgagaatcataattagtctattatttgactggtttgactgatttatttcaggtaccaaatttagttattaaattgtaccaaaattacagtgagttgcatgagttaagtagagcctacatgaattttcccatgattttatcttgcacaaattattttaggtatttagtaagatttatctttatatatgtttcctcctcataaatgcatctagctatttataaaaattatatttggactctcttgacctaaggtgatattatttaacctcattttcatgtctttataattatttctcaagagtggttataggtttgattagtgaaattttatcttttatttatgctcatgagacctaatatgcaatgccaacaaaaaatccaaatgcacgagaaagactcaagtcaaaacatgtcttatgcaagtatgcatgcttacacttgtgtttgtatttttttcctaggttataaatgaaaaggttttaatttgccctcgaattttattcatgcaagagttagatcaacttcacctaggtttaaaaaggaaatttttggttcacaaaatttgaagaactttcctttcaactagtttggatggaaattccttaatcctagaatttgggtatgttacagggtaggtcttggacgagggaggcga

SEQ ID NO: 6826 - DNA, 1501 bp, Oryza sativa
caccacctctacactagctttattacactaaccccaataatctaaaagtattttcattttatttgtttgtttaatctactcttctcttttcatatagagcttatgtagagattgccccttgagtgaggggtggctcctcctatccctcttctcttctctccctcacctcatcatgtgagccaacatgcaatcttggggcaagtgcttaggggtttattttaattgctcttaagaacacaaattgtttactcaaattggaagctaaatatgttattttgacaaagtctagaattacttgtcacttctgtaggttaatgacgaagacactttagtgatgtaaaagaggaaagagtctttccttctcctgcttcctaaatctctgattttatcatgcaaataaatgtagctgtctttgttggagtggatcatctgcctgcaaagtgatcgtataggtgtttttattactccggccgtacaactcattttcatcaacttgatgtggtaaagttgtttagtagtctggcatgttatatatagacttatagttatacatgtctatgccctgatgttatcttgtcattaagaaacttaaggagatccttagcaaatctttgataaggacttgatattgaatattgttttctattttcttgtgctgatatgtcagtctgaactcgtgagggtgagtatgggcagaaaattttctttgccatgtaaaagttatctcaacttctcgcatcagttaacctacagtactatctagaataagagtcaagctgatttaaccctctactgttcagggctaatctgtaacttttggtgattaaatgccacctgcagctctcttgcaacctattatctagcttagcttaataaaaaactaggtctagaacattgcgatatgtgataatttaaggaggcgacatctgttaggctttggttaatctattttcaagtgatgacaggatcctctgggtattagagtacatgaagatggtgattataattgtatcaccttctgctttcatgccttgtttccctattctcactttgtttctgcagtcatcctatacttatatctgtgcatgctaatatgctaccaaatgtgcacaaagccacaaaatatactgaaggcagttgtttacctcttaacatggggccatatattttttagtaccatgaaatgcaaacaataatctgatgcgaacatccataacactaaaatcgcatcatattgttttcctttttgtgttttttggtggctggtaccatgagcatgaaaaatatcatttgtttgtcagtttttataaattctatttttttttctgtggtatactttctaacaataagaaaggcagtgagggagcaatgggtgaggagagcatcatatagtagagactgaggatacatggagttgagcaagaaggctaatagtttttctttttttctaaggtggaatgccatgtgggctagctctgtccagcatgcgtgattgttatca

SEQ ID NO: 6827 - DNA, 1286 bp, Oryza sativa
ccactccccccgcctcccctcgtttactattggtcgccgattacccccctcttctcctcctcagcgccgccgtgccaagaagccgccgccgcgccgccgtgctgagaagccgtgcgcctgccgggactcgtcgtcgccgtgtgccgcctcctctgctcgtcgtctcctctccaggtacccctctctctctgatgcccatgaatggaatggtgcagtggatggatgaataaatgatgcaatggaatggatgaatgaatgatgaactttggatgaatgatgaactttggatgaatgatgcaatggaatggatgaatgaatgatttaagtgccattttgacatgtaaccattcatggagtgtgtaccgctttatatgttgttttgttcccttttgctagaactattgaattttggggataatgtttacatttagctgaaaaaggatggattgatagattggcaacagtgtttctagcttggtagggtagctagctagaaatagtttatctagctagctagttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctgtcattctttgataattaaggaactttattaggtttagggtttgaaatttagttcaaatggaagaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcattttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattt

SEQ ID NO: 6828 - DNA, 1501 bp, Oryza sativa
tatttatcgtactattggactgtccttttccaaaaacctttcatttcaattaattaaagataaaaaccaagatcggtccatgtcaaggagtgaacattattccttctaggaaagcatcacaaaaatcaaacaaaacaccaaaagtatattaaatggctagtggtgattcgtttttcttattctgtttttaaagataagaaagagttgtagagatttagctgtcacgtgcatgaacgattcagccgccaacatgatcttttgtctaggcctagtcatagcgtcttcgtcattgtgaaaataatccccctctcgcttggcgtttaagcaaggccatgaaaatcactgaagcctcatcgcttgctttacagattggcggaaccagcgacactagcgataagcgatactgtcgagtccaggcaacttatagattttttcgatggccagccatttctactaacaatattataggcaatcaactatgggtatctcagttggccagccattttactagatattgtaggacatcaaccagggatacctttaaatttcggttgcagttaataagccaaaaaacagacgataggaggcataacaaatatatggatattttaataatcttttaagaaacctatatatttagtgaagcaaaaacctatatatatttatatgtagttcatatatccggcaactgtaggtaatgttataattttttatccgtcatcaagagtcacatgactcacatcggggattttaattatttgtcacttttaggatgaagtttaacaatttgttatttatagtctatgacatgcgagccatcacgtgtctacgatgagtccagcaacgaatcattaaatgtcacatctaaaagtggtaaatagttaaatatctcgctcatatcaacttaattatttctatcccttggttgtgtaatctataattcaaattgtttcctttcatttctttctcccctgaagtcatgtcgttcaattctttttatttgaataaccgatctatattctatatttaatctaaattgtttatacaatttctaatgattgatcaaagcgttaattatatgaagtagataaaattttatgtcgcttagttagaaaacagattcatcttatactttatttctaccattattatacaatattttttagcaacttgtgggccgggttcctttcttcaattttcagtttaattaaaaattgataaaacttcaagagaaataaaactagcttaaaagcatgagcgcaataaatataaatccttcattataatctcaatgcaagaatatttatacaactataaatataaatatatgtaattaattactaagatgcaaggcatgagagtaagcaggatttatagagattcggcaaaataaatttaattaagcatgagttctaaagctcttctcggattggctacttttctcgtttactgtaagcatgttttcctaattgctaaacgttatattttaaaataattttat

SEQ ID NO: 6829 - DNA, 1501 bp, Oryza sativa
caaatggtttggacaaactagttaataatttattgtcaactgtcaatgacgcattcctgtttcttcatcttcaaaacatggattagcaagtctccttgtccgcatgcgggtagccaagtcaaaaaattaacacatggtattttcaaatcatagattactacgctacaaactactacaaaagtggcagcaagactaaaccactggtacatctacaatgataattacttaattgctatgttcacaaatagatgtcgtacttcaacctcaacatccctttttttaagggaataaatctaaaaatattaaatcaataacatatgaaaaaaaaagatttgatatgtgaagataaattaatagatttctcagtaaaaatgctatcatatagttaaacttttaataatatctataaataattaagttgattgaatattatggattagtttttagccctttcttcattgcttttagtgcccaactcccttatgattgatactacatccgtcccaaaataagtgcagcaataaaaatccgtgtccaacgtttgaccgtccgtcttatttgaaaattttatgaaaaatttaaaaaaagttagtcacacataaagtactattcatgttctatcatctaataacaataaaaatattaatcataaaaaaaatttaaataaaacgaatggtcaaacgttggaggtgaatagtgcaaaactgcacttatattgggacggagggagtagtactgtaagacatgtaaaatgagctgcctaaaattattcaaaaaggataaccaaactaaattcaaaattgtatcaatcaattataatataaaagaaagtggagccatggtcttgttacaaactagccatttggtctattatgtcaacggaaggggtaaatatgtggtggagatccatatatatatatacccacaatgcatggaaaatggctcggtttcccttattctgcgtcaaatatttgtctcaattctctctactcaagataagtctttgattactccaatttggaagcagtactgatcgaccaatataaagaaagaagagctatgcacaaacgtttggatcaatgtcaaatatgccctacaaatttttcagtttgaatagtaaatgtggtggtttggtttgaagcttgtttgataatgttcatgctcaatttggcactattttagaactttcttcaccataatataaattttggctcctaattggcatcaatccaaacacatttattttcaatgctaccctaacaaaacattggcagtaccaaaatttatcaagattttgttactaccaatgttttagtatagtaatacaccagacacgtcttttttcttagccttttagtgacacaaaatgagacgagacattagtatatgattaattgagtacaaacttataaaattgatttatctgtcttttttaaaaaaatctgtcagggttacggataaggtataccctctacccttggatgtatgctacacggcaatg

SEQ ID NO: 6830 - DNA, 1501 bp, Oryza sativa
agggagtgtgccttttatatcaagagttgccttagtctccaaatataactcagagacaatgaatcccgcatgatatagaatcaacccaatcctcccgagtgggactctgttaatcaccagcccatgaggatacttcccataatatcttgtatacttccttaccacatacggaaatatatcatatgaacgatggtatgccagtctcgtacattccataagtcgtaggataggaggtatgccttataccatgacagaatgcatctgactaatgtatgtatttttaaaactcatgtgttttataattaaggacaaagtacatgagttacattccccaatggggtaaggctgaaagaacaactagttttgtataaaagcccatgagtgatgagcaaattacacttcaaacgtaacatacgcgaaaatatagaaaaaagcaatcaggtccttgcaacgactacatcaatgatgatcagatcctcacgcacggcgacggaaggagcaaaagaacaatggttaactgcaatgggtagagccaaaaagcatacccaaatggggcctctcaacagaggttgaagacaccttagcccataggagaaatcatcggccgccttttacagaactgatgttggagatgaccaccataggtgcgggacacaccgaagatggagcaaaaagccggtgcactccttctgttcgacgggctagagaacaatccttcaacccaaaagcaaaatagcaaaactcccaactgaaagcgtttgagatgagcttaggattcaccgagcaggaagacgacaacgacaagaacaccgacgaggtctgccatgtctatcaagctgagacaagaagagtcgaatgtcggcgaccctcttgagctacacaaagaacaggtagaacccgagaacgagagagacccgactaaatctaaacctatctctactagtgaataaaggagccagaccctcccctaatcccatgctgacaaccgtatggccattggagaaggaagaaaaggggctgggagtcgaagattttttttcccctgagatatcgcctttcgctagagcttttgaggcgaagcgataaggaccgtcgtatggaggccttaatgactaatatacttatttcttgattttataattagtgtgtctcagaatcttaagtaagaatttgacagcataggaactagagtctataggtatagttgttataagctcccaaaattataggtatagttgttataagctcccaaaaataaggtcttaacgggagattttaagtagtaattgataggtaaaaggtccattttacgcctctgaactcttgtgaagcggtttcactactgcaacaagtatttttgcatgtggccaaaaccaaattttgcatgcggttgagccatccgtctgcccaaaagtgtctgcaaaaatagttgtttttccatgcaggtggcgcatcgcatgcaaaaatcagattttcgcatgcgggtgcttatgtcatacac

SEQ ID NO: 6831 - DNA, 1501 bp, Oryza sativa
atgtgcatcaaaacgtactaaggctgtgtttgttggtggggttaggaaccatctctcacgtacagaaaaccaagcggtccattagcacgtgattaattaagtattacttttttaaaaaaaaataaatcaatatgattttttaagcaacttatgtattgaaactttttaaaaaaacataccgtttagtaatttgaaaagcgtacgcgcgaaaaacgagagggggagttgggaataggctatagatatttatatataaccatcgtacgaataggctatagattgcctataaatgatttgaattagtagttggctatactattaaacttgctctaatggagtagcattaatctctggaagattaattacatgaccaataattaggaagattatgtgattgctacaattaacttcagaatgaggttattcctaacccaatgactagaatgatatccatagcattaaataagctgccatctaagataaaaaaatgatatgacaagtaaataaatgaggaaagagaaggaaaccatgtcttgcatgggatttggtttctacacaacatccaagtcatcatgtgaaataagaaatagtggtatttacattggaagagtagtatatagtactagtttcttgattatgagaagtttatgaaaattatatatagtgttttaggttgggaatggcttgagggaggctgtggtgttgttggtctcggcgtatttttttctcccataataattaaaagagaatggagggatattcgacatagaaatcacaataatggccacctgctgtatagttccacgaaatacggcgaattgtgtattgtacaccactcaaattgaattaactaattaccggaccgcacgggtccagcaacctacagcacggtgcacgtaccattcaatttgcagcacgttcgcgcacacaccgttatctccatgtgatgtgcgacgacgaaccagaggagttgccgtacgtacgtgtcacggcgccacacacccctcgtcctccctgcaacctaaaccgttccacgcacatccgcctcggtcgatgctgcctcctcctgcttgcgttcggccctcgtattccggctcgacgaaccaggaccaatataaaaagctatggcctcaagaaaaagtaaatgtcaattaggataaaaccataatgtgatattctttacctaatatgaagccgagcattgctaatttgctatacgttcgataaaacttcatatgatcagagtacgatatttcgtagcctctggtgtgtgctgcaaatatggggcataacatgtttccacccaatcaaaaatcatggatggtaggatcgtattaaaatcctacaaatatcatcgtacgcaaagcaatttccatatgaagccatagccacattatcttttctttatccatgtcaatcggttacttttgtattaaatcctcactttttttttctattcacacatgcaagtctaataaattaataatccacaccctgaaaa

SEQ ID NO: 6832 - DNA, 556 bp, Oryza sativa
gagtccgtacttctggagtcgagagaaatcccggctgtcggtgacatgggaccgggggtatcttgactagaggtttggggcagctgcagtcacccacgtggcctgaccccctcgggggggtcgggcccgagggtgatgtggccgcccctccctttgtctccccgaggggtcaggccgctcccgtttcggccccgagggctggggcgccccgaccccctgtgggtttggcgccacgtgtgtgggttaggtgagcacagcggggctcacctaaccgcatttattgtgggttggacgagcgccccacgccctatttaatgcagcgcaacacactcgttcggtccgtgacaggtcacagtgtgtgaccggtcatagaccggtcagatagagggttaggtggtaacaggcggccttttccacgcctagccccgttcccgttgaatgatgagagcctatatgcactcgtccctagccggagcccgcgtgctgactcctggagttagcacgtcagtcccggctagattcataccaggcttcatcgcaaccattacaaggaagt

SEQ ID NO: 6833 - DNA, 1501 bp, Oryza sativa
gcactattcacgttcaacgtttgaccgttcgtcttatttgaaatttttttatgattagtatttttattgctatgagatgataaaatatgaatagtactttatgtgtgactaaatatttttaaatttttcataaatttttcaaataagataaacggtcaaacgttgggtacggatatccacggctgcacttattttgggacggaggtagtaagtgcagccatgagtttccgcgtccaactttgatcgtccgttttatttgaaatttttttataattagcttttttgttgttataagatgataaaacatgaataatactttactcgcgacttatgtttttaatttttttcaaaaaaaattcaaataagacgaatggtcaaagttgggcgcggaaaactatggctgcacttattttgggatggagggagtacaaaaatagatctaactttttgtcaaaaaaggagttggattaaaaattagtgcatttttcagctaaaaatatttaggctgtgtttgaagtattaaacgtaaactaataacaaaacaaattatataatccgcctgttaactacgaggtgaatttattaagcctaattaatccgtcattagcaaatgttttttagcagcgcaccacattgtcagatcatggagcaattgggctgaaaagattcgtctcgcaaattacatgcaatttgtgtaattagttattcttctcgtttatatttaataccctgtgcatatatttaaatatttgatgtgacaggatgaaaatttttgtcagggatctaaacaggtatgtgaaagagtttatgacacattaccaccactacatacaacaatacaaggaggagcctcgatggcatacgagttgggctaacacgagagggaactggggtggatcaaccacgtatgtgtccgggcatgtatatataggcccgatcgagagtgaggggcggggaataatccctccgacacataaaacgaagcaggccattagcacgtgattaattaagtattaactaattttttttaaaaaaaatggatcaatatgaattttttaagtaacttttatatataaacttttttaaaaaacacaacgtttaacagcttaggaagcatgcgcgcgaaaaacgaggtggcgggagtagttgcccgcgggaacgagcgcacccatagacctaggtggcatgtttggattcattgactaattcaaggctaaaaggtgaaaagagagtagaaaaagaggagagagggggagagagagctgcttttttatggtccccatacaaaattagtcacattagaacctcttggaggggctaatgttttgagagaggttaattcactttagcctcaaattagcccacaagtttggatccttggggactaatttatggctaaaaggtcaggctaataattagcccatggaaccaaacagggccctggttcaaacctgaaaaaaaaggattaagtaagataatgattaattaaaatataatcatt

SEQ ID NO: 6834 - DNA, 1501 bp, Oryza sativa
attatgtttcctagctagctatacaaaactttttttttagaatctactatacatacatgaaagtaatatatttccttcagttgcctgaaaatggtaaaaataattcagtcaaatttggatggccaggatatcaatcttgaagcaaccctagcttatcctttccttcttcccccaattactgatgccgccttagttgcttcgtctctctcccgtgaccgattccactacctcctccactaccactactcgaaaaaccatgcttacaaaccatcaacggcaccggcgaggccagccagactggcctcctcccccacctccctctcaacctctcccccactccattagattcgtggccgtcaatccccgcctcctaaccccacgaccttcattgccccccaccaccaaccccgctttgtctccatctccataacttcaatggcggtcccacaaccacgttgcccgctggtctagccagccactgcctaaggtcatccctctaaacccaaggaaaccctcaccttccactctccccaactcctccccctcccctttaccgtcatccttaaaacataaatcgttggtcaactattgatatcggacccatatgtcgtagcttactttgatctctggatgctcccctggctcggggcacacattacacaaagatacggatcgattatatacatcttgtacatacataaccatcatgcatgcagtgtacgcggccggtcggcctgatcgatatcgtacatcatgatctgcttgtgagacgtactacgccctcaaattgcaatcgctttctgttactttctcgattctttcgtcctaaaataatattattttggatccttatgtatgacttttacaaaataatttatttgtgagtagtcattgtattggagtttgtaaatgtagtggataaatgtatagggagtttataaagagatagataattatattgggatttgataaaataaagatcttctagtcttttacttgatttgataaatgtatagggagtaggacggatggagtatatccttgatttgcttggccacctagtagcaagctatagcttgccaaacattaattagaccccttttttttcatcaattcgtcgattggaattttaatttgtttctgtactgttgcatgcacttgtgaattgatttctgacccatcgtctgaagagtactatatatatactgcatgcggttctgtaattgcgagcagtactgtttcaattagataaaagttccagtcttttgacttgtcgaaatggacggccggacacagtctgacggagtactttggctgacttagattaataataatgtactcagagtacattacactattggccttaattactactcctacttcaattgggattgggattgtaaaatcaaaggtgtttttattattattctgtgatgaacaattggcatcggagattattggttttgttatttggaatttattcacgaagtggttttggaga

SEQ ID NO: 6835 - DNA, 1501 bp, Oryza sativa
  unsure (1)..(1501): unsure at all n locations
atacatgcgttgtttaaagttcattcccaatagccatgcatgtaccatatagactatgaattattaaaagaaagagtaaattttataaaattatatattttgacaaaaccatcgcaaaattatatattaaagccgccgtgtatcacaaattacatgtttaacattgaatctaccaaactacatatttatatgctggtctaataaaattataaatttagcacataatgtattacaacactacaaatttcataggtcccattcttgcgttattatatggatacatgtaacatgtagcttttgaccaaaaaaatatatgttgtatctatattttttgcaatattataccttcaatttatagttttatgataaattcacctaaatgcattatattttttgatagctttatcgaaacatcattagttttgtaaaatttacgcaaagacggtgatttactgttccttattaacaataaggaggtgtgctgcaaggtactgcatgcacctatgtattaccaaatgttaacactaaaattcgtagattgatttttataaatgaacctcctagctagtgtactaattaccacaaattaactaatactagccaaaaaaaaaagaaacatagtgtattttatcccttcagagactgtaaataactaaataaacactttgcgaggttatgcgacaagagtatatccgttatatattccgttgagtgtaaggccaaacaacccccactgtaacagaaggatgctcttgatttgaaataaaaattaaatgtttggtttgatgtgactagttagcatgtttagttaacaaccaaacctcatctcaatattatattagtgaacaaccaaatcatgatactatgcctaagatccttgatgaagacccttttgataacatactangaaaaggcatcagcagaagtcacctttgccgttaactagctaatcagcacataaagctttgtagcataacggaacaaaatgcaaaagtggcatatgtcaccctaactaaacaacacttggagctaggactagggcagattagaccaattaattagtcagattcaattattttaatttaggctatctccttaggtgatcgctcgagtactagtacattagttaaccataaacaactagggtttctgccaaactttcccatgacatctggtgatcgcactcatatggttatgacccttttttttaacccaagggagatcagattcttgtagctgctttttaatatattttttaaatttgcagtttttgagtacgtggaggtgattggatgaatgggagttttggtgcgatatggggaatggggtattgagggggaaactccctccttttcaatatataggttaattaggggaaggagttgatcagagaggattcctcctttatacattacctaaacaaatctcaaaaatcggtttttacttacgatctagcctccataatatctaaactctctatcgattttcaccatctctgcct

SEQ ID NO: 6836 - DNA, 1501 bp, Oryza sativa
cttaaaacggtcagattttttgttttttttgttacggctaaaatataatgaatttgacgttaagattttaaccctaggtgtaatacaattgatagtatgtgtatgattttttctagattttttggtgatattttttagttggtgtgcacgtgtgtacacgtgagggcctgtgtgcataggatatgttgcctacatatgtatatgtgtgtgtatatatatatatatatatatatatatatatatatatatatatatatatatatatatatatatatatatatatatattatatttacaagcttatctatctctgatgaagcaagcactatctatagagctatctaaactagctagccaagcaagttaaacgcagcaatccttgacctaagaaaaggaaacaggacaacatattacttaattattataattatagttatgtgcataatgtgacggcgccatgtacttaaattaattagttaaagcaatgaaggggaaagaataattaatggtggcagctctgaccacccatgtgtcgacgcaaagtttggcgtgtcgcacgctaaaatgtctgtcgacgtgtgtgagcatatatatatacatgtcgcttttattctgttatgacttgtgataacggaactacatgcccctttatatgaagtacaaataaattagtactaatagtatgtagatagggaaattaattcagaggacgtgtcgaatcaaaattatttctcttaaaatatactactagtaatatatgaaatataagaggtactaacacatgctacacctagctagtttcggtctattccggtcatgcactttgaacctagctagctacgactaactttgttccaaaatgttgctacctactccaatattaaatgggactaattttgatttgtagtattagtatgtgtctcatccagttttagataatattttttgcgaacgcgtaaaaggattgcacgtcaatatattagcaggaaaagagtttctgttacacaaagcaatcagccagactgacttatgcctaaaaagggtgggggacttgaagctatgaactactacgacggttaaaaacgcaactccaaacagcgggagggggcagagccacgctacactctcaagaaatcccaaaaaaaacaacaccggctaaagaccacagctggcccagttttagataacaatattttagaacgcaggaagtactagttaatcggatgaaaattaatatatgccacaatgaaaattaattggatgttggctgatttgacctatactgctaaaatttgaccttgatggagattcaaattaagcataactcaaattttcaagttcaataagtttttctaagcagacacttacagtacacgtgcacttacctctaagaacacatgtactacgtctataaacacctctaaaaactaagccgacgtatcttgagtttaaattttatagcccacaattgcttatatgctttcaatcagtaagaattcta

SEQ ID NO: 6837 - DNA, 1476 bp, Oryza sativa
ggcgtggagctagtcggccgccttgtgcgccgccgcctccgcgcgctcctcgcggtttttctgcatggacgccattgatcagatgatcttggtatgcgtcaaagctaatcaaatcctctgggttggaaatcgattcgagcttgcttcgctctctgcttcttggaggatgaagaggaggaggggggtgggggataaaaaggagggcggcgagaggatcggaggaatcctctggagatggatgaggcggcggcgcgggcggccgccgagatgcgccgcgggcgtcgcgctgcacgccgcgtgtgacgccggcggacacgtaccatgcatacgtgtgctgcgggggcgcatggagtgtgttcgcttcttcctcaaagcgggggagggggttaatgggatcattgccattgcaaattgaaaaaatcatctgttttaaaaaatatctttacaatttatataatttgatccatatacgcgttttgaatttttctttcctactgtatttttatgtctccttttaaccctaacctcaaatccaacgaccatagccaaatcgatcacctaatcttgccaacgtggggagcgccaatcagcagcgacgacgccggcggcaagtgacgactagctaaatacaaagcttgctctcgacacaagcatatgcagtggcggcgcacggtaacgatgaagtttcgatctaggttgcgcaaagtcggttctggcgacggcgagctcaacatgagcagacctagcactggtggaggcagtaaggtctaggacgacacgttcgacagctacgatacgcagtctaggcgccgatgagcaccaagctaatggtgctggtgctggcaatgagtgccagctagccgacttgagcggtcgtggacggcgacccctccatgccgacgagcgatgccaatggtcgtgaacggcgacctggctcctccaccacccaattatttttctctttttttcctatgtagttttttatatgatattcattcaattattttgtacacgaattatgaatggtgaagtggtagcagtttgttgtggtagcgatgtcaaatgttagattgaaaattttgattagaactaaagcatccaattgtggagttggcaggaggaaggatagtgttgttgttctttgagttgtaagagacgattttattttagtccataaaaaataaaaaatagagtagtcacaaaacgattcataatgtgttttagacgtataatgtggaattttgatgttttgcagcacatgattttaattatgtgatagtagtggtatttttcaaaattgataaatttataatggcattgatataattaaccaaactgtaaatatattccttagcattttgaatttttttttcgcaatgcgctggcattatcttcggaaacacgccaaatatgttatatttaaggaacatccgtcagctacccattctcgaccttgatttttattcctggttttga

SEQ ID NO: 6838 - DNA, 1501 bp, Oryza sativa
ctgtcgccgctgtctcactggcctaatgcgtgagtactatacattattcttgtttacaaatattcatcttttctttccttattatgcttatgaatcaaaatttaaaatttaattttaggttttacaatttatttataagccatgttgttaacgtttatatatgaatatgtgatagtcttttaaatactaaactcttttaaaatttgtacatagtttgcagtatcatttacagagtatattttattgaattggtgtttgtattgagtattcctcttttgcgtggataagttatgttcacgtttatagggcttgtttggcatagtttcagctccacctcttctagagttggagctcagccaaacaatttcaactccatctaaaatataagtgtagttgggtggagcgctctcataaaataaactagagatgtggagctgggtttaggctcaattccactctagacccaactcctaaaactaaatttaagagttggagctttaccaaacagactatacatatatgcaatggcaatttaacaatatcttaagatcaaattataagacatcttcaaattattatacatggaaagtaatttgaggatattgcatccattagggcagtcccaaccctccacctagtatggtgtctatggcattaactacattgtcatgtaggacttttagcttatgtggcactatattaattaagagagagagtgaagagaggaagaaacggggtctcatgcaagacacggcttcaacacgagaacctatgcactagacactatcaagttttacattgggagagaatagtgtcttcataatagatgaagaataaatatgattggtagataagagagatgatgtatttattaatgacccattttaagaaaccatgggttgtagagtgtagtttctattgtgatgtcttattgacatggcaccataaacactgcttatggacactataggttgggagtgcccttatatcgtttttgtttatgcaattcatttttctcctttttctttcccaacacaagactgaagtacgattatgttcactatttttttacctgctgctgttacatgccaattatttaggactttgcttagtttgaaggaaaaaaagatttgaattcctaagaattaattttcataagtgccattcgttttgtggaaatgaaacataggaaaatcaaagatttttttttctttcatacgagttggatagagaagaaaacatatgaaattttctattgactcaaatctcttggaaaattggaagggttggggtaatacaaccttatttatctattttctcattctcaagggttgaaaattctcaaaaccaaacaacctctaatatataatgggattaacaatctcaaatgatatatgctcactattcgaagatgcttataacgatatgcttgttcagatacatccctataattttttttgacgtagggtgtaagtgtatgactgtatatgtttataggggt

SEQ ID NO: 6839 - DNA, 1155 bp, Oryza sativa
gaaactaaaagaaggctgagttcagcgtatataaccaaggtgcttgcctctattcctagttgaaggacaggaagaaaatagaattctcaagtccaatgccaagaatttttaagtggctcaacaatacatggaaagtggaacccccattgctggatccattgacaatctcagaacatatacagcttacgcacaataccattcaaagaccccctgcaacttgcatattcttgctcaagtcacttgcaagaacttatatgatacccactgtcccaaaataaagctatttccagagtttaaatttgtcccaaaatgtagctatttctacacctaccctcttatctcaaccaatcgcaaccatctcttatttaattcctccacctattttctcctctcaaccaatcacagcattcagttccacctacttccttaattcctgtgaaaaaatagatgcttatattttgggacatgtggagtattattgagccaatgcggcattccagtagagcaagaccagcgctctaagcttctggagaaaattgcaatattgggactgcaaacattggggcttcgctgttgacactccgagtggatgataaatgggcccatccgtgtctatgaaatatgggtccagtgtcattatagcaaagcttatgtttgcagtgtcataattgcgaatcccccaagcttctgactgcttaaatcacagacagatcaaaatgtacgcacctccggccgatggcgcagggaagacgccgtgagcgtgacgccagctgggggcggcgccacgacggagaccgtgggggcggcaggggaagcgaagtagaggcggaggcgcccgccgtcgacgacgagctcggcggcgcagaccgggcaggcgaagcgcacgagccccgccggcacactcagcagagcgcagcagccaccgcacggcatgcgcgcgggcgcgggaacctgcacggggaccggcacgggagcgtgcaacaccgcggcgggaggaggcccccgtccggggatgggcagagcccgccgcgggcgcggcggcggcggaggcatgagctcgggcgggagcgcctggtgggtcccgcagtccgggcaggcgaactcggtgaggcccggctccacctccagcgtctccccgcaccccgcgcaccgcac

SEQ ID NO: 6840 - DNA, 1501 bp, Oryza sativa
atatagaaaggaataggtgtctgagcaaattatatagagttacagtccccctctcatctatataaggtaaaaaattcagtgcaattttcgtggggctctcatagttttcacgttcatgttagtagtagaggcttgagatcccgccagcctatgctggatccgcccctgggcgccacgctcagcgtcgtggccgtgaagctggccgtggccggcctcacgtcggcgacggcgaccctgaccactgaccagcgcggtagattctggggcaaactccatggaaactatatagtgggccaacctatatgggctgcagcccatgtacaatgggccacccgtacgtcgcaagcccgttccatctcgcacactatgggcctcacgtgcgtgggaaacatgatacggcccaaatgattaaagttctccgaaacgagaaggcgaaaagggaagggggaaaaaaatctgcagccttcccgtgttatcctcttcaacctctggccctctcactcctcgcgccgcgcggctgctccggccaccaaagtggcgctccgatggcggtgagagtcccttccatggagctgcaccgccccccgccgtccgtatccggtgtccgaggtatctattcatgattcatcactcccaatatgatggcgatatcgtcggattttggcatcgccgaaggttggctggatgggtggggggttcatgaaacttctataaactttatctcgctcagccgcgtgtgattttaggctgctgttgttgcggcgagcgtctcgctgtgcgaggtgacaaactgacaactttgggtttaatatcaggatattctaagtgctagattttggtttagtcaggggctttaatcagtcactagtgttgctggaacaatgctgtgaaggatggagaaggtttttttttctctctctctctcttactgctgaaaggcagaaacgatgctacgaatcaggaataatccgaggagtagataaagaaagttatgttttccgttactagagtctgaactctgaacaatgctatgagcaattggtagtgctaatggaatgggtataggagactgagtggttcagtgtgcataatcaataatatgatcaaactaataatgcagttaagtgacagaaagaacatctcgtaactcaaaatcaatgattcttcttataggtagcatttgcatatctgcatctgcaacgatattatggaagtatgttcagtaatacattatttctttctattactcaaacaaagtttgttttttgggaaacgacaaacaaagttatgtttgatgtcttctaatttttaaggaaaaagctgccttcaaaagcctttccttgtccaagcaaagagattagagggattggagaaggcaaacccaaggtataaaatccacctatataagtcgagtctttaccttctataagaaatgtggttcagtggctgataacctagaacatattagtgccactgcaccttcatgatcttcttcatacag

SEQ ID NO: 6841 - DNA, 1501 bp, Oryza sativa
ctatatccgcctctgtgtacgccgcctgcgcctcagcgtctggcagagaacagcgagagggaaaaaaaaagggttggcggtttccccattccaccgtccaaatccggcgcccgaagacttgtccggtccagctcgcagctccgctcgggtgcagcgtgcacgcgcaacaatacaataatcctccgcgaatctgccgtctacccgcggccgcctcagcccgccgccgtgccaagcaaggaagacgcggtgcagctacgtcgtcctcctgcggccgcccaccacatccatcgtccgtcccctgttgcccaaaaaaaacactttttttttccgcccacacctccctcccgtcacatcacgcgccgcgtcgtcgcccccctgcactgcgcaccgcaccgcgggccacgccacgccacgcggctcgcgccgcgaccgggacaccgtcggccccaccaccgcgcgcgcgctctcgcgctctcgcgctcgcgtttacgacgttacgtacgggggaggtggggataacaaaggcggcggccggtggcgttggccccaccacgcgaaattgcgacggttttgctgctttttttttttggtttgcttgtctgcatgtctcgttttgcgcgcgccgccgtcgtcgcggtggacggaattatgggaagcaatcagctgggtgcgcgacgcgacggcacagccgttgttggctcgctataccatcccttcaccgcgaaaatcggcgcgcgacaccaccattcgcttcgccgcctacctgacgcgaaaatacacggacctcaccccttgttgattccaccgatgggaaatggcaaaaagaagtaagaaaaaaaattggaaccaaacatacagattgagatcggatacggtcgtaagtgcgactgcaccttacgactgcatatatttttagccatttatttttcagatctcaaacattctaacgcatgcatgattatcaataatgcgaggacaaaatattataatttagaattaaatatgatattttctaatacaatgtatttggatagacagtctgtcattcttatattttaatacggaggtatagtacagcaccctgcgtcgtgccgttgtgcgtccaaaaggatcacaaggacaataggacggggcagcgcagcactcgaactaccaagcaagcaaggagcaagggaaagcaaccacacacacacgctaccaaatcagcaccgtcaaaggcaaggagaaaagaaaagagagagagagagggaagattaacgacgggacaaaccgcgggggcggcgcctctctctccgctccgctatggggtcaaacctcccctcccgctggccccgccgcacctccgcctccctataataccacctcctctccccactttcctccccccaaactccaacgcaccaccggcgccaaaccaaccacccaccatccaccggtcgaacacttggcgctctcgcccgccttagctcgctctgctcgtggtgctcgacccgaacaagaa

SEQ ID NO: 6842 - DNA, 1501 bp, Oryza sativa; identical to SEQ ID NO: 6625

SEQ ID NO: 6843 - DNA, 1501 bp, Oryza sativa
gaagggacacatggaaatcatgccaagcttttcgatttagttgaaatcatggtatagatacaaacgaaaagacagactatcccaccgtgtgcacctagcattattgccatgggtgggagctggacgaagcttcctggaagctcccgggcaccgaaacgaaaaacgatacccaaaggaaatgaaaatagaagtcaggaagcgtgccgaactgcagatagcaaaatatttaggttgtaaataaacatatttagcttgtaaaatttctatcttctttcctggttcgcacaggcatcggtttatcatccaagccgtgaggtaaaaaagccatcgaaatttggaaaccaattaatatgtacggatcatcttgtcaaaattctactcactctgtcctaaacaaacaaatctaacaaatctactactagatgtgacacattttagtacaacgaatgatgtgtcatatccagtaataaattggttttttatgagactgagggagtaagttgcatctatcaaataatttgcaaattaaatgtcttcgtgtgatcaaatcatgtgatatatgaaagtatttagcaaataggtataccacaatttacacaacattggtttagtttgagatagagttatgtagttatgcccataaaaatttgtagctatccaatcaacactgatttattttcacatttggtattttatcccacaaggacatgtccaaatccaagctcgccctcatatttatttaaaaaacatatgtatttaaaaacatgaactttaaagggacaaatttattgattttacaactagagcaaattcagtattccgtgttgataaaaataaatatgtaccacactcgaaagtcaaaactaacttagtacggaactaaataagatatattattgttatacttacatcgtcgaggacaatgaaggacttttattggatgatttgtcaatagtaaaaaacccaacaattatttctgcgatatagacaaatcgacatttcgtagacatacaataagtatttgacacgtatcacttcgagccataccattaatttatacacgtaatcaacaatactagacaatagaaaacttttagggagcaattttgtcaataacccttgaagacggataagtgcatggttttatgcatatccaaatatactgatagaataacattcctacgaaaacatatctgttcatgaatccatccttttttttatttaaaaaactattaacctattttcaaatttggtgtttttatcacgcaaagatgtgtccgtgtccatccatatccacgccgggcacagcaatgttttccattttccaggttttccacagctgtgcgcctgtgcctgtgtgcggcttgcttgcttcattttcagccgatttttttgccccctccctggtgtgggacccacttccagcggctcttccactccaccacaacacaatcatcaaaccccaaccgcaacgactcctcctccctctcctctcttcttc

SEQ ID NO: 6844 - DNA, 180 bp, Oryza sativa
atcatggtacaagatgggctaatagctttatgtcgctgcttcaggcgcaacttctttttttttcttcgataatggaatccaatccggcctctacatcaaagatgtatccggggcaatgtgtgaacggtttgcaccagtgattggatgatccagttcaaatcttctagtcggatcaaggca

SEQ ID NO: 6845 - DNA, 1501 bp, Oryza sativa
gctgatgagggtaccacactaccacagtccaaatcagggccgtggaatgcactctccattttggccgctctagccagaagaaaatcggaaatcggccgggacagacaaactccatcaccaagtgccgctcgtggcggccgtgggttccgcacttccgctgcatgcctgtatgtcacgggtagcatgattcggctcacatcttctgtcattatgatattatcattatagctactgacacgtaaaacaatagaatattgagatccgcatatcagtgactataacgataataatattatggtaaatagtcatcaacctagctagtgtgtctctgtagcatttgaaacataattcatcacattattaatacaaatcatctacttagttatatataaaagtaattattttgaaaaaaaaataaaagttaacttaatagcttaaattaagcttagcttaatcgtctaaacaatggcaaacaatgtcacagagggaagctctctgataccgtatttctataaatacggagattctgcagtaacaatgtaatgagtaagttgaaaaaaagaacatgacacaaaacatggctaattagtatcctttcgttctagaatacaataactgatgaatatagataaatgcatatttaaattcgtaaataaaagcaagtaaaatagcaggttgtaattaagctaatgtcacgcccagaaattcacgaaccagaatttctaagctgaatgtgtattaaacccctgtccagaaccagccagggtacacaaacgacaattgttgacatacagatccacgtcttacaaaaatataaaagattacaaagcagcggaaaagataaaagcgagctaaaccgggaagcttgacttgagcagcggggcgactccattccacaggcaatccttgacggcagcgacggaaccaacctctctgagacggctccaactgagaagaacttcaactctgttgtgggggaaaagagagcaagactgagtactacccactgtactcagcaagtcataccggaagaggaggtatgatgcaggatataaccaaaggaggctacgaggttcatttgcataaagcaggcatttaaaaccagtagttgaaaacagtaaaaacagttgtagtaattaagtaatattaaccagtcactgtccaacgctacatcacgttgtaacaggcccaaccaaccacctgaactacaccagctcattaagctaaactagggggtgagactaatcacggtgaatctggtcgaccgcccataaccgcgggcacggctattcgaatagttttactctgatcagaggtgtacaactgtacccacaagacacagccccacgacacgttcccgtgcgccgacatgctaccacgacataccggaaagaggccgtgacaggacccttcgcataaccccctctaaccgatcgcaccacaccttagggttcgcccccgcccccagcaggcaacgggcagcccccctttcgtgccgcag

SEQ ID NO: 6846 - DNA, 1501 bp, Oryza sativa
ctattgttactttgagaacttgaacaaagcaaaacactatttatgttttttaatatatgatgcggttaaattttatatacacatttaaccatttgtaatataaaaaataattatcatttattttattgtgagttgtcttatcactaagtttttaaaagtataatttatatcttttacatatttctatataatatttttaaataagtcgaatggtcaaatgtgtataaaaaaatcaataggaacatctattaaaaagcatagggagtaattagtttaagtaaaagcctaaggcaagaatgaataggatccaatcatacagaccaagtcgatctgttaactctcggccgtaggtcttaaaattttttaaaaagataaaatcctcaaaaacataggaaatttgtaggctaggttaaccacaaagctctgagtaccaagtatacatttttttttcaagacaatgttcagtgttctttgtctcgctttctaaggactaagaatattatggataatctttttggcggactggcatagagaattaggaatatttgagcacatattttccaatagcacaagtctttggaatatatgagcaaatatcatttatattctatttctttctgaaatgaattcttagggtttccacaatttccatgttttggatgtgcttttgtagctcttcaggaaaagaaatgcacatcattaaagatgatgagaggtctaaattaaaagatatctaacagactgatcgaatatcatcaaagaggaaatttctatataggaagaacatttttcaaaaagaaaatcttaatctttaggagttttaaaaatatgcatgccataatctagtagttagtagctaaaaaactgggccttagtttctatccatatattttaggttcaatcattagtacacaaattttaaatattgactttgcagaaaataaaaatgtcttatagctcagaacggagagagtaacgaaatactttatcattttttcttatttactctcttcgttctatattaattattatataaactttttagtcaagatcatgaaaaccttaacttccctatatttcacttaatatgactatgtgatggaaaaaatagaaacaagcatacttcaactttctcgcatgcataagaaacgagcatttgtaactgcatgcatgcatgtagactaaatttacatgcctagatacaataatgccacacttaaatgaaaggatgattatatatgataatcagtttagaaattctggttttgattatataataatcaatgtagaattgagggagtattactctattcgaaattggatgcgatcaaatggttagtggtacgtaggacgcgtggcctattttgttgctcagccatagctcccagcctcccacgtccgcacgactatatatagcgcggcagcacgatcgatcgccggagctcatccacaagctcgccgagccagccgttgcaccggccgcgccggagcgagcacacgg

SEQ ID NO: 6847 - DNA, 1501 bp, Oryza sativa
agaactatcttcaagactcattgggctaaacatggtctcatgctgctggaacaccagaaaagattcagatttagttgggagcagatgacttgtcaaaaaaaaatacagctgtttgaaaactacagcacattgtatcgtatcctgaagccatccacatcactacatagtccaaaagcatagtgcacatccaccccttccctcttcgacacatcatcagaaagcacaagcaaaggtaccacattatcttatcccaaaattcacatcaattctcaataagtgctagcatccatggaccatggttgccacatcaattcgagctaacattaccatctcacgtgtactgccaatccatactttcctctcttttattatgcaccaccactctaccaaactgaaaaactaaaatcgattcctttccaaataacaacaacaacaacaacaacaacaataataataaaagaggtgcatatttgaatgtttttgcaaacatggtaattagatgtagattgaccaccaaccaagcagtgggaaagcaggtaattctactacactgtgacgccgccatcgatcgatggccacggggggtcaccgccccgccggtgctgccgccggcgcagcaatatttcgccggagaagtcgcgatccccagccccgcaagcattcgccccccaaatcaaacaaagcactgaagcagaaacgcgaaaaatctacggggccgcgcgggatcggaacacccgcaccgctctacgagagcgaccaatgccactggggcggggcaccttacctccccctccgacggccacgacgccgcccctcctcctccgccgccgggcgccaccattgctcctctcgccgtcggcgatccacccgcgccgcgccgccgctgcacgtgcggcccgcgaatgagtgtgccttttgcctgccttctgccccagcgtgccgcttgcacctcctgtatttattcctccgcgccgcacgatatgacgtggcacgtttgtttacaggctttgtacgtgtcagggtaaacagtactctgttttttttcgcgggcacacagcaaacgcatatgcggatactgcgcaccactacaccactgcacacgtaacaccgaacttatattcgtggatattaaaaatttgtatcctgttgaatagggtcatgcatccatgactccggtactacactaagttgtaatctttatattttgatttgaggcatattgtatatggtgaacgtagttttttctcatgtctcttactagtgtattaactactttatattacatatctctttgatttttttatgattttttcaagtttaattaaatttataggaaattttaataatatctacaatatcaaattagtagttttaattattttgataatatgtatgttttgtgttgaaaatgttgttacattttttttttataaattcaatcaaactataaaaagtttagctataaaaaaaattaaagcatgacctataatataaaagagag

SEQ ID NO: 6848 - DNA, 1501 bp, Oryza sativa
tggggattttccagcttatatgaggcgcaaacatgcaacacgcatagcacttagacagcgcaaagtctacacacaattaacaagtctggcaccgcggacaattctgaaggattaagacaatttttttaggctgtgtttagattggcccaaagtttagaatttggttgaaattagagacgatgtgactgaaaagttgtgtgtgtatgaaatgtttgatgtgatggaaagttggaagtttgaaaaaaaaaactttgcaactaaacacacccttagataaattttaattctaaaaatataattactatgagatcggatgtgctgtattttaggacggaaaaccgaggcggctacactggaaggccgctgaaacctcggctggtttttgcggtcccctcgcgcggtccagccgctgctcggcgttgctccgacctacctgagctccgaacccagtccaagccgggttgtacgggaaccaccgacactttctctgtcaaaactagctggaactattacatggcgctcacaccaacacaatgacaggtagcgacccgtgatttgggtggtggtgatcgcaccaacccaagtgtactccaccgagaaccagctccgtaaatgggacaaaacccaaccccactcactaaggctcatgagtggaatcactccaaaggtggggttaattgcatttggtcttgtggatatgcacgtgatttgtccctactgtttactaccactctttctgatctatgtagataagaccagaaacaactttgtaacagaattatcctatctaggaatacatttatatcgctctcttttatattataggtcatgctttaattttttttatagctaaactttttatagtttgattgaatttataaaaaaaaaatgtaacaacattttcaacacaaaacatacatattatcaaaataattaaaactactaatttgatattgtagatattattaaaatttcctataaatttaattaaacttgaaaaaatcataaaaaaatcaaagagatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcagtatccgcatatgcgtttgctgtgtgcccgcgaaaaaaaacagagtactgtttaccctgacacgtacaaagcctgtaaacaaacgtgccacgtcatatcgtgcggcgcggaggaataaatacaggaggtgcaagcggcacgctggggcagaaggcaggcaaaaggcacactcattcgcgggccgcacgtgcagcggcggcgcggcgcgggtggatcgccgacggcgagaggagcaatggtggcgcccggcggcggaggaggaggggcgg

SEQ ID NO: 6849 - DNA, 278 bp, Oryza sativa
caagaaacaatcgatggatcaattcaatccaattcaacgccgcccccaatcaaagaaccgagaagaaccaccagctcggatctctctttctttttctcattaagagttggttcggttcaatggatatggagctcggaataatccggaggagttttctcccgctcctctccccgctaatggcgacgacgcatccctctctctcatatcgcgtagtagtatttgattgctttgttgcgtgctggcctggaccaactcacacactacactctctctctagt

SEQ ID NO: 6850 - DNA, 1409 bp, Oryza sativa
ataaatttgtaacgaaaatattttgaagtacaataaatctattggatctactagcatatatgtttgtatatagttgctcaagtattgtaggtgtatattatccgcatactcaatgtacactaagatcaaacaagggcaaatgggtcattttcttgccacctccatgttggtaatgtgacatgtccttctacatatgcaaaattggcatttgcaaagaattattctctccagtggcatctcaatagtctagttgtaaaaatcgaaccgaacccgtggtgtaagaaaaaccggaccagtgcttagcagggttcctaaaccaccgggtccgaggttaccacgcggtaatcgtggcaaaccatatgaaaccgtgtaaaatttatcaaaatttcaaattattttttaaatttatttgaatttaagaaggttgccatggttttccttttaccgtaccccgcggtaagcgcagtaaccacgcggttaccggcagttttgcaaaccctggtgcttagtctggagatggagatgtaattgacttgagaaaaatcatttaaatcggatggttttttgcagaaccaaaggaaaactaagctggtctggaatcgagaccccgatggacatggcttgtgggttctttcaaaaccctacctaacccttaaatatttttcatgctaaaaagtataaaaagtgtgcacatggcattttagacccaaccctcaaattttcgcccattattaccatgcatgtgcacctgactgtttgggcttagttgctacaatggttttagaaacaaaacaattatatagtattatattttatgtgttgattaaaccaaaattctctataaataaaatatactagtataaattgattattttattgaaccgatggttgaagtgaaccaaaatccgtaggtcgtatcgtagggagggcctgcgccgatccccatccgtcccgcgactcgaactcgagcgagcaaaggcggcgccggcgctcgttctgccgccaccgccgcggccggctgagccgatcccatccatcccgcgagcgagcgagcgcttccgccgcatcctggtcctggttagcacatcctccttcccatctctctctacccacgctctcactatatcgaatttgcgttaaccctagcttcttctgttctagaaattccttaatactagtagcagtttgttaatttgttcccaaaaagtttgggggttcaactgaacccccatgtcccatgttagatccgcccatgcgtggtgcttttgcgggagatcggattgctattgtctctctatgctttgtgctgtttctaagttggaatgtgctaacagcttgagttggtttctcttgttttgtttcttacgatattttgttaaatttgaattgaaggatcaggtagaaggaga

SEQ ID NO: 6851 - DNA, 1501 bp, Oryza sativa
gtgagaagaaaaaatgagcttattatatgaacggagtaactacttataattataaatcgaaacatgtatatgtacggatttgtatgcaagagccaacctaactaaaatcctaaatccccctcttgatagtcagagcattcacaaacaaaactcaaacccatcactaaaataaccttagttttatttttttttcaaaaaaaaaattcacacaactgatgtacctaacggttgacagagttaccgtaccccccacaaactggatctacacgcagcaaccgccatctcacctcggccccacccatactacccactcattgccacgtgggcgcccgcctctgggcccacccaagcgccctgtgcccccatgcgccagcgaggcttgctgcgtcgtcttcagccgtacttttatacctccaaaatcatttatagaaatcatttataggagtactccttccatgattccataaaaaaaaagacaatataatattagaggtgacattttctgatacaacaaatttggacaagctttcatctagaatcattgtaataggaaatatcacatccattactatagaatgccttttttcgagacggagggggtatattttaagatgaagaaaatatatgagaagcattgaaaaaatatgcaaaataagataaactattagtgcctaattaattaaatattaattattataaattttaaaaagaattaatttaactttttatattttttaaaatacatcagtcagcagtttgagatgcgtactagcgaaaaacgacgttctttttcttctcttcaactctcaaacgcagcccccaccaccgctgacgccatcacgtcgtcagtgataacggcgacggcggaagcgaacaaggcgacaccctttctgtgccccgttttgtcgtctttggaagcgacgccgccgtagagagagaaactagagagagagtgtagtgtgtgagttggtccaggccagcacgcaacaaagcaatcaaatactactacgcgatatgagagagagggatgcgtcgtcgccattagcggggagaggagcgggagagagctcgtcgggattattccgagctccatatccattgaaccgaaccagctctgagtgagagagagagagagagatcggagctgttgtttcttctcgtttctttgattggtggcggtgttgaattgaattgaattgatcgatcgattgtttcttggtgtggtggtggcggcgacggcgagcagcgcgccaaggtacatgacctcggcggcgccggcggccgcgcagttcgctgcgccggcgccggcggcgatggggatctacgaccgccggcaccatcccctcgccgccggcgtctggggagaccaccccttcatccgcccggacaccaccgccagcaccagcaacgccgccgccgccgccatggtcgtcgcgccgccgccgctaacagagcccaagttcgagagccaggtaattatttatttatttataataattaa

SEQ ID NO: 6852 - DNA, 1501 bp, Oryza sativa
ttagtgcaatatgcgatgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcg

SEQ ID NO: 6853 - DNA, 1501 bp, Oryza sativa
ctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaacaa

SEQ ID NO: 6854 - DNA, 1501 bp, Oryza sativa
aacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatata

SEQ ID NO: 6855 - DNA, 1501 bp, Oryza sativa
ggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaac

SEQ ID NO: 6856 - DNA, 1501 bp, Oryza sativa
tgtttggtcgcgcttgtccggtccacgccatctggcacattggcatgtgccaccctcaccctcacggcctcacccaccctatccgtggggcgtcgcgtcgcgcctccccttcgccctcgccctcgcggttctcgcgtacgcccgcgccacggccacgggagggaaaaccacccgtgagccggtgtgacgcagccgcgcgcgaggcgcgacgcgagtgtgcgtgaccccgacccggccgcgcgacgcgaggcgagggaaaagacaggagagaaaaggcgccgcgccgcgagagcccccgcgacccgcaaagcggaaaagcgcagcgcgcgcgcgcgcggcgagacatatcggcgtatcgcgttggcgtcgcggtgcagcgcagcggaggcgttggctttggcagtttggctaggctggcacccttcccgttcgtccaaattcctctcgccctccccgacaaaccaccctttttccaccaagcactccaagcatcccactccactctccgctccgccacctccttgcgctgctctcgctggtacggaggaggatgcggcgcaggctcctcgcgctgctgctggtggtggcggcgctcccgctgctcccggcggcgatcgcggcaggtgagctcttttgtactactttttaatggcggggctcctcctcttcttcccttcaccgtgtcacaggttcccttctctgggtcgccgccgccgccggaatcccgctgctggctcctctctctcatcgagcgatgatctccgcgactggagcggccttggctggtcgccgcggcggagctgttgcgacttgcgcaagtagcgccagcagccgcgcacgtcgctcgagaagcgatttttttttatatcttattttaattattattcaggcgtcgattccgcttctagtttcaaccattccccgcgatttttcgtcaccattctactccgattactgcattgtagaaccacatttttgtcatgcgagagttgattaattagagctttttttttttttggggggggggggaggggctgatttcaccggtggttattatccctcgccggagagcaatccctaaccacaaaatggcacgaacagcatgcatcgtcttcctgcttcctgcagcgttcgtcagccgatgccggtaaaggggactgtactactcgcaatgggggttgacgggttgtcacgccattgaattcccctcacctaatggggctcactcactcactgatgaacactgtacaatcagagtgtgggtggtggtggtggcttggctttgcatttcgttcgtgttccagggctcctccccacgctcgccgtaccatttggatttagctggccggtgaggaaggtcccgggtcctggcaatttggtagtgttattggatcacttattagatcggcttgatcgtgcagtcttacctgatgttcccttccgcatcacatgggttgttcttgacttcttgtgttgtgtgtgccgtgctaggctactggtg

SEQ ID NO: 6857 - DNA, 1501 bp, Oryza sativa
aaaatttatctccaaattcttacaaacgttttcgtcgactcgaaaacatcttgcaaaaagtggttgacaagtgacacacctataatcctattgatctgatcctctgacccctgttcataattttgctgtgtacagtactccctccgtccaaaaaaaaaatgatacctaaaaggggatgtgatattttctagtacaacgaatctggacaaagaattatctagattcattgtactaggggatgtcacatcattgtttaggttgagctttttttttttgggacggagggagtatgacttgcgctgagtttagtttcaaactttttcttcaaactttcaacttttccatcacatcaaaacttttctacacagacaaacttctaacttttccgtcatatcattccaatttcaatcaaactttcaattttgacgtgaactaaacacacccttaaaaactatctatttctcatcaccttttatttagtgatacagctaagagttgtagaaccgagtttagtttcctactttgatggctagctaaaaatttatgatcatttttacctatgctattcaaatgcaactatattttatgaaactgtcgagatgcagattagggttttaggtcagggttaaggtcggagggggataagggtgggggaagatagggttttccgagggctaagatggatggccaagagcgacgaaggaccaacagtggacagtagacacaggtgaatggcaaggcgctagaaccattaggttggcaactgacggtgggtcagtgtttgtggcaaggacaaatgacgacatgggttagaaggcaacggcggggagtcacaaaacacggttttagggtgtaagcacctcgccgttgtaggcttgagaagaaggaaagtaggggatgggagactgagggggtctcgctggcgccggagttaggggatcgagtgcctgctcgatcgagtcgtggcggcggcggagtcaacttgcatcaaaagtatgatattgtacgaatcataataaagcgatatctcgtgtaagaaaaaatcccataaataaattaacggagagagcggagcgaacgcagcaatgtgcaggtggtgccaacttgcaacccaaccgcgggacggcggctcatagagtcatactcatacccaagtggtagtagtaatagaataaacgaccgaccggcgtacgtcgtcagcgttccagcccaaacacattccaacaccgcaattctacattataaaggtggggctctacccccagctcaaaacacgcccccccccccggtgggccccatccagcccaccccatccaacctgtctccgccaaatactactcctccccccaaccttcttcttcctgtaatttttccttcttttcttctaattattattagtactaattcaacctccccctcgccgccgtcctcctcctcctcctccgcgtccgcacggcagccggaggcgggaggcgaggcgaggcgaggcgcgcggcggaga

SEQ ID NO: 6858 - DNA, 1501 bp, Oryza sativa
caagaaacgaccgaatctcgcatcaaagtaacccggtaaatacgtagtaggataagcccacaaaagaagaagaagaagaagaagaaaaaaaaaggaaagcgggcgagatatacctcggagaggagcacctcgacggctggcggcggcggcggcggaggaggtccggatgacgcgctgaagccgaagccgaagccgaaggaagcgttggagttggagaaggagaagagaggggaggaggaggcagcggcagcgacggtgttcttggtctctttgccctccattgtttgtgcgtagctgtgggcaccaccctccctgaccctgggctttcagctcgagcagcgacgagtaggctacacggagtacggccgccggcggcggcggacgggcggcgcaaaccacggcggaacggacagaggcggcggcggcgcggaggcgaaggggaaagctctatatttgcttttttgaaaacctgggccttttgaatagaatagaaattaatttacaaatgaaatatttagggttcaaatttcctttttaagatattcatgtattgttgatgatttatttatttattagagtgcgatacaatttatttttgtgttcactgttattattatattataaaatttgcgaggaacaacattattaaaaaaatgcataggagtctaaatccatattttacaaattgtaaacttgaaattttatgttctcaatgcaagaatttttatttacctttacttgataacattggcattaaatcgacaatctcataaaacgaagctttaaggacatcaatttagtagaaaaccaatccaaatataaattgaaatatttcaataaaaatacttaaatggaatctaattacagctcatgatttcaaacaaattcccacggtaaatttcaccttaattaaaccttataacaatagaataagattaaaatagctcacccgtcgtaacgcacaggcatttttctagtccaaatataaattgaaatatttcaataaaaatacttaaatggaaactatttcttgttttcaaacaaaatatttaaatgaaaaaacttttgcaataaaaacataaattgaaatatttccggtaaaaaaaacttcaaattgaaacttaattaaataaccctgaaataatcccccaacctaaagtcatgaacatcaggctatttttgttgtgtcctagtagtagtgaatttaaatggaaaattttgcaataaaaatataaattaaaatatttccggtaaaaaaacctcaacttaaaacttaattaaataaccctaaaataatcccccaaacctaaagtcatgaacatcaaggtaattgttgtgtcctagtaggagtggattgagggacttgatatttatgccacggatgctataaaacctctctccctccctcgtctccctctccaaaaccctagctttctccttcccctgctttgcggcgcgccagccaatcaccccaaacccctcccagtcccagcgatggatc

SEQ ID NO: 6859 - DNA, 1501 bp, Oryza sativa
gagcgcgagcgccgcttaccgaagtgggagtaggagtcgaagtagtagtcggcgctggtcttgtcgctgccgatcacctcctcccctcctcctccctctcccccttcctcctccgccccgacggtggcggcggcggcggcggggttctcctccatgacctcgtcggggtcctcgaacctcagcctcgacgccgtcgcctccgccaggccgccgttggcgtcgctgccgctgcccttgcgctgatccatcgctgggactgggaggggtttggggtgattggctggcgcgccgcaaagcaggggaaggagaaagctagggttttggagagggagacgagggagggagagaggttttatagcatccgtggcataaatatcaagtccctcaatccactcctactaggacacaacaattaccttgatgttcatgactttaggtttgggggattattttagggttatttaattaagttttaagttgaggtttttttaccggaaatattttaatttatatttttattgcaaaattttccatttaaattcactactactaggacacaacaaaaatagcctgatgttcatgactttaggttgggggattatttcagggttatttaattaagtttcaatttgaagttttttttaccggaaatatttcaatttatgtttttattgcaaaagttttttcatttaaatattttgtttgaaaacaagaaatagtttccatttaagtatttttattgaaatatttcaatttatatttggactagaaaaatgcctgtgcgttacgacgggtgagctattttaatcttattctattgttataaggtttaattaaggtgaaatttaccgtgggaatttgtttgaaatcatgagctgtaattagattccatttaagtatttttattgaaatatttcaatttatatttggattggttttctactaaattgatgtccttaaagcttcgttttatgagattgtcgatttaatgccaatgttatcaagtaaaggtaaataaaaattcttgcattgagaacataaaatttcaagtttacaatttgtaaaatatggatttagactcctatgcatttttttaataatgttgttcctcgcaaattttataatataataataacagtgaacacaaaaataaattgtatcgcactctaataaataaataaatcatcaacaatacatgaatatcttaaaaaggaaatttgaaccctaaatatttcatttgtaaattaatttctattctattcaaaaggcccaggttttcaaaaaagcaaatatagagctttccccttcgcctccgcgccgccgccgcctctgtccgttccgccgtggtttgcgccgcccgtccgccgccgccggcggccgtactccgtgtagcctactcgtcgctgctcgagctgaaagcccagggtcagggagggtggtgcccacagctacgcacaaacaatggagggcaaagagaccaagaacaccgtcgctgccgctg

SEQ ID NO: 6860 - DNA, 316 bp, Oryza sativa
attcctgcagccccgcgcatatcaccgtaacttgcttgaagaacttgttcatcagcaggcagtggcatgatattaatcacaacctacacaacaaacattagtatacggtggttaattacatgacagagtgatcaaacaccaaccaattaaaccgacctttacaatgtttataataaggtattccctttcggcaaccactccaaaagctctcctcacctgctgaatgctaatctctgttactgaaaccactcaaacacttgattagatcgaaaaccttaatcagagcctcccactgcagctgcagcgaggacagcca

SEQ ID NO: 6861 - DNA, 1501 bp, Oryza sativa
aatgtttggagtagatccaaatatatacgtgaatatatattcttttgtcttttagattacacgaaagacacatacgcacacaccacacccactagccttgatcccggccgtacccacgagtaaatccttaacacacactttaattatctgataattaagctcgagtagcaacaccgtaacaaggcctttatttccaatagtacatggttactcccctgtactaaaatataaatatttctacaactcataatttgtaccacaaagtatttttggcatttattttattaatgcatagaaattcatatatttttggacaatcaggtacttgggaatagaatctaagcaattcaaaattcgaccattgaggcgactgaaagagaggttttttttcttaatctttgtattttgctaaacaacaataaaaaagaaatacttatattttaggataaagagtagctataatccatcatttgctctacgactaacaagccatggaaaaaaatgtcgcaattaacaaaaaaaatatttagacaaaaaacttttatacatgtgttgttagcgaattaaaagttaatattgaaaaataaactataataaaaaaactctcaaaatcaactccaataataatttcctaaatttaaattttaactacgactaataagccaataagaaagctgtaggtaaaattaagatagcatctccatccatccatccatccatccatatcgatctgtcttgtcccatctcgtcgatgtctcacatctgctcatctcatcatctttcatctcatctcatctcatctcatgtgcaagtgcagccaataatgggagccaataagcactaggagttggtttcagataaaagacgaggcccctttcgtccagtatttaataatctcagcaccagcattgccggggccctcgacggcgaccggccgtcgatgtcccggccgtcggcggccgatcgggcggccacggcggcaacacgccgcccgccgggcacgtgacatgccacgtgaagagagggccggccggccggcggtcagtttccggccggtgtcgccgtcgccgtcgtcgtcgtttatcttgcgagataagatgagtacgtcgttgatcgatcgagtagtggtgatcaatgttgaagctaaagctttggaaaaaaagagttaattaaattaattaattaattaattaattaattaattaattaattaattatgtgcgtgattagacttctgtgagtgctgaccagctaataatgcatgattcctgctgatctctcttttattggcatatgtatgttaggacagaagtggtaattaattagatggcttaatcacacatactcccaaaaggtctccaaacgaggctgcaccagagagagagcagagacgatcctccttgcagatggatcccataaccatcgagatcggcgaaagcaaaaatcgaaaaccctagcattccgctccttccaaagctgctaggacattagaaggaccaac

SEQ ID NO: 6862 - DNA, 1501 bp, Oryza sativa
aaattttgaattttaaattgttgttatatttttagggcagatgaattatatatctttagagaaaaagaggaaaatatgtactacctccgtcctaaaatataagtattagagttagacacggttactaagaaagtatgtaaaaagaaattgtggaagattatcattggttgagaagtggagattggtgaggaaattgaatggtggagggttgtgattggttgagaatagaatgttggtggagaaattgttatattttgaaacaaattctaaaggctaaagttgttatattttaggacggagggagtactatatcatagtcattaatgattaggacatattattaagagagaatccactcagtgccattgagttttcactacttctacaatataccactgactttgtcaagttgaataatatgccatcgtgttttcccgaacgtctactgcgtgccatcacagtccagaagctgttagttgggcatctgttagagctgtaaaaagacctatttgcccctaactcattgtacatgtttttttttttgccgagggacatatgtattatatgaatacatatagagaaactgattgaatcatataacagcctatgattgctagcttcacgcgttggtagagacgtagtgaactagtgatctgttgactttgaaatgggacatatcggaaaaaaataaatgtacataatgaaaaaaaaaatcaaccccatacagttagatataaaacaagtttgaacatggtgcatggcactgagctcatatagatatagaaatgaataccaaaatattttactaaaacaggtgctagggtttattagtcatgggcattttagtcattaagaaaaaattcaatacaccaaacggatgcaccctaacggcttgtggacggcgatggcacgcagtagacgtttgggaaaactcgatggcatattattcaatttgacaaagtcagtggtatattgtagaagtggtagaaactcagtggcactgagtggattctctctattattaattaccatcatgtaaaatataaaaatggattgtgacatacgcacattccattctgacctgactgagctatagctactaattaacagctccagctcatgcaatgcaatgcaatgcaaccctgaaacaacaagcaatatatattgaaaaccatttagaccggtttatatattcagcaacagaatcgtactagtagcatataattagctcacatccaaatccttaatccgtaagcacactcccaaattaaacccggcaagttgcatattatccatgaaaaacccatcagttgctattgctatatactagcctctagctctagttgaccggcgagagtagtattaataccgctaccacgcgtagccgccgagctcgccattagcttgctattctctcttcttcttcttcttcttcttcttcttcttcttcttcttcttggtgtgattgaggtggaggaggagatgagtttcataggcatgg

SEQ ID NO: 6863 - DNA, 575 bp, Oryza sativa
tgcatccactaacacacgttcaaagagacaagacactagcgacatattcctgatctcactataatcctatttaaagcttacatattgtagatatttcttaacggtattactagaaatataatttccagcaatggcactgaaatattcttggtatatttatgggccacaaatttaatctggtaaccgtccaattatcccatggtagtaatctaaggtatggttttaattaaatcctaatggaaaatataataaaataatactatgctaacaattcatatattacttgtattcatcaaagtctatgcatgggttaattaatttttaggtaggataaggttgacacatagaagaaagatttaaggactactccgctaaaataaaatctaggctaagtggagaatgaatatgaaaataatcattcctatacttctagtatataaatatctatagtttacacttgctagtatacaatcatatagccaataccctctaactatgccctcctgatgtttcgagagaccacacctgattgccgagttccttacgacaatccgtcatggccatctgaccagaaa

SEQ ID NO: 6864 - DNA, 1501 bp, Oryza sativa
ctacatttatcgtttctgcgccaagggataccagtattaagttggcatcgttcctcaaaatgggctacaacctttatgagctcagagccttaaaggcaggtgtaaagagggacatgtctaatctttgaccacaaaaaaatgaattaacccaggaaccagtgccatcgtggataaatgaatcccattgacataactctccagcaacaggtagaaataactctaggaaatgagcagggtacttctccctccctctccacaaatataactgttccaagcatttaaaatttgtccacaaatataagaattctagaatactacttattcatcaattatatctcatctgaatttcttcccatcctatccccaacaacaaccatctctccttcaataatggacaccaaagtcttttctcctcaatcttaaatctactaaataacttagaattacttatatatgtggacagcgggagtactctacaaacataatcaatgcattatggaacacaaacttgtaggattgaacacaagtaaccaagcctaccagagagggatgaatggtagggaaaaccaaaaacccaaaaacttttagcggaaataaaagttaccctcaaatcgatggaaatctcgacgtagtcctgtcgccgccggccggaccactcacacgccgccggttagatcatctccctgccgcctgaacccgaagaaacacaaatcgaagaactctcaaagtagatgacaactttattgcttctctctgtgttacaagtgcaccaacagcactctttacaaaaatttcgactaaactcgaaaccctaactaaactagcaactcaattgctctcgaaaacgataccgggaggctacctctccctctctgtttataccgaaaacctcctactcaaagtagcagaacaactcctaatcacactaggactctatcctcaattaccaaccaaattacaatttaccaaattgtaattctctcaaactacagccgcacgcatctcttataccagcttggtctcggtctccatcgcacgggacgacaccaactcggcctctctaccttgccctccagggcgacacggtctgtatccaaccgagccgctgcatcgctacctgtttgcacagaacgcacacacatgcatgctacagtaccgcccgtactgtagcaccatatgccagccaatcacagacacgatcaatcacacatatatgcatgctacagtacctcgccgtagtgtagcatcatatactcttcctcagttgtactctaatccccttcgcgaacaccgacgcttgcatgcatacctcgtgaagcccgttgcgaatatctctcctacacggtatccatccaccgtgtaccatctcgtatccaacttcgtcacccgatatacttaatagtctggacctcaactcctccttgagtttagtcccgatccccaccgttgactgaagttgacctccaagaatcctgactctagtcaccttctcacatggtat

SEQ ID NO: 6865 - DNA, 1501 bp, Oryza sativa
agtaatgaccgatggctttactcccacgcaagcacacacactccttacaagtggaattgtgtgtgtcctgagcagggtaggttgtcctagggcaaaggtttgaatggaaacaatatcttacagccaattcaattcattgtgtgagaatccaaccaaaaccagcttgtaacttgcaagtcttgtcctcttaaggggtggtcagcacacattcaatgagacaggcctcctgacaaaaccccttgattgtgttgaatctgagatcaaagaaatggctggttgctagtagtaggagtactctactccatggctgtgcatgataattagagcacacagcccatacacctcaaatgtcacatctctcacaagaggcctctaccctgaacaagttattgcctactccctctgtccaaaaataaggcaaactatgggttttcgtgtccaactttgactgtccgtcttatataaatttttttataatttgtatttttattgttgttagatgataaaaaatgattaatattttatgcgtgacttgtctttttaatttttttcataattttttcaaataagacggacagtcaaacgttagacacggaaaccaaggtttgtctttttttgggatggagggagtacaccagctatttcaagtggaccacaaatataaactgctgccaatctatcaatccaccccttttagctagtaaatctatactaaaattccatgtctttctccacaggttaaattgcaatgcaacaagaacaagcctcctcattcattcagttccaaatgaacagtgggatagacttgggttccttacccaggacttccaaagccaaatcgaaatttggtgccctgcagcaacacaccaggaagctaaaggaacctggacctctacaagttaaaatggggagttaaggacagtggtcatacatgcatatgcataggcccccaaccacccatgcacatggaaagcaatggtagggtctacccccctggatggctgtgattaggccacaatggccaggcaccaacttttaagtaccaccacctgatcattcctcatcacctacactcagactatatattctaacctcaccacctttgaaccccccttcactttgattcttcctgtctacctaggttaaaaaaactccccatctctctctctctctctctctctctagagatctagcagtaatacatgcatacaccaaaagaacctcatgtactagtagcaaatatcaatacataaagctctacacttctactactagtatagttggaaggctataaatgcctagccatgatatgtgcatggttctctacacaacacaccatcatcatcttcatctcctacctcctctcctctcctctcctcttctccactacccaacttttgctcccaacacatctttgtttcgatcgaccgatcgatcagctctagctcagccgcagcaatggccatgcaccctctcgcccaggggcacccccaggcgtggc

SEQ ID NO: 6866 - DNA, 1501 bp, Oryza sativa
atatgggcgcattagagaaacgccttgatgagattttttgttaccacttagccgcaccaaccccattaccagcctccttaatcaaacaatgtcctagagaggtcaactcttccgcggtcttcaattacgtgaggctaataactcacttcattgaagtgtaggctacgtcacctaaggtaagcatcatcttcctttaatattctagcaagccgggaacctttgtgcaaattaacttgtacacatagggtcatttgatttatgttcttcttaaggccctacacataaaaaccatcctaggtcctctggtttgatccttgcataaagttccactgcacactacaccctccgtcacaaaaataagttcattggtgggtttttgtgttcaacgtttgaccgtccatcttatttgaaaattttatgaaaaaattaataaaaacaagtcatgcataaagcactattcatattttcacatctaataacaatcaaaatactaatcataaaaaaatttaaataagacggacggtcaaatgttacacataaagaaacccacaaatgaatttattttgggacgaatgattgtattttctggtccacagctgcacaggcttctgatttcttctggcctttgtagccttgatgcttaagctcagatcctgactgtttctgcagctggcatcaacatataattgggtaatgatgcccttgtttatgtctctccaatgcgtgtgtcggctgtgggctctgcagtggtcacccatgactgcacctgccagagatgcccccctccgctgttgccaacaatatctgtgacgtccactcgttctcagccgtcagatttcgatcagaccatcactttcttctcagccattacatgcacacactttcttctcacaaattacacacattacatgcacacacttttttctcacaaaattagaaaattacacacattacgtgcacacactttcttctcagccattaattaagtattaacaccaactgtcttgcaaattaattttctcaagaaaagggttgatcatcataggggcaaaatcaggtttaacaatcccggttttggttataaggggtatcctcggttttcacgccgttgttaaactgataaaatctgaataaatcttataaaaatattataatttagtttgatttcttttgaacttgaaataaaaacgaacgattcgtgttttcgaccctgtccaaaaagtctagattttgataaggttcacaatcccggttttggatataaggggtatcctcggttgtcacgccgttgttaaaccgataaaatccaaataaatcttataaaatattataatttagtttgatttctttcgaactttaaataaaaacgaacgattcgtgttttcgaccctgtccaaaaagtccagatttcatgaattccacggagatcgtaaaccctgcacaatattcactctactgtttttttttatcaaaagatagtgggggagtcccccatggttaa

SEQ ID NO: 6867 - DNA, 1501 bp, Oryza sativa
tgttctctcagatgtagtcatataggtagaatatgcatacgtgctatgttcaaaaaatattcctagttggtactaacttggtatacgtgtcctgtttatcatgggtggacataaatcatcaatgagccaccacattgtagatggtctatagtggacataaagttacatacacagtagtatgttgtgagttgtgacttgtgaccaattatatcacaatcatcgaaattgccccatagttacaatgttactaaagccagctatatatagtgcagaggccgaagatgggttaaaaaaagggagaaagttcacgccagcatggccattgggcattgctattgactgtcattgtgatgagacaatttttttttgacggaatgagacaattttttagggagtacctatgcatctttcaaaatatttttatgaacatatcacacagatttgtaatctttatattaaaatccaatagacacagtaaaaagtaaaaagcaactaaaaacacaataatcgacactaaattaccatatcatcaagaaaaagaccaaatcgaatataaatttcaaaatttttatgcaaagattcaaaaattatactgtaacttacaaaaaaataaactgtaaatttgagtgagaaaatcaagtgagcgataagaaaaaaatctttcgagtgagatatagcaaaatcattttttttatagatgatcccagaaagaacattattagactattaggccggtgcaagcaaagtgtagttccataattcaacggcccatatgttcctgcttgtgcgcggttgacaaagcggcccatgcatcgatggtccttgggaatttttttcggttttagatttattttttttaatatttacagaaataatctatcgaccaaaaaaattgtagaaatagcccctgccgcccacctctggggcggcaagctgacgtggcaaacgggggaggaacgggcggtgacggagggaggatttttttgcaagaaaacccttgccgccctctggtggggcggcaaggggcccgaatgcaaaaaagccagtcggggccggttattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctaaaagtgcgtattgtagatatcggtacctacgtagatctgctagtttggaattaatacattaccgttgcattggcttacacaagaagatattacgttgtagatgtttattgcatgaaagagtaatatgatctagttatttcgttgacagata

SEQ ID NO: 6868 - DNA, 1501 bp, Oryza sativa
ttggtgattttgcaatccaaggtgacatacatctcctttgttggctcctcgtgacatcaaaagattttccacaatgcaacggacgacacttgataaaatagttagtatgtttgtgtggtatttaattgctctctccattatttgtcattttaaatgattttttttctaaatataattaaatattttattaaccaataaaaacatccgaccactgcactaactaggagtgcgcagccaaaaaaaaactaatgtgtcaaagcaactaatttattattttcaaaaaaggtataaacgttgatgctcatatacgcgtatgtacactcatcactaaaagcatatacacccctataaatactttcaaaaacagtcccacatatatcttgcaattgagaaagtcactacagacgtctcgttatcggcgagcagttgtataccactgaaagctagaataattactcgcaaatatcaacacctttgcccggtctaaaacttgaattcagatggatgaattccaccacaatgaacttaatcagctgagctatgttaaactcactaattgaattataatttagtatgaaaaatcacaatgcgctgtatatatacttttatcgacaaatctcaaaatctcaaaatatcactttcatgtagtcaattagggcagctttaaatatggcgactaaagtttgacgacatgagttggtgtacaacaaatagtttctcttctttaaaataccataaatgtgataataaattatagtactgtttaaggaaacacaagttattttattttcccgtctacaaatataagcattctagatttctttttaagattgaagagaaaagaaaaggatttaatgttcctcacttactaaatgagagaaggtctgaagtgattggaagatagttagaagtaagatgaaagaaaattaaactatggttgattgatcggacaatatatcagtacctagaatttcttatatatgaaaaaacaaaatttaaaatctaggaatcattatattcaacaacgggggagtaattaacagtaaacgtagctgttatgcttgttttacatcacgaaaataatctggtagatacatcgatgttgacttgtttggtatcgagttcagcgaactgatgaaccatatggtttcatgacaagagcctgagctaagctatgccaggcgagcagccgttgcgggtcccgcttggtggttggacggtttctccatctctttcccttgtctcttgcgcaaggttgtcagtatcccgattcgtatactagtatcttacgatactacgatcctatcaagccgaaaggataccgatcccacctagtatcttaattttcatagtatctcgatcctactattcattactacacgatcctacgaaatcttaggtggtatcccgattctacgatccctacgatactacaaaatattattttaaataatatggtttcaaaataatgtaactaaatatgctcaaatttatataaaaa

SEQ ID NO: 6869 - DNA, 948 bp, Oryza sativa
atgaaagattagcatcgagatgtagataatgatgctgcaatctagtaaaaatggcacacgaccaaccaatcaattagtagcaaaaaagaaaaaggatatatggagaggtgtagagtagagccagctcaaagaatgcatatatatccttgcaaaatggacgtctctatcttgtgctactgggataatcagctcgtgccaaatgtgtgtgcagcaagaacagtgcagcaatggtggattctggatttgggtctatcctgagaatctgaacaaggatgtaatccatttgcttgtacggctcgatccggcccttcttctccgagctgtgtaaagcttctcgcgtttctgttgataaatagtttcagatttcgctaaaaaatatagtttcagataacaatgctgattgtcacatattcacagaggaggaggatgcaatcatgtaaacattccctccgtaccgaaatgtatgacgccgttgactttttttatagtatctgaccattcgtcttatttaaaaattaagtattaatatgtaaaagtataagttgagattatattttctttgatgatgaaacaaatcacaacaaagtaaataatatttatattttttaataagacaaatggtgaaacgttatgcaagaaagttagcggttttatatattttgggacggacagggtactttgcttcagttatactacttcaagtgataaatatttgacgtttagtatgagaatggatcattttcatttaaaacaaactttgaccacaaattacttctgaaatgcttagttaatttattttaaaaaatcggtatgtatagatttaccttggagagaagtatcaaaatatcataaacttattttaatataaagttgatgatcaaattgaaaattaaccaaatcttatctaaagatcaaatatatttttaccaaatggagtatttgtaaaaa

SEQ ID NO: 6870 - DNA, 1421 bp, Oryza sativa
tttttccacacaaggatctcacatgtattaatgcatatcggatgcaatcatacatcatagaggtgatatttagcgaagttgtggacagtgtctactactgttttggcccgtttggatgtggatgaattgcttctatcaaattaatggtgtactccactacaaatatgggctatatgggagttggacaactgtacctaggatgagcttttatggaccctttcaattcgagcatgtctgtccagcactccagctggttaattaattggaatttggcaaaattcatttgaaaacatacttcgaatttcatataggaactgatagtttatttgtccaaaacagagatcaagcctcaaagagatgttataaagctcctttagaaagagaattaaacatagctagtaattctttaacataaaaggtgaacttttaggatttggttgtgaaaataaattacctagcaccagaatatgatctctaggtctaccaaatccttcccacccaaatatcttcttcaaaagctttcaaaatctggcccggaaacttccaaaaagaaagatacgggcaaatttaaaagtgagagttccactagaaaccattgctaaaagaaaaatcaattattccacataaaatccctatttaatttctaagttgacttttacaatttcaatcctatatgcaagttttgcatgtctggtcctgtccattcgcgagtccttatgctgaccttgatgacgtacattgtgtcagcatgtgttttcaatttggaattatctctttttacgccccctttgaattagaggatattattgtaggaattttagaggattattatatttaattttctaattattctttgcaatataatcttttttattcgtatgaaaagataaatttccattgaattgtattcatatgaaaaaaaacacgaatattagagaagaacctaatatcaaataattagaaggggtgaggcttggacgtttctcatccatatgactcaattttatggaaaataagtctaaccatttgaaaaactattcggtcctctcatttcctatattttccatgttgtaggattagacaaacatacaactttaattactgtggttttcttattctcatgtcctttcactttggaacatatttttgtcataaaaagtcaaacttcaaaatttcagctcattttaccgtcacatttcaccgttggtaactgtaaaactaaaacggtaaaaattgaagtctcaccttttcacaggctcactcactctataaaaaccgctcccgacctgccgctcggtacgcatccactcctctcctctcttccgttccttctccctcgccgtcggccaccgcatcgccgtcgtccgccgccgacagggacagcgttccagccatggacaagggcgccctgatgccgtcgc

SEQ ID NO: 6871 - DNA, 457 bp, Oryza sativa
ttttaaattcaccactcaaatttaccttgggtttttaagcaaaaaaaaaaactttactgccactaccgtgatacttcctgcatcccaaaatatacatatttctagcacagtacattatttcaaaatgaaactatttcttcacatacgttctcctctcaaccaatcatcactattctcctttacctacttttacttatcaaccaatcacacatttcctccgattattctcacctattttttattaataaccgtaccaacctaaaaaaaatgtctacattttgggataagggaaacaatttggcaaaaagatctatgagcactcatctgtaaaaataaataattcattagggtgtaatttgtaaattgtcttgagtctttacgaacaaatccctatcctgcataccgccatcgtctctttctcgtcgtcgccggcgacgcctcccgccgccgccgagga

SEQ ID NO: 6872 - DNA, 1352 bp, Oryza sativa
  unsure (1)..(1352): unsure at all n locations
gttgaaggttggctggacttcaaattcgtcaaactatatgggggtttgtcattcgggttgagctcagacttcttgtgcaaccttggtcgacaggcttgttgttatagctccttacatttaatgatgaactccgtgaaaatcctgtgctgagtccggcgaatcaaattgtacggctcagcaaaaatcctctgtattgtgccgtttccgtggtggcagccgaagaatattaccatcctgtcaagcggagtgcacgcccaatgagacccaaggaagcagtcgtcgcggtaatgccggaactccctatcaacttgcttctttctatactgctcggatatatcaaaaaagatgctcctttagttcagttaatcctccttttaaaaggatagctctttgctttcagcttctgtcttctggcaatgtactgggtttattaatttattccatataatctctgttcttgcttaatgaagtgattgtgtgatctcaagaacacaaaaaatcctcccaaaaaatggttccaatgacgagtgggcccagaagacttggtagtcgtagataacgaaacccttggtccgtgagcgtgacacgcagcagttgaaggctgagaccggagacggagacggagagagacgacccgagcagagcagagcagagcttcccctcgactcgatcctcttcctccctagggtttccgctcctcctcgatcccgtctcgccgccgaagtgcccctccccttcctccccccacccccacccccacccccgccgtnaatgcgtggcggcggtttcggtacgtcctcgcgatcttcaatcgcccgccgatgcatttatcgcctctctcgcctcgtcttcttttttttatgggacagtcagtcgaaacattcttgcttgcgtggactcgcgcattggaggagatttgggcattggaacctcaagcgttaggttcttgatccgaggcctctcctgtgctgtgcaaatcccgtagaatttcactctttttaacatcatgttcaggtttggatcctgcaagttgcaggctgacggggggtgctattattgccatgtctacgtcatccttatctgataaatccgtaactctaatcctgttgttgtaatgattaatccgtagaccggatcccattttccgcgtttataatagctctggttgtgttttgcttggtgcggatgccacatccatcgcttagtaattcaaatgtttaatagcttgatgttctcagttcatttataatgcgtcccatgattttaagcctgcatttttcataagcagttcattaaaaatatgatttttatcgtgcatcctcttttgcagttaacgaaatgaggcatactgg

SEQ ID NO: 6873 - DNA, 549 bp, Oryza sativa
acatcccccaaattcccccatctccccgtctcggaattcgggttgtgctccactaaatccctcgctaatggcgtgctaatcccaccaccacccttgcattgcacgcggccgtataaaatcccgtgccaccgtatcattcactcctcccgtccctatcgcgtcggatcgccacccacctcgccgccgctgcttgcttcactcgcctcagatccgcgccgccgccccccgcgaatcccctctcctccccgaaccctagccccgctctcgggggttccccctcctcctccgccgcccgccgcgtccgccacttccatcggaggtattgctgctgctgctgcttctgcttctgctgctgcgttgggggggggggtgttccgatctgtgggctgtagggggatctggattccgcccgtgctgggggtgtgattttgtgtgggcatttgtttgtgatgacgggatgatgatattgttgggtgcgagcaggtgatcgatcgagcgggggtggggggagaggttgggcggcttggattggagagggctcggagtgga

SEQ ID NO: 6874 - DNA, 279 bp, Oryza sativa
ccgtgggagaagttctggatcagcgtcgcggtggtgctcggcgtcggtgggctagtgttcggcctcatcttcctcatcaagagaagcatccccccgccgaggaccatcagtgtggtcaagcttcaggttaatttctctgaatctgatcttagagtgtccatgagcaattcagagtttcagactgggtttcttgatatgatcagtgatcgatcactgattcaaaattgtatatatactgattggatgatctatcttcgtctctgttactcgcaatttaga

SEQ ID NO: 6875 - DNA, 1501 bp, Oryza sativa
ttattattagaatttatattaaatgttcattaatttacaagtgaagttaaacgtgggaaataaaatttcctaaatataaagcatggatggatttaatttttattaaattctccatggttaattatactctctggaatattctcggatttttcggagctcaattcctaatttttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattcctttccttcctctctcttccgccggcccaacccgagcctgcatcctctcttcttctctcagccaaagtccggttttgctccctcttctaatcaggctgagaaaagaaaagcccggcaagaagtctactttctctccctgcgctactgttcatcttccaactcaggcagagcccgagccagccgtgccgtgcacagtgccgccgcctcctccttccaaatctcgcctccccgttgctccttttttccaatttagttgaggggaaatattcctcttatcctcctctatctttaccccaaaaatcggagctaatcgttgagtatcttatccgaatcgaactcgttttcgagtttatctccaaaaccgagtgtttgatttcccggatcgatttcttgcgggaggagtccgatctcttcaatccaaggctataaataggaccccctagtcctcctctttcgtttgcccctctcccgtggtctcccgtgccccgtagcctctccgccgccgccgccaagttcgccgtcaccgccgtaaggtgcgccgaggtgtgggcaagctcggccgctccctccccgctgtcgccggtcaccggagccccgtcgccggccgtcgtcgttcgtcgtttggttcgagggtgagtaccgttaggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtatattatagatctgacgatctagttgtctcatatatgccccctagagggcctcctgccccaccttatataggatggggggcaggattacaagatagaaaccttaaccaatacggtatctgtttcctaaatcaggactttaggccgttccgtaatatacaaggaaacgt

SEQ ID NO: 6876 - DNA, 1501 bp, Oryza sativa
gggccttgtcgagcatctcgcggtacacctgcagcgcggagtcgacgcgggcggcctcgcagtgggcgaggatgagggtgttgtccgagacgacgttggggacgatgttggatcggctgaagaagaagtcgaagagggagacggcgtcgtcgtggcgccccgcgcggaccatggacgccgccacggcgttgcaggtgaagacggtggggcggacgcgggaggtgaccgcggcgcgtgcagcgacggaggcgccgtcgaggtcgccggatcggatgagggactggacgcggttatggaggctgaggcgcgggccgacgagcgcggaggtggtgtccgggaggcgcggtgcgttggggtcgcgcggcgggggcggggcggaagggtcgcggcggagcgcgtggagcggcggctcgatgcggagcctccgcttgcgcctccgccgctcggccgcggcctcctcggcggaggagaaggcgaagccacgggcgtggggtgcgagcggcgcgtggggagggaggaggtggtgcgtggcggaagcggcggcggcgggggaggcggtggaggaggaggaggaggagagggaggggtgcgggtggagggtggagaggcggcggaggaggaggagacgacggtagagcgccatggcgtcgcggtggggggcggcgacggcgggagacgaagtttgtggcggtggtgagggaggcggcggcgatcttcaacaagaggaagaaaaagaaaaaaccctcttattctgtagctagggtttagtgggtgttactgtatgaatgtatgatccattttccatctcccggtgtgagcctcctctatatcggccagcaacgattcgttgggccgtcaagttgggccagtgctacagtttcctactccctctgtacaaaacaaaaacaaaaaaaggaaaacgtacacccaaggtccctcaacttgtcattgtgttacaaaatcatcccccaaccgcaaaaccagataccggacgtcctcaactaacaaaaccagatccttcggtggtttttgaccccggttttatcctagtggcggctgaggcagcgtgagccccatatgttagtgtgaacacatcatcctcctctctcttttcctctcttctctcccctcctcatctctctctccattctcttgtacgccggccgagcaaggcaggagaggcgtcaggcgtctgcagccggcgatgggcgacacgacagcgatgatggcggtgacaggcgacgcggcagcagtgggaggagccgttgcgggagggcggcgagggaggggcggtgtgctggcggcgggggaaggagcggcacgcgggctcccccaccggccgccgcccatgaggcccacaacgcggcggctggggaaggagctgcgggcgggcggcgggggaggagcggcgggcggccgacggaggagcagcgcgcgggcggcgggaaaggaggaaggcgcgccaaccacacgccgacaccaacgaccaccatgcccgccg

SEQ ID NO: 6877 - DNA, 623 bp, Oryza sativa
cgattttgattcttcaaaatatagttttgcaaatttttacatgaatttaagtagaatttatgtgagtaatttggagttctggctatgatggcacttgcttaaattactacaagtatttacttgttgatataacgtgaacaaaaaataagtatggtgcactgattattctagaacaatgtagtacaattggagtttgaaatgattaagagacatcaccaaatgtactgataataccttcaagttgacactacagctcttggttaaaacttacaaataaatgcatatcattgcgatatttgttgttttagaaagcttcgacagccccccctcctttttttttgtgatggctctacatgcacacacctgtttcgttaacattttagcatatgtggaattcttctgcttgtctttagtcatagttgcttgcatgtcattgataattcatatgattgggtagttatcctttttttattttaagatagtgcaatataaaatactacattagctcactgtttgtctctttaataagtaataactctgttgtttttgctgatctattgtgaggggcttcaaggctccagctatgcagtcatgcatgtatttataccttttatttatttttg

SEQ ID NO: 6878 - DNA, 1501 bp, Oryza sativa
tcgtttctatcctcgaataattatcacaaatcatttatctattagccattagttttgaaaaaaaaagataacaataataaataaattaaataaagaaaatgaagcgattaattaatactatggtcggtccaaaggcctggttctgtttgcatattgtgtttggatgatgccctggccttcgaaatcgatcgaacgcctgagagtgtatctagctatagctaggtgaaaattctcagagcacgatcaaacagaaccagcctctaaattaaatcatgcatgtaaatatgctaagccacttatcatgcatacgtagcattacgtttctaggctatgggccggttggtccgcatataaaattctaacacctaactagctatatatagctagctacatcttgttttagaatagattagcaaatttccaaatcatgcatcatcatgtcatctagaaatattactccggtcttcaggcttattcatcttctgtttccaaataatgtaatgttaactggctgatttgttggttcgtctgataatacaaaaattaaaagcgattttgcgtgtgtgtttgtcaacaggggtagctagtatcctcgctctgcccttccactgtcgcactcagcaacaatttcaagcccaccatggaataccagcttgcacgttccaaaaccagacaaattaaatggttcgaccctgagaccaccggaaggaagaagaagaatttcctggtttgaattaaataatgtgccatataatcatcttttagctgctgcatggggtttaggtgtggaacaatccaaatttagggatatccgggattattttataatcagtgcagttgagagagtgaatttgttgattagctgatctggctagctagttgaaattgaaatttcgcgaggaatctaatcaattgatatttattagtagagattcgtaaattgaagtgtgtcgtaagttctgttgagttctcagtcatcgtaaattattgtgattttttagggaggggtggttagtataagagggttttccacgttaaatccgtataactaatatcagacatcaattttttatttgatataatataattatcaagtattttttgcattgcccgccgtaagggagtatctcaattacataggttaattaaataattaattactgccactacttattgcattcatctaatcactaaattccacggtcttaactttcaaagatgctcatatatgatagccaacatttttgaaccccaacttcataaggttaaccccaggaccaacgccaaccatatgcacagactagtaaacgtcttctctctccattcaattcctgcttaattaatccattattacctccatgccacatctctctctctagcttgtctatgtcactgatcagtgaaatcattattccacacgctcatgctactagcaacaagtggcagccgttctgatagaatgtaagccactccattccattccatcccatggatctctctt

SEQ ID NO: 6879 - DNA, 1501 bp, Oryza sativa
acttttttgtcagagtttacatgagttttcaccaaaattgagtttccaccttccaccgcatatttagggtgtattcagtagtaggagtttggaactctccccgaagcaccgcatatttagggtgtattcaatagtaggagtttggaactctccccgaagcacacaaaatggagtgttgtatcagcgcatctatatactaatataaaaaggagtttgcccctcccaatcctattggtgaaatcattccatctatctcatccgttcatcctcatcccatctaatctcatccgtccgctgtacaccgtagctagtatatctcctctagcgattttgcccgatctcatcccaccagcaatttcggtccccatgcggtggctgcgcggcgcaaatccccgcgcggtgactccgcctactcactctgcgccttgctccccgcgcgcatcctcgctctacgcctcctctcctcactatggtccagcgacagtttaccgccggaccaacaacctcacgtcctcgttccgcgcaacgccggacctccttcatccttgcaacggaccaacgacaacgcaccatcgcaccgccagaccagagccgaggcactaccgcaccgccagaccggcaccgaggcaccatcgcgcagctgcccaccgctagaccagcgcacgccatctcatccccttcagccggggactgccccagacggtggggtagtggttccccctaccgccggagccgttgcggcgcacgccacgccggcgccgagtttgttcgacattctgtcaaactttcttcgagatgcttaggaactggtgatttggggactacttcaaggtggaggccattgggttagcctgggatcatctcactcaggttttcttttttttggatccttttagattccctttttattctcatgcaattgtggccgtgctgtgtgaatctaatgtctcttctaattgggactggaatcatgagttggttgggttggcattaaactgttttgagctagcgaagtcttgataaataatacttcctccgtttcacgatataagtcattctattatttcacatatttatatttatattaatgaatctagacatatatatctatctagattcattaacatcaatgtaaacgtgagaaatgctagaatgacttacattgtgaaacggagggagtagaagagttgttacttgtaagagatgtcttattttctgatcttgtcgagtacaaataatagataagagacaaacaatagatgagttgttgtgctcgacaatttgggaagatgtctgagtacaacacacctagctttatcccctataaatacgtttataccccccagcctgaaaagttaaccatgcaggcatcaaatcacacagcactaactcatcaagagctctacatatacatactaattaaacctaaatacgtagcctgatcagtttaggtttgtcaaacgccatggatatggagatgggtaaattgcttcatcgccca

SEQ ID NO: 6880 - DNA, 1501 bp, Oryza sativa
agcaacagttatgtacacaaaacaccaagctataggccaaacatttaaactttatacgtaggtcttcttttgtgtgcgcgcgtagttaagggaaattgtttggcagactatacatccgaaatcagaaataagtgtagcaaataaaaatataatgaagtaatagtggtattattttggttaatagtttggtgtgataatttttttttggatttgctaaatttctggcaccataaaattccattgattacagtcggtttgcatgcctatgcgctatgccacacaaccgcacaggcctgaggcctcccaactgtgcttccgtgaggttgaagattatttccacacatacatcatgatgagagatgattatatattaattacatatatgcaatttcgagacttacatatgtaattttgagacttacatatgtaagtttgtgacttacattgtaaatacaataaaattgcatatgtaatttataaacttacgatgtaaatacacaccgactattttttggtgaaaaatatggcgccataaatatagctactccccttttttttagctaatagaagatggatggttttttcttcagaattactaataaaagatggttgcctcttaaataaggtatgagatccgatcaatctggtgttaccttgctgagcttggtagttttatttccatgtattttttccctcttaagattgactgatttatgttaattgttcgttatatgtcataaataatgtatacatcattaaggtctaaagaattaccttttatcgttataaatgcagtaaaagcagattgagtctcacaccgaacatgaattgctcagtttcaaaaaaatatctgggtatatgagtagcgccgagcagagattgcttagttccacaccaaattctgggtgcatatattagtcttgtttgtgctttcagttttattctatatataggttgagaagttgtttgtatcctaatcggtcatgtaattcttatgtttgggttctatgtaatttatgtgctggactgaatttgtaattcctgggcaatgggcccaaaaataccgcatgcgggaactggagacggacagctaaaaaaacgcgtgcattgaaaaaaaggcggactcactaaaaagagcgtgtgcgcaaaaaaaaggtggatgggcccacagaaaaccgcgtgcgaaaaaaaccctgacggacaaaaaaaaccgcgcgaaaaaaaaacggacagaaaaaaaccgccgtgcgcgtgtgggaaatcggcgacggaccaaaaataatgacggaagccttaagaatttttttattaggtatagatttgacaaatttcctttcctacatgtgtcggtcagtgtatttccctgcatggtttcctatcaaaaaaagaccaagaaaacaggtgtttggttgtgattagttcacgctaaaattagaagtttgattgaaattggaatgatgtgacggaaaagttaaaagtttatgtgtgtaggaaaattttg

SEQ ID NO: 6881 - DNA, 1501 bp, Oryza sativa; identical to SEQ ID NO: 625

SEQ ID NO: 6882 - DNA, 1501 bp, Oryza sativa; identical to SEQ ID NO: 624

SEQ ID NO: 6883 - DNA, 446 bp, Oryza sativa
ggatccccctattttcatgtctggtccatatcctccataaacggaacatcacaaatttttattatttgtaatttaaaaaaaaagtacagaaaacatggaaatgcataactactttttgagaggtctgcatgtcctgcaccagcgaaacaatcggaactaccaagtttgcatctatttataggaattgtattagacttgctcgacgaaaaagccggccaacgatctctatgctgcatcatgcgtccatgcctggttttctttgccccctgccaccataaatacgcacccaactacaacatggatcaccaaacacctcgatccatccctctacccttcaagaaacaagaaagataacaccaacaaactagctagctcgccaatggcctcgttgtcctccttccggctctctgtggcagtggcggcattgttggtcgtcggctcgtgcg

SEQ ID NO: 6884 - DNA, 1501 bp, Oryza sativa; identical to SEQ ID NO: 621

SEQ ID NO: 6885 - DNA, 1107 bp, Oryza sativa
gtgaaaaaaaataaaattcaaaaaaaaggaaaccctagccggccggccggttatgccgccgcccgcccccgcctccagatccgggtgacctgaggcccgccgccaccgaccacgtcgccacccgcatcgtcgtcggccgctcccgccgccgcccgccccggttccgccgccggccaccaccgtcgctgcccgccatccccacccccgccgcctccagatccgggcagcccagccgcctccaaatccgccgccgctcgccagccccgccgcctccagatccgccgccgcccgccgcctccagattcggacgggaggagtctgtcgccgccgaccacatcgccgatcgctcccgtcgccgtcgaccacatcgccgggcgggaggatgcccaccgcccgcgtcgccgcccgcatcgccaccgttgtggacgccgcccactcaccggatcgccgccgtcgcccgcatcgccacatcgtggacgccgtccgtatcaccacatcgccgccgtcgtggatgccgcccactcacccgcacccccgccgctgagctaggtcgccgacgccgcccactcgcctgatccgccgcccccgctgcgcgccggccgtcgccgtagccgcagccgctccctagggcggcggatccagccctcccgagggcggcgccgccggatccgccgcccgccaacgcatcgccgcccggcggcactctcggagagggagagggggaggagaaaagaaagagaggagaggagagaaagagagagagagagggggtgggtaaaaaatacagggagagatagaggagatgagttaaaaaaatttgaagtggtgagagggaaaagagagcgggaggagatgaaattggggtggtatttttgtatgcggaccacttaatgagccgtctgcgaaaatagatttttgcatgctgttccttaagtggaccgcatgcgaaaatagttattaaaaaattaatttcaaaatatgagaacttcgaatccaattttaggatattaaatgaactcaaatgaaatagttgtcaaaaacaaagttgtagaactcgttgagatctaacaattttcttttggtcatttctccatccgagtttcattt

SEQ ID NO: 6886 - DNA, 1501 bp, Oryza sativa
tgatgtagtttttggttgcaacaatggcgaatgagaactttgaggtagaagaagattactgggcagagaggtggggtggagggtggccatccagagaaccttggagatggagttgcgggggaggaggacgaaggcgatgtggttgatggcggagtcggcggccatgcggaaggcgtccttgatcttggcgtcgacgttggcaacggtgatgatgacgctcgggttgtgcatccggatgataccacgcatgctagagtagacggcctggaggacgggcacctcggagtgggatgggccggagagcgcgccgacggcaaggtcgaagatcttgaaccgcctctccttgcacaccaccttgggccacttgagcaccgtcgccgcctcctctgcaggggtagtgcccaccgccggacacgacgaggtaagccttacagccgggggtggtgcagaaccgctctagcagcaacgccagcgcgtggacctcgctgagcgagtgcgcatagaagagtgcgtccaccttctgcgggtgcatggcctcccactgtgtgacgtagccggaggtgagtgcgcgccaccactgctcgtcccgcatctgcacgatgtccttgaagatcaccgtcgtctcggcgaggtacgcaagacggtgcttgctgtccccccacgtctccttggccgcaactccacctccatcgctgacctcccgtactacttcgtccacaccctcctcaccgtcatccacgccatcctcccgccgccctccaactcccgcaaccctggtagcctagctccgcgtcgcagcccgccgaagagtacggcgcagtgggcggcggccaacgggcatctccgcccccctcgccggccggcgaggaaggatgccgggagcaaagaggaggcgccggtcgctccctccctcgtcgtccactcatacgtggatagagaggatggtgggtcccattcttttttccttttgtctgactgacatgtgggccctatatttttttttatttttcatttttatattttgcttctagtgtcacgtcaccgccacataagataaagaccaagtcaaaccggtcacgtaggcaccacgtcagctaaaaccaccatcaaaaccgctgagggacttactttgcctggttttgatagttgagggtatctggtttttaggttgaaggacgaaaatgggattcgttgacgagttaagggacctcaagtgtacttattccaagttaaattaaaggaataagatcactttgactcctgaactgaccactgaatctaaatcgtatccctaaatcacaataccagaaatcttaacccccaaacttgcaaaaccggtgtaatttgactccctttgtggttttgaaaggcggtttcgctgacatggtgcacacgtggcagtgttgacccagtctttgtcctacgtggcattaacgtgacgcttatgtggcattaaaataaaaaatatatatgcggggcccatttgtcattcacccaaata

SEQ ID NO: 6887 - DNA, 1501 bp, Oryza sativa
aagtgacaatggacggacggagaaaggcttggaactttggaaggagacattggttcacttcgcacacaggtagtttctgggtggatgacaaaattccgaagaaattcggatttcgtggaattcaaaactatttcaaataaaaggtctattcacttgaaataggtgctcgtatttatgctaattattatttcagtgatagacaacatacatattaacagcgagacattcgtgatgacttcatcaatcacaaggaatgccggcttagttttccggaggtgtttatagaggtaggatgtgtgtgtgcgcgttcacagggtgaatacgcgggcgttatgagctcttgtgattgtactgcgtttctcagaaaggtctcttcaccattttattatttttcttttgagacgaatccacccagggccatcttaagatttattttgggaaccaggagagattatagtatattatgaaaggtctttgaatcttaagaaataattcaaaggcatccaataagttgacaatttccagaaaaaaaatccaaaactacatgcagttaatgaaaaatcatcgtattctcatagaaatggctatatactctcgggattcgacagaacacctataatcaataaaaagacgcataactccatagcaaattctatactaatataaaaagaaattgtcaccttctaattctacaggccaaatcacttggatgaatccctactgtccatccacgcgatttcattcaccaccgcacgatttcgttcccaccgcaggatgcgaagacttcgctcctccacgcgcgcagacttcgctcgcttctcctcctcctccccatgtgtactgaagccacatcctcgcaggagctctgtcgccgctccgccgcatcctcgccggagacgccgccgccggatcctgcttcttctccaccgccgccgccgccacctcctccttcttccccaccgccgcggccggcctcttccccatcggccgcggccggagccgacgtcctccccatctgccgctgccgcagtccctgtcgccatcgtcgacgttgtctccgctgcctcgctccgctgcccatctcctgtcatgctgctgtacttgaccaatgtgcctataccctaggtgctgaacaataggagggaatctcaacatcgttgagacgtacaggtaatcagactctatcttgcagcttcgattcatcattcaattatacaatttgatggtctttctttgttgactgccaaacaattccccttcagctcactgccatcctcctctccctctgctgtgtggtttgtgtaaagcatcaccattctatacatcactgtgttcattatgagcttggctatgcaatatatggattggccattcaaatatcaatgtttttgttcttggatttgcaatgcttacgaaattactctctgaaattgtgcttgcaatgggccttgtattattttccccacgatgtgggtagtatggatttttttttctgtttgtc

SEQ ID NO: 6888 - DNA, 810 bp, Oryza sativa
gtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcactttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgagctcggggtgcatggttttgatagtagcacctcggccatataaggaccggt

SEQ ID NO: 6889 - DNA, 1501 bp, Oryza sativa
ttagtagatcaattataaaaatcaaactactaaatacttttgttgatttgtttgaatattatgcagttgtgccgtgtagacatgtgttgatgtgcatataccgaataggttttggaaacctatcggcatatgtacgtacgtcaacatgtaggcctgcggatggatatctcctgagtcctgattggtcggcacggttgtcatgcatgcacgtattccgtttgcctaattccagtcctaaccggacacaagaacgaagcaaatacagattgatttgccaccaagtcgggcttggcattccttggatgggcgtcgcacttgggacagcagctgcacggccgggtggaggtcggcgtctccttctcggcggcgatgatcctgatctcgtcggaggatatattccggtcggattagatctccccacagtcgaagtcatcgagtagcttgttgttggaaaatccatctcttaaacctatctcgtcgaaatcctgaagcaccaaaatccccctacctggcgcgccactgtcgacgtttgatgtcacgactacggtatttggacaggatggggatcgttggtgctaggatatacgcaagactgaggtaaaagagacggagacagggatttttatacaggttcgggcccctgaattgtcaggtaataaccctacatcctgttggccgaagccgatattgctcttattcatgataatcataccagtacaatatttggggtagcctatctaactgttgtcaacatggcggtctgacgatctgagtcgtagtcgacaacagggtagccttcctccttgaattcgtgcccggcgagatcagagatagcgctttcgtctctcctaacagtatccggaaacaccgtaggggactagccgtgcttatctctaaagtcgatatccggcggcgtgtcttagcgtatgtaggcttctatgttgtggcttctatgtcgattgtgttgagtgttgatcctctgtcccatagtgggtgttgatcgtgttgatcgtctcatggtgggtgtccccctgtcctcctaggaggcttgtatttatacccataggtgtccccttgtccaagtagaactagggaaaccaatatggatacaatccgagtagtccttgtcgttttcatgtagaattctggttgtctttccttatctggaactcctcctatatccaaagattgcttccgtatgggatatagtatgtagtgggtcctgccgagatttagtcaactactattaggtatatggtatccataaccctgacaacttacatgccatatatactgtttttacaaatgtaattttagttataaagcactgtaattttagttataaatgcaacatttataacttcaaatatctgcacggtttctcaagtaatgtatttgttctaaaacgataaatattctagttaccaaaatttacagtgcacttatactaaaattacagtgcacttacatgccatatctactgtttttacaaatgtaattt

SEQ ID NO: 6890 - DNA, 1501 bp, Oryza sativa
tacgtactggttcgagaaccagcgagcgagtagaatctctcaaacaccaatggaagttgcggtgtgagagattgctacgtgctggttcattggtgttgcggtgtgagagattgctacgtactggttcgagaaccagcaagcgagtagaatctctcgaacaccaatggaggttgcggtgcgagagattgctacgtactggtttaggaaccagcgaacgtgtagaattatctctcggacaccaatggaggtgctaaagttggtttattatatgtgtatctcatgtggccagcatgactcacatacccaacttatagcgtatctggatgtccgttcgcagtcatgtcgggtgatcaagccgacgacatttgcgaggaattatccgataacaaccttttctcgagtagtccagccatggccggtgctatgagataggtcgtcggtcttcgttggtaagttggacgcgacgactctgcatttgtcaagaatgacctcgataatacggtgtactcgaccacatcctactcgagtgctcaattgttcctgaaaaatattttctagaaggcaagatatatagcagagaatatcgagtatgtactaaaaactgcatggatcttctagtattatcaggatataacgagcagatgtaacatcggggacaaccgtaaacaagcatgatttatacagaagaagacggagtgagcccccagcgttagatcgtagtcgatttaacatcggggacaaccgcgcaacagatattgtataaaaaacatgctctgggtaaacataataaattattgatctgacaatgctgtataaattgaaaaaataggtacgataaattgtgtataaaatattgcgtatctttgtagatacatgccggatgtatctatggaattagtagatcaattataaaaatcaaactactaaatacttttgttgatttgtttgaatattatgcagttgtgccgtgtagacatgtgttgatgtgcatataccgaataggttttggaaacctatcggcatatgtacgtacgtcaacatgtaggcctgcggatggatatctcctgagtcctgattggtcggcacggttgtcatgcatgcacgtattccgtttgcctaattccagtcctaaccggacacaagaacgaagcaaatacagattgatttgccaccaagtcgggcttggcattccttggatgggcgtcgcacttgggacagcagctgcacggccgggtggaggtcggcgtctccttctcggcggcgatgatcctgatctcgtcggaggatatattccggtcggattagatctccccacagtcgaagtcatcgagtagcttgttgttggaaaatccatctcttaaacctatctcgtcgaaatcctgaagcaccaaaatccccctacctggcgcgccactgtcgacgtttgatgtcacgactacggtatttggacaggatggggatcgttggtgctaggatatacgcaagactgaggtaaaagaga

SEQ ID NO: 6891 - DNA, 1501 bp, Oryza sativa
aatcactaaaatttcgaactttttaaaacttttgcattatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattgtatgttaaatacttgaaccatgtcgacaagtgtcatgacatctaagtaaccacgaagtagtcgccactacaatgattttatatatataggagtgttccactagaataattaaattaacatttataactttcatcgagtctctcatgggatggattcactcatgtaaaataatttgtcatgcaaataaattgaactttatatataaaataggtttatgtgagtgtttaattaaacatttaggtcaatattgtaccaagtatcaatttacttttatggaataatcgattaaatgtgtccttgtaaaatacattgttatacaaataaactcgaccaatgtgctattgtattattaaggtcacattagaatatttaattagtttttaagaaatatcaaagcttataggttatattggataatttttggataatttaatggaaagcaaattcatttgggaactaataaataaccaaataaatattcaaatcaaacatttgaattctcaaaaccaaaatatattgattacatttcaattcaaattcaatcccattcacttttgcagattagcccctccctttccttcctttccctttttcttccttttctctcttttctcagccgccactattcaatgtccgccaaccgttcgatcccgtctactgcgtgcaccacatcgcttctggccgcgccagtcacgcccgtgccgcaccgcaaccgcgcctccttcccctcagctgcgtccgaccccaaccctagccgcaccgcacttgccgctccgcaaccgtatcgcgttgtatcgcgccgtgcgtcgcatcgcgccggacccacgcccgcgcccgcgtcatcccttccgtgccgcgtcgtgccagggcccgcaccacgccaagccgcacctctaaccgctctcctagattctctccagaaaacacggagctgcaccatcgcccatgtgcgcgcgtcgccgtcgccacgcctgccttcatcacccagacacgcgcgtcccatcgcccccatccacgcccaatggataaaacggagccctctcctccagctagcgcccagacctgcagtctataggttataggtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatccctctcagccttcttctcgta

SEQ ID NO: 6892 - DNA, 249 bp, Oryza sativa
tttgcaacttctatgaaggctttcaaaaagatgcttgagtttggtttctttgtgagaactctgctgaacttgaacacccagtggacttcagatttgaagacatcaaccatgaactataccaatcatccagggaaattttctcaactgcaattagcccatgcatccttcctgttggcattcatcaaggaagaaacatcgaagcttcttatgaattctatcatccaatgagctcaggtagacaacttggaa

SEQ ID NO: 6893 - DNA, 1501 bp, Oryza sativa
aatgagttaccataatgcatatcccgccaaatacgttgatgtgatgcgatgcggcagatgagcaaatggtatattgtaacttttcttttcatttgagtcaataggaatgccgcactattaagagggatgatgcattgacatatgaggagtgatcaaagtgctcaaaatctttttttaaaagtgtttcccctcagtttgatatgttctggaaatttttggagttttccgaaagtcattttcggactttccgaaaatgcacagaaccaatttttgcttctggaaattttcggatatgtccgaaagacattttcggactttccgaaaatgactgtgaaggcaaatgtggttctgtttattttcgtacttttccgaaattgattttcagagtttccgaaaaacttcagcaaaggcagaaatcgcttctgtgtattttcggacttgtccgaaagtgattttcggacttttccgaaaacatccagaaccatgttttggtggtggaaatttttggacttatccaaaaaattttcggaatgtccgaaaaatctttcgttgactttgctgttggtgctgagctggaattttcggacaagtccgaaaatctttcggaatatccgaaaatctcaattattgtgcataacgggcagaatttgggctgtggctataaatagccccccccctcacttgtgagggctgctggttccattccaatcatttgtgcccttggcttgctctctctctagcacttttgagccttgctttcttgtttcccctctcacccgtgttcgatttggatttggtgtgtgtgtgtgagagttgtggattcgagtttgtgtgagtgcttgttgttgacttcgtgaagatttgtgagcacttgcatcatctccgggagttctttgctacatttgttactcttggaggttaaggactcctaggcggctaggtgtcactcccgagccaccgatctacttgtggttggctgggagaagtttgtgaaggtcggatctcacctccgaaagggaagagatacccttagtggaaggaggagtgcttagtgcaacctcttgaggaaagggttagctaagacccggctcttagtgagctcctcaacggagagtagaatcccctcaaggattcgaacttcgggaacaacttcgtgagcttcatctttggtgacttacttcctctctctccactagctttgcttgtttgagccgctataggtctagttgttgtttgtgctagcatattcttgttgtaggcaactagatctaggatttactttgctatttgtgctgactccgaaaattttcggatatatccgaaaatttcggaaatatccgaaaattactgcttccgcttttaattgaatttttgaattagcctattcacccccctctaggcctaattgacactttcaattggtatcagagcctaatctcctaattaggcttaaccgcttagagagatcatgtcgggccaagcgggggaggggatcgatagt

SEQ ID NO: 6894 - DNA, 1011 bp, Oryza sativa
tttattccatgagtccaataactatattttttagaatttggttaacaatagtctattgtttgaatgagctaaagatgctgaataaaactacagctactataagctgctcaaacagggtacatgaagcataatagacatatgaggtgccacaaccatatgtccatactaccatatagatgttactccctccgtcccttcgtcctaaaatgtagcaatctaaaatatgatgaggcctattctaaaataaaaaaaaatctggacataatatgagactcatcctagaacatccatcagattgctacattctgtctaaattcgtcatcctaggttgctaaattctaggacataggtagtaacaaagtacagattgcataagagcaagtataatatagggctataaaaaggctgaatgctgatgtggatgagagaggagaggagagatgataagcgagctgtaagtttgcagccggcttaggcacagaaaccaagaaaatttgtgagacagacaggtggaccatatatttatagtgaagagttaaccaccatatgagtgagctgagagataggctataaggatctgtacagtaagcagttggttgtattattagccttgctctaagagcaagtataatagtatagtcaattattggctttaaatcatctataatcaatttaatagccaatttatacaatagttacatatacacatatactacataattaacctttggtatcacctgtcatacacacatgtatcttgagttcatgttgcagctggctacagatctgtagcccgctattcttacatcttttcttttatcgttttaaaatatatttatagttggcttatagtctgctattgtaccaaactataagagcacccatcagtgtcagagtttagctgaagttgctcaggcgctgagcccaggaaaacggtatataaaattgtgattcgaagaggccagctgattgactctacactcgggttgcggtagctgcggcaattgacca

SEQ ID NO: 6895 - DNA, 479 bp, Oryza sativa
gagttaaccaccatatgcatgagctgacagatcgactataaggatctgtacagtaagcagttggttgtattattagccttgctctaagagcaagtataatagtatagtcaattattggctttaaatcatctataatcaatttaatagccaatttatacaatagttacatatacacatatactacataattaacctttggtatcacctgtcatacacacatgtatcttgagttcatgttgcagctggctacagatctgtagcccgctattcttacatcttttcttttatcgttttaaaatatatttatagttggcttatagtctgctattgtaccaaactataagagcacccatcagtgtcagagtttagctgaagttgctcaggcgctgagcccaggaaaacggtatataaaattgtgattcgaagaggccagctgattgactctacactcgggttgcggtagctgcggcaattgacca

SEQ ID NO: 6896 - DNA, 1501 bp, Oryza sativa
tttctgtacacacgcagcacagtagcaaaggtgccgtgcaaagtgtccaaaatataatcaccacctgatatgtgtgcccgccgactcgcattgatcacttgccgacccagctttctttagaaccaagcaagcaacacaaggggtcgcgagaacgaacaaaaagtgaaaaaaaaaaaagaaaagaagctcatcactactcgcagagagaagcaacaatgggattactgagtactgacatggattagccgtgtctccccaaagagaaaaaaagttagacgaggttaatcaagtggccatcgatcaccacggtctctctctttctctcgctcagcgatgatgctcttggtccggaccaaaatacagcagcagcagcagcagtacaaagctctgacgctcgggtcccacatccgtcagaccatccgtccgtccgtccaagattcaggagacgaagcccatccgttggatggaccaaaagatgccgcggtcgatgcatatgtaaggatgcagatgcaggcagcatgctgtcgtcgaccgacccgatcgatcgatcgatctgtctctactgcagcacgacatcgccgtctcacagggcactggaaatgatgggtcgcctgcctgacctctctacacaaatcttaagcctagagacagacactgatataataataaatagagattgaccgggattttggtgctgtttgttaatggtgaccatccgacaaaatgctctatcaccgtcctctgcgtcctcgctctgcaccgactgattcaccacacttcacgttccacctcaccggagggtaaatacagcaatcaccgttccacacatttcgtacaattttgcttgtacaaaagctgatcaatttcgtgctcaaattaatagtacaaacccagccgaaaagcgctcacaaagccaaacaaacactcaatgtagcagcagcagcagcagcaatcagcatgagtgcccaccattgcttttttttttttttggtgccgtcttctccgtgttgttcgtggcacaacaggacatgatcgatcggtcaaagggtgaggggagaacgagacgacggtgcataaaaatcaaatggaatggaagcgagaagggagagaggagaggagcatgcatgcatcgttactccagtacgctgcgtacagcggccggccgcgccacgatctcgctgtctgctgctgctgcttccaactgctctctgctctgctctgcttctgctcctctcttcctctctaaaaagcgtcgccccaaccaacctgccccgtcctagctaaagccatagcagtaggcgggctacgcatcatctcccgatttggcaacacccatattgctgcagtgcagttgcagttgttgcggttgcagtgcaagagggagaagaggagtttcttggtgagggagagggagagatgagggacgtggtggtggcggttggcggcgggacgaaggcggcgagcaggcagcaggggcagggcggggtgacgttggcggcgg

SEQ ID NO: 6897 - DNA, 1011 bp, Oryza sativa
gatgaggcggcagcggagaggcccggtaggggaaagggggatcaggggcttttgaccgtttgaggcgggattttgaagcggcgcctgaaacttttattttctcgttttcttctcccttttggcctttcccttccaccagctatcgtgcacctgtaatgtgtgtttcccaaattatatgtcacagcaataatataaacaaactcaaatattagtattaagttttccacaatgtgagcacattatatccaatatgatataatcttatttttactagaagggagagcgcggcgtgcgcagccacgaaaacaaacataatttacgtagaaaatttcattgaacacaaattagctaacattgattaaatgttcttcatttcatttaacctaaaaatacaatatcaaaacgtggtatgtatataattacagtgtgtaaagtatatgcttccttcattttctcaaaatgacgtccttatacaataagaaacgtgttttaatatttgacgtccaaatacaacttaaaaaccctttgacgtccgaattcgtgaggctatataaggcgcagcgatatgatatcgaacgaagtccggttgtcagtatcctgattcgtattctagtatcttatgatactacgatcctaccaagccgaaacgataccgatcccacctagtatcctaattttcatagtatctcgatcctactattcattactacacgatcctacgaaatcttaagtggtatcccgattctacgatccctacgttactacaaaatattatttaaaataagatggtttggaaataatgtaaatgaatatgctcaagtatatatagaaatcagttaaatatatcaaaaccaacgtggtttctcatgataaatgtctatatttgcataatatatatgtaattaatatgaatattaattaaacttaaaaaaagaaaatctcatagtattccaatattacgatacgataatacttggagcaaaacattactacctaatatcccgatccaga

SEQ ID NO: 6898 - DNA, 466 bp, Oryza sativa
cgtcgggatataagccaatgccaaaaaatatcgaaatagagattgctacaattccagccgatgaatgaagatataatgtgtttcagtatttacagaatccatctcaatcggcttcgcagaaattgcgttataaggccttgaaatacactttattggatgatgtcctctattatcggatgattgatatagtgattcttaaatgttcgagcgccgctcagccaaaagttgcactcggggaagttcatgaaggaatatgtggtacacatcagtcggctcatcaaatcaagtggttggaccaccccctcccctcctcccataatctagccaccaaatagtcctcctacttcccctccgcagcagcagcagcagcaagaggtgaaaatttgattccaatcaagcagcatatcaaaacaaacctaaattacggcaagataaaaataaaagtgatattttttcttggtggtgg

SEQ ID NO: 6899 - DNA, 589 bp, Oryza sativa
agtcaacggtgtcaaacattttaaaatagagggagtatatttcactactttgaaggatttatttatacagggcctcagagcgaagatttgttaagacaaaaggaagttatggccacctccagctttaccagaattacaataaagttttttaaattttaccactttaggataaatcagtaaaatatcctctgatttaaaaaaaaatcacattgacctcctccaagctatacagctagctcctccactgcttacaatcatgaaatgtttacaataatgagatatatttatactaccaaacgaaatagttaaaaaaaagtccaaattaccccctccctccccccctccccctcttccgccctaaaaaattaccggacatttcataccttaaaactctttaaatcgtacgaattaaacccctagaactattttgagtagttttggtccaagctggcacacatagcatcacacaatagtaaaccaatcagaaaaaacacacacataagggccacttgtcatctatctcttccctcattccctctcctctctctccctgcccgcccgttccccctctcttttgatggggttaagt

SEQ ID NO: 6900 - DNA, 1501 bp, Oryza sativa
cgtccaacgtttgaccgtccgttttatttgaaaaatttataaacaaatttttaaaagttagtcgcatataaagtactatttatgttttatcatctaataacaagaaaaatactaataataaaaaaatttcaaataaaacggagggtcaaacgttggacaaaaatggtgcaaaactgtgatctttctgggacggaggtagtatctcctagtgtcctagtgtagtatagtagtaagcttacacacgagaggaggaatcagtggtatactcgtgtaatcgtaaatgtaaatataagatttaaatcttactgtttataaatattatatatgtggtccgtgtttccaaaaaaaaattaatattaactatgggtttgtcattggtttatattaaatattttaagtgcatgctaagatatatataggatgcactcgtggatgtgtgcgtgcgcatagcgatatgtttgtgcatcttccgtattatttaaaagtgctatatgaaaccttacaacaggaagatgaaactacttggatcgatggatggagcctctagagacaagaagtgttggagctttgctttagaaaatgatcttctaatggagtagggatttaattagtacatgcttgcggccggcctgtagcttcccgatcgctttcaagaccagctttttctcgtgtagcaagtacaaacacaatgatgcatgcaactcatgttaaagaatgattaacaaattaccaacttggaaatatttttgggttttagcaagtgcacgcttgtaactaactaccttaatggctttaaggctagctaggttagctacaaccctattaattagcctatagagatgtcatatataaaacctctataatcatatctgaaaaagagtagcctaatgattaccagcctcagcttagatgtgcatttttatgataaacaaagccaaaattaaaagaagggacaagtgatagtgttatcatcagtaactaacaataataatttattgtatacaaggaaatttcctttgaccctttctccatgctccagccatgcatatgttaatataattagagtaaattttaatgcatatataaattagagtaaattaattttacaaaaccacatgcactctacataatatatcatagaactacagttacaaaactatagagttacaaaactatagatttagtatattcattatcacaaaactactgcaagttttaactttacccgttagattcacggtcacctgacatgtgtgaccactgcagtccaagaagtttcaacatgcatcattgttgattgccacatcaaaaatcccaaattatgcatggaacccttcttgttaattcttttttcttcagttcctccatggaaaccttccaatcgtactatgtatgcatgtattccttcatatttctacctctaaaaccagctttttcattcaaagaagttctagtgtggcaatcaacaactgcgcatcttcaagcctcctatgtctgcagg

SEQ ID NO: 6901 - DNA, 184 bp, Oryza sativa
acagtggccctcaggggccttcctgggggtcgggggctcctagcaccgtctgacaagcggcagagggccacttgcccccccgggggggtttccgggttacgggggggggggggccccccccccttttggaccaccgttcggctcgggagcctctcctccctgctctctcccgggccaagtcggc

SEQ ID NO: 6902 - DNA, 250 bp, Oryza sativa
tgaggtagaacgactactactgcaagtacttcatcagataaagtgaggctgggagccgaggggcgaggagctccaacggaatcggcgcggaggcctatcccctctatccgcgatggctggtagcgcggtggccgtgtgcgtttgtggtcgtcgcgtttcgccccccaggtgatcgaggcccgagctaagtcgagctactagaggcgagcacggctttgtcctgtaccgccacgtactacggcaacgcagc

SEQ ID NO: 6903 - DNA, 318 bp, Oryza sativa
cagagactgtgacccgcgtagatagataaactaaacagcagaagagcaagcaagcaagaagatgaaatactagtatgtggagagaagagcaggttgctttgcttgcctcgtagtctttcgctggggcggtcgatgacgagacggaggcgcgggggagggggcgggtcggcggtgggaaggcaccaagaagaagaagagagcgaggccaaggtgggcgagcgggaggcctgaagcagcagcagagagtggcgaggtgggtcgggattgacggggaggaggaggagggcggcggggcggagaagcaagtggaggccaaca

SEQ ID NO: 6904 - DNA, 446 bp, Oryza sativa
cattaacataaggcaaaatttgctacaggacatgtaattagccgaagaacaccggaagaatgtgtatatgctggagagcatcgtaaaacactggtaattagctgatgtacactcacgacattattttattatttctggagaaaatagagagagaaacagttgtgaaattatggttttacccttgaaccccaataaaggctcactctcctgtgggacccacctattagggaatattattttttttctttttctctcctactgtactccttcgtcttcctttcttcgtcatgtcttcttccatgatggccagcccctccccacccatcgcggctccagggatagagttcacggcgccgccgccggggcgcgaccacacgcaggattgctcgctcacctacgcgcagtggaaggaggtggacgcctccacgcgccaccgcctcccgctc

SEQ ID NO: 6905 - DNA, 605 bp, Oryza sativa
aagggggggcatgaaaatttgcagggggcccccttgccgccctccgcgagggcgattttgcactgtgcggggggccgtctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 6906 - DNA, 443 bp, Oryza sativa
cctttttggtttcaattgtagcctctgttatgttgcaagcttgctgagaaaggttcagacatgtggtctgtcttaccacttgttcaagctctgcttccaggtattaagtggaacatatacacttgtgctttatattttttactttttgatccaaatggccaaaaaaaatgtgaatagatagaacatttgttaccaaataatgtacatattcccccatgctcattcatatcttatcctatatataccaagtgatgacaggcctctgccaactggtgtaacataatgacacctttgtttttgtggattttctgggatttatcctttggcctctccgttggcatgggcctaaggctttgggatgattgtgattaactgcctgacttcacccattcgttgagttagagaaggggaattcctgcagttgcataagcgtacaacacaga

SEQ ID NO: 6907 - DNA, 1501 bp, Oryza sativa
cgtgcttatcgcaatggaatcttttcgttttccttttaaggagcacaccactctgtttatgtaggtgctacaacctgatcaagctggatgtgttcatgcgtgcggaaagaaaaaaagaaaaggaaagggaagttgttaactgtcaaagaaagcaccatgcatgttagaagattccaaattcctagctcaaatccagcctcacatgggcggtacacgtgggttgatcccccacgcatgtaatgcaaatattattggggcccggggcgttcgctcgtgtgcatctccaacaaatttgctgcaagtcgccaaacttatgagacagggaaatgtgcaaggcagcagcacagggcgtgtatatgctcttctcattccaccaattaaaaggattgatttgtaatgcgggtctgggaagtgggaactgaattgttcataggatacgttgtttggtttgagtacgtcgatgatcaaaactgtggtttggcaggctgatctagtgctgtaaactggtgttcagtttggtattgataaggagttcctcttctgccaagactggaggaagcgttcgatgcttgagctgaaaagggaatatattgtagttcagttccttgtgcagattgggaactgcagccatgccggctagttgcctccttcctcattctgcgacgtgctcaacgccgtgggcagagtaggtatcgtggttcgtggacgccgttgggctcaacgccgccgccgtagaatgtcgcgttgtggcggtcgcggaagtaggcgtacggccgtgcatcgtgtacggtcctggtctttgctgtctccgacaccttgatctagtacatactgaactctcattccggctcccggccggcggccggtggtggaactgtcaaccgcgtcgcccactcccgcacgccggcggcgtcgacgtgggatttctttctcctcgagcggtcgtgactcttcaatgagcatctccctcgtccgatctgaacggagagcgcccacgacacgccatcctctgggttgaggccacatgtgcgatcgatctgcgagtccgttactccacccgtttcatccttttaatgagttgttatgattttttttctaattaaacttcttttatgtttaatcaaatttatagaagaaattaacaatattttttgacacaaagcaagcatattatcaaaacatgtcagatgtaagttttagcaaaattaatttcatgctgtagatattattttttttataaatttagttaaattttaaaatgtttaactaagaaaaaaaatcaaaacgagtcaaaatatgaaacagaaggagtactacaaagtggtcggcaacggaaagaccgcgtttgcattagtgcaatttatttatcctcggtggaaccaaacgtaaaatcgaaccgatatgaaaatggtaccggtctcaaaaacactaacggagccatcattttgcttattcgcaaaataagcgaaacggtatatttgcaaacgaaaagtaacttgta

SEQ ID NO: 6908 - DNA, 1501 bp, Oryza sativa
  unsure (1)..(1501): unsure at all n locations
tgcgtgcgtcgtttgtgtggaagaaacacgaggacgatatggtccacttccttccagtttcacatctttttgttggaagtacacgcacctagccgctatccccgggagacgaaagctacggcgatctcgacgcgggaggtgactccgaccacaccgcgcgcttgtttcacgtttgcaagtgggcgcacgcgccgccccgatcagtcataactagcgactctcttcttgaccccaaatgcacttgagctctatagttgtttttctcgaaagttcatcttaaccgagtaatcatgttctcctacataggctcgcaccagccgtgtcatcagctatcaagccaggagccccgtccacgtttacaactgttcgtcgcttcatcagtgcaacttggcaagacagcaaaatcagtgagaggggttgctgtgactgtgagagggattaaatggatctggtaaaggatggcaaataagtagttaaaatcccccgcaatcagcatcggccattttcctgatatgtgtacgggggacagagagaggcaatcaggcgaatgcgtttttaaaccggagaagggggccacatttcctactgcgctgaaccggatcctctcggtatcacctcgcgccacgcaaccgcggggatccgtatcctctcaaattgtgcaccctccacctgtccgtcctcctccgtaggccaagtgcaccgccgtccttgtcaaaccaaagaccgcggcgatcgactatgtacgtggaaaacaattttaatcacttatatgtatattgtatgtcataaatagttataaaagaatttatttaaaaaatcaaaataaattgacatataatatgtcactccaccgatatacaagtttaaactcgactctataagttatgaaagcataaaaaattaagctctaattaattaatcttttgtagaagttaaattttacaagtttaaactcgactctataagttatgaaaagttatgaaagcataaagaattaagctttaattaataaatttttatagatgttaatttaaactcgtatgtatatcgaatgatatatttcatatcaattgatttttattttaaaaaaatgtananctaatttaattgacatgtgtaataaacgggctcgacagccaccgagacatggagtgattataatcaatctcccgcggtgtatgggctcggcgcacgcggcctaaccctccccttcctttcattccctccccccgccgccctcttgaccctcctctttaatcacgagacccgcactctttttttgcgtcgctcgagcgcccgcgttccccgcttcgccgaaactaccaaccgcctcgccgttctcctctccccgtggcgccgccgcgccgcacggcgggagggcaactgaccgagggagactgcccaccagcgtgccgcgcgccgtcgcctccggctccctggttcgtggaataatggcggcggcggtcgcgggcggtggggaggagggggaggagctgctcct

SEQ ID NO: 6909 - DNA, 1501 bp, Oryza sativa
atggtggatagcgaaaccatcataattgccactaccttttatcgttgtattcttcatactaataatatatgagtgagatgggagtatttgaaagtcttttatgtttgtagtgtttcaattaacttttccttttagatgatattactttagtatagtgtttatgattatgtaagagcaagtttaatagtatagacaactattagcaccaaatcatctatagctaatttactagccagtttatacaattgttacttaatacactattaatatatggtcccacatgtcatacacatattgtatcttggagtccgtgctgcagctggctacagatctgtagcccgctgctcttctctcttcttttatctctttaaaatatgtttataattggctcatagtctgctattgtacctgctcaaagaattttctaatgcattcgtccataatcattaaaattagtagtttcgagaaacggtaagagctctacatgcatggatctcatgatacctattgaagcgcgtaggagtgtacaagtgtgtactaagatttatctttaaggttgaatttattatatattgataactatataaatacatgaaaagatgttgcctatgtataattaggctctctaagatgatgtgagataacgttcttttgagacctcgaaatcttcgtatagctaaaattatctctacgaagagttatatatgagatgatacaccatccctcgtaatgaagaccgataggtatctatatggtttaattctttccttgaaaagttatcttaatgttattttaaaatttaagatagtttgaccgaaaataaggaagatgaagtcattttacaagtcatgatagcttggctgaaaaaaataaaagacaagtagacaactagtcacttgttacatctaaacatgtacattatctccatgtcttattcataagatggagaaaaaaaaagcattcgatgtctacgctctctgtaaacattaagtaggttacataagggttaaatccactaccatttcaggttaatggtataagacttttgcatattccaatattttatatcgtctgtttcattgcccggtggatataggagtagatttttatatagtattaattttcttatcttgctgaattttatttctgaattccgaatcatataccgggagtactactcctaaagaggaggcccacatgtcggtaaaaccacaaatccacaatatactacactctctctcaccgacggccctcccctataaacccaatttccccacaaaaccccagatggcacccacccacaacgcagccttcgccgtttggcccccgaggtaaccgacggacaccaccaccaccgcgccgcctcgcctcgtgaagctccactagtttctagggtttagcctagccccgaccccgaggaggcccgagatcgcaatggagggcggcggcgagggcgcggagtcagcagctgtcgcctccgcggcggcggcggaggtggagg

SEQ ID NO: 6910 - DNA, 1501 bp, Oryza sativa
aggaaaataggaaaaggtagaaaaatatataataaaaataaaatgtgggcaatattaagtgtgaatacaaatttacatttgaataactcagattttgtgtgaaatacgttgtgacaaaataggtggcaatagtccattctctaaattggaaaacatctaataaaatccaaagaaatcggctagtactgttcataggcctctaggtgttcgatgttgtcccctaactaccccctctctagccagcaccctagcctgctgctgccttgcgccccgcgccaccgcgcgccgtctagtcgccatcgccatcgccctgccgcgccgttcgccgtcgccatcgccctgcgcgcgccgctgccacgcctcctcgcgtcctatcccgccgcgcaccgtcgccgtcgccgcaccgtctccaacccgtcgcgtcgcccgtcgccgccgcgtcgccgtcccatcgccgcgcgccgccgcgtcgccgtcccatcgccgcgcgccgccgcccgtcccgtcgccgcgcgcgtgtcgccatcaccgcctgccaccgcacgccgagccccgcgccgccccgagccccgcaccgccacccgtcgcatcgccgctccgagccctgtgcgctgccgtcgcgtcgccattaagctgccgccccttcccctctccttctcccccctcttccctataaaaaccttccccccttctccaccccaccccattccctcctcctctccctcttccccttctccacgcaccatcgtcgtcgtgccgccgcgccgccgccgcaccgtgccgcgactgcgccgccgtcgccgtcgtcgccgccaccgccgccgccggtgagccgtcttccctccccccccccctcacctcgcgcccaccgccgtcaccgcccgggagagcaagagccgagagagagaggtagaaagaagccgggagggaggagagaaaaggaaaggaaaagagagaagagagaaaaagagaaaaagaaaagaaaaagaaaggaaggaaaaagaaaaagaaagtgaggaaaagaaaagggaaataaataggaattaggaggagatttaggatatttaaaatatttggaattaattataggattaactaaagtgtagtatttgcaaaatgatactataatcatagattattatagattattcttggtaatttccataagaaatcaattcgcggtagtaatttaaatgtaattaataactaaacaattagatgaattcttatagactattatagattatttttgggtaatctctataagtaatcgattcacggtagaaattcggatttaatcactaggaatttcagacgtatattacatttaatcgtttagtcatagactaaattaaatcgtataatattataagataattttagggttccatccaatatttagatcgcgatagaaatttctagcctattatatggatataatgctcgggtagattaaattaaaaacttatgataacaaaatatttatacccgcaaaatagtt

SEQ ID NO: 6911 - DNA, 1501 bp, Oryza sativa
atatatatatatatatatatatatatatatacactagcaaaagtgaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaattttttttaattctccatgattagttacgctctttgaaattatatttgaatttttcagagcttaattgttaattttattaatacaaacgtcatttaacaattatttacttggaaaaagaaagaaaatacttccttttaggtttgcttcgaaataaatacattcaataacttataattgtaatgcttctgaaaaaatgagcactaaaaatgaacttattctctttttttgggcctgagggacctaaaatagacttatttccggcccttgccggtcggtccacggccttttgtgcacgcgcaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacggcgcccctcttcccgcgagcggcggcagcggcgccctcccccacaaccaacggcgcggcgccctctccccgaacaacggcggcgtggaggcggctgcggcccggcgggagcgggaggggcggcgggccggacctcccctccgccagatctggcggcatggaatcggctgtggtccggcgagtccatcagagctgacggcgtcgtctaaatctctctctctatgtgcatggtggggaggtacggcagtggtggtggtgctggacgtcatggaacgccggtcgggcctcgcctccgccagatccggcggtgtggaggcagctgcagcccggcgggggtggaggggcggcgggccggacctcgcctccgccagattcggcggcatggaggcggctgcggtccgacgggggcgggagaggtggcggcgtcgtctctttctctctctctctgtgaatggtgtcggttctcctggtgatgctaaccgaataggacttggtataacagatgggagtttgtttcctatttttgtggaatcggacatattcttttttttccccgatttttcttttaccgcgttgatgaatcggattcgttccggttttttttcacccggtttttttgacggacgatggaagcacctcttattttttaagtagtagtagatatga

SEQ ID NO: 6912 - DNA, 1501 bp, Oryza sativa
aggagcacctttccctcgtgctcgtcacagttacgcatgacgtctcctactagggtgcatcatccacaggtaatctgtggatgtactgtatagaaactccatgacgttggctaccggtatattgccataagatgaacgaacacattaatagctcaatgaaagcaatcaattaatattagttatgtatgatagatagacaaacatacagatagatgttgccatatgccataattttgaccatgacgtaaatctaaagggttcgccaacacaactagatatacctctacagagtatttgcatgccaagctatgtctatactatagtggtatagtggtattattcgttttgtcacaccacccctaccattattatttgggttccacagtctatactattacaccatcctttaatgatttatctctcgtttcgcagttggctttccccaaattttaaaatcaactacttgtttaataaggaaaatcataaaagtactacttagactaaatatatgcttaattgatttaataagctataaacacaatttgttttccattgtaacgtatgggctcttgaatagtgtactttactataccaaaagaaatagtaataacaaagtatttatagttatagattgatttggcttgtaaaaaaagtagcatgctaataatgttttggagcgaataaacaaaaattttgacgtaacttttggcatctttggccttttttttgggagtgaatcgaagagactgttcgggcatccttgtttccatcaaggacagtaatcacggaaaacagagcgatccattatcatatgattaattaagtattagctaatttattttcaaaaatagattaattttatttttataagtaacttttgtataaaaacttttaaaaaaacataccgtttaacggtttgataaacgtgcgcgcggaaaacgaggaggggttagaaaaaagggtgccaaacacacccgtactgtcttgtgtcgactacatacaacttaaatccgttagcaatggtagagagcgaagtagcttgcactaaagaaagagaagcccaggctgactctctcaagcctgcactgcactgcacgtattgaaacttcaagagagctcaaattgatgagtgctaattaaggccgtgtttagttgttttggcaaaaagaaaattaacgtatatgaatacacatttgaagtattaaatatagactaataacaaaagaaattatatatttcgcatgtaaacggcgagacaaatctattaagcctaattaaaccgtcattagcaaatatttactgtagcaccacgttatcaaatcatggcgtaattatgttcaaaagattcgtcttgcaatttacatgcaaaccgtgcaattgggtttctttcgttcacatttaatgcttcgtgcatatgtccaaatatttgatgtgacggaaaagttggaagtttgaagggaactgaacagagcctaaacataattcaagtaaggcgagagat

SEQ ID NO: 6913 - DNA, 1501 bp, Oryza sativa
tgacaacaaaggtttcactgtttaatctaatcttgttgatttcatgacatcggacctccagccgatgtgtgctttaaccttcgaatcaatacttgttctactatatcatattgctagccgattggtttatactggattatattgctatattattacttatcatcatcaaccgattgcctttatatcattatctacattggacatatagccgattgcttaaaccctatcgctatcggctagtatcagcatcggcaattatcggctgtcggctggaactactttatcggcttgtcaatgttaacagttaaatttggtaagcccggagtagtcatcggcttagagtcagcatcggcttcgaagtcctgagattagccgatgagagttgtcaagtcgtcagttgtcggattcttgctatattcggttaaggaaattgatctactaaagaaagcttatctataagagaccgagtttaaagagaatatggcatggcaaattatctattaattaggaatagtttgttagtttccttttatctttaggaaagtgtgtttagtgtcctgtaaggactttatcttttccttttatctttaggaaagtttctttcttgtccgacaaggacttgtatcaacccataggtaaaaatatatacagccagggtttatgtaatctatcctcacgatcaatacaattcggcgcatcgccaccttttaccttttctactttattttatcgtccggcgggacttggcacctgacgcggggctgcatcagtgttcgatctcccgctaaggggtaagtctaatgtttcgccggcccaggcaattgtatcgtttacgtcggcgtcattcaaggccgcatcagtacattcgacctcttggattgctctggtttggatgatatatttgcctacctatttatcatatgtctctgttaatctagtcttagcatatcaatttagctctatcgtctgcttctcgttttagggtttctgccgttatcggctaaattgcgttgctagattagattagcttagacatctatcaccctgcaaactcagtcaacggcttgattgtctagatattatgtttcttttcatacttagtgctgtatcagttaagtttgatctactaagtcgtgcttagaaccataatctctagcctgcttcttgattgccaataaaggtttcatcggggtttcagccggtgagttatctggacgttgcatcgactcataaggattataaatacatataagttggatttagccgatgacaacaaaggtttcactgtttaatctaatcttgtggatttcatgatgtcggacctccagccgatatgtgcgttaaccttcggatcgatgcttatttatcatatcattatttgccgatcggtttatactggattatattgttattttattacatcatcatcagccgattgccattatatcattatctacattggacatatagccgattgcttaaaccctatcgctatcggctg

SEQ ID NO: 6914 - DNA, 1501 bp, Oryza sativa
ccgttggatggaggtaaggaagaagctcacgccgtccgatcatgcggttaaaataagacaatggaacactctggaaacagtcaacgggagttcaaaggatataaaatgctactaagaaataaaggaatgagaaataagataaagcggccataagggtggcgatcttcgggactattcaaattgtagctaaataaaccttatcaaattttgattatgtcaaaatttttataagttagcaatattactaaaattttggcagggtttcttatgtatcaccaagtttaacaacgaattaatatatgcacttttttttaacaattttacataaaaaatggtatagttgaaaattacataacagccccctcttgactcctcatcatgcgacatcacacatcgtcgcctcggcctctgcagtatcctcctcccccaaatacctcctcttccactgtttcctttgctaaccactccggtactcccgatagatagacggagggggataagggtggcggaaacaattgttggaattaatatatgggctaaggcccattcgaagattaattctttggaaaatcacaaaagcccacctcatgggatagcatgcatgtggagtttagtaccaccttgcgtattctaggagaggggaacctcattaaaagggaggatgccctcctagccacttgaagcatgagtggtggagagaagaggggaaacacacacgcttgcctggcctggtagggaagggtagggcaggcggcgcgcgtgcacgacgtacgcgtcgaatggtccgcaaaattggctcctcacccttgcgcagatgcagcctccttttgcagttttgttttgttttgttttggaaacattccgaaaaatccggtgtgtgaaaacggcgtggagtccggataagttacgcgcgaattatccggttcggttacgcggagtggagatcgtgcgggcgccctgatcaagcgacctatctctatataaaccgagccgccgccttcacgcaacacacgcaaaatcaatctaaggtttgcctcctactctgtactgcgccgtccctcgtagactactccatcccgctcgccggcgtgcaccggcaatcgggagagcaggtctccggaacctctgccttcgacgtcctgcaccgggagaaggcggcaataaggttttttggaagcgcttcacgcgactactccctgttcgtccgcgaaggctcgccttcctctccgctcgcgtgcttcgcgccttcgtcgacgctcgcaaccgcgagtagttcctgccgtgcaacccgtctttccgccacctcggtacgtgttcgacatgttgcgcatatttgatctgttcatgttttactacttagtttacatgtttagatctaatgatgcgttcaatctagtttacatctacaatgtcatgatttatttatggaataaattaaatcattatgtgcttataatttcaacaatccaaaaaccttattataggcgctttgattttacta

SEQ ID NO: 6915 - DNA, 527 bp, Oryza sativa
taggatttagtgggctctaactttatagtaagaggatatgtgaaaatgattataaaaattttgattaattgaaaaaaagtaagtaggtgaagaaattaaatggagaatgcttgtaattagttgaaatgatggggcaagggagaaatacacataaatgtgttaggtgtcggttgggaagcccacatagatgtttggatttctcaacctacgcagcccaagaggcattgatatggaggaatcaactgtggcagtttacgaactgacacctttgaaactccacaaatgaaaagacagctcgatgtatcggctcaaaacgagccgatgcatcgagcccctccccattacccaaatcacacatcagaaatccacataccaccatcaatccatcctacaacatccccaaatcacataggacaaatcaccatggatccatccaacaacaacatccccgcacaaatcaaacatcataaatcacaaaaattcattctgaaatattggcaatccaattagattcctactctccacca

SEQ ID NO: 6916 - DNA, 1501 bp, Oryza sativa
agccagatcgagttgtgtcgccactccgcccaaatcgactgtttgtcaatacctatcggatgatcaggacctaacatcccctcatcagttggtatcagagcgcggttgcccgttaggtaatttatcttccaataaccagaaaattgccacacaaaaatatttattctttacctaaacaatttgagccgttgtgttgttctattagattttgctttgttgaattctagattgcatcgtcgtgtcgagtgctagtttagttttagatttaatttttagatttgagtattgtatctgttcatcacttaggtctaggtctagggttcatcactcaagtcggtgtgagttgtacgtcagttttggtcgagtttttcatctcgtcggttgttgccgggaccttgaaaagttgaatcgtctcgttgtcgggtttccgtttttgtagtttggagatgtttttgtcaagcggttttggagttgctcggttgctaggggtccggttaccgtgcttgtgtatgtcggtgtgcagtaccatgcgcaggtagaaaagagaaagaggaggttttcttttggttgggaatagcagatcggtttatgttggttgaggataaattatctaaattttcatgtgggaccaataggaaaccaagccgagtcacacagtggccaatccctctcatcctcacgttattttccccacataaaggcggacctctgttacatcttggagaatttttttttatgtcggatttgagatatttttgtaaaaaagaaaatgacatgagcaatccatttttgaggtgatccaattttagttttgtactttgctgagtcccaataattttcatatttacatttgagtccctgttcgaggtcagtggttagttactgttgaaaaaaaaaataataataaaagaaaaggcagaaggtgcaaagaaaaaggaagaaaaagccgcaccaagaaaaaaaaaaggcagaaaggtgctaaaaaaggcagcaccaagaaaaaaaaaagaaaaatcattcatcctttgagtatgttttgagagtgcagagttgtgcattgattcatatctagtccttagtattgtcgggtgcttgcttgagctagagttgggtctaggctaggccagcacattgactagtactttgaactattattgaactttgtattttctgattagcacaattgcgttcctttgctactatatattgtgcctcccaagctctacatatatacttctggtcagcaccactttgatctttgcaatcgccacatcacatccttcgaggtgtcacgaactagccacggttgtaccgtccttagcattgctggtaagacacttgtaatagcttgataaggtgctccatttggctgagttattgagaggcaccactacaccgtgtagcagattactgtttgctgctgtttttgtgtttgcaatgacaggtatgagtggcgctcaaaatcagcgataccaacaaggtaacaataatcgcgtgcccg

SEQ ID NO: 6917 - DNA, 1501 bp, Oryza sativa
caattgcctgggccggcgaaacattagacttaccccttagcgggagatcgaacactgatgcagccccgcgtcaggtgccaagtcccgccggacgataaaataaagtagaaaaggtaaaaggtggcgatgcgccgaattgtattgatcgtgaggatagattacataaaccctggctgtatatatttttacctatgggttgatacaagtccttgtcggacaagaaagaaactttcctaaagataaaaggaaaagataaagtccttacaggacactaaacacactttcctaaagataaaaggaaactaacaaactattcctaattaatagataatttgccatgccatattctctttaaactcggtctcttatagataagctttctttagtagatcaatttccttaaccgaatatagcaagaatccgacaactgacgacttgacaactctcatcggctaatctcaggacttcgaagccgatgctgactctaagccgatgactactccgggcttaccaaatttaactgttaacattgacaagccgataaagtagttccagccgacagccgataattgccgatgctgatactagccgatagcgatagggtttaagcaatcggctatatgtccaatgtagataatgatataaaggcaatcggttgatgatgataagtaataatatagcaatataatccagtataaaccaatcggctagcaatatgatatagtagaacaagtattgattcgaaggttaaagcacacatcggctggaggtccgatgtcatgaaatcaacaagattagattaaacagtgaaacctttgttgtcatcggctaaatccaacttatatgtatttataatccttatgagtcgatgcaacgtccagataactcaccggttgaaaccccgataaaacccttattggtaatcaagaagcaggctagagattatggttctaagcactacttagtagatcaaacttaactgatgcagcactaagtatgaaaagaaatataatatctagaaaatcaagccgttgacttagttttcagggtggtagatgtctaagctaatctaatctagcaatacgatttagccgatactggcagaaaccctaaaacgagaagcaaccaatagagctaaattgatatgctaagactagattaacagagacatatgataaataggtagacaaatatatcatccaaaccggagcaatccaagaggtcgaatgtactgatgcagccttgaacgacgccgacgtaaacgatacaatcgactgggccgacggaacgtagcacttaccccttcgccggagatcgaaagccgatgcagccccgcgtcaggttccaggttctgtcggatgataagtaaaaacctcggtaaagagggtggcgatgcaccgagagtagttgtattcatcgatagattgatagattataatgacctcgggtgtacatatttatacccacagggagatactagtccttgtcggacaagaaagaa

SEQ ID NO: 6918 - DNA, 1501 bp, Oryza sativa
tgtagttatctcctaaacttatataagttttagcactttggtaaaattaggacggcagcaatccaaattcgccctaagaaacgaatcaagaaatagaggaacaagacccgattttcaagctataatctatcattgttcgtaacatgacaaggattttttatccgtcccccgccccctgcctgtgacgtcaccagtgacgcgaaacgccggccggcacgagcccggcacgtacgcctggtcctactattcctagtcctagcagcgtcgacgtcttcgtccgctacgtacctgactacccacctgcacgtcagtcgtcaggacgtcacgtcaccgacacgtggggcccaccccacccgcagctgataaaccggtacacacaccgtcccgtctgctttgcctcgcgcgcccgagctgagacacggcgagcaacacgatggccagcgtcgacggagcgacgcgccgcggcggcggcgatggaagcatcaggcggcgccgggtgctggtgttcccgcttccgttccagggccacatcaacccgatgctgcagctcgccggcgcgctccacggccgccgtggcggcggcggcggcgagctgtccgtcaccgtgctccacacccgcttcaacgcgatcgacccgtcgcgctacccggagctcgcgttcgccgaggtgcccgacggcatcccgcccgacgtcgccgcgaatggtaacatcgtcgacatcatcgtagccctgaacgtcgccatggacggcggtgagtcgtcgccgtccttccgcgacgtgctcgcgtcggtggtcgccgccgacgacgaggggcggaagccccgcgcgtcgtgcctcatcatcgacggtaacctcatggccgcgcagaagaccgccgcgagctcggcctccccacgctcgtgctccgcaccggcagcgccgcctgcctcggctgctacctcgcctaccccgcgctcctccaaaagggctatttgcctcccaaaggtcactaccaaatcatcatcttttcacatcacagttttccatttcattttgaatccaaacaatcctttcgttttgcattcatgctctaagttctaactacatcattgtggagtggaggccgggttttatattgtggctttgtacatcccttgagatatagaggccggcttttatttaaatccactgtctaattaagagaaacaatattattgtcatttgtttcagagtcgcaactctatgaaccagtggaggagctaccgccactgcgagtaagggacctgtactacacgagcaacgccaaccaagaactggtccgtaaagttcttggttggatcgccgaaacggcgagaaactctaacggtgtggtgatcaacacgttcgacgagctggagccggccgagctcgagaggatccggcgcgagcttgacggcgacggcgtcgccatcgtgctcgccgtcggcccgctccacaagctctcccccatgaacgccgggggcagcctgcacctgtgcccgg

SEQ ID NO: 6919 - DNA, 1501 bp, Oryza sativa
ctcgcgttcaaacgggcggatttgcccccgcaaatctcgccggcgccattgatggcggccggacctcccgcgccggtttccttcccctccgaccgctctctcccccttccaaccctatttaaaccctccccgcccctcctccgtccgtttccgcctctcgccgcccttcctcctcgccggattcgagctcgcgacgtcgctctctctctccgccgtcgccgccgagctccggtccgccgccgtcgtcgccccggaccgcctcccacctcggcgccgcctccttcgggttcgccgcatcctcgccaacctcgtccacctctccgtttcggtcgccgaccgccggaatgccgtcgaccccgtcgacccgagccgcgccgccgcctccctccgctccggccgcctcctccgtcgccgccgtcgccccggggtgagccgtggaccgtcgcctcctttcccccttcccttccctctctcggcggccgctccgccgcgccggtggtcgccggcggcgaccatcggggcacgggcgcaccgtctcccgctgaccgtgccggcatggccgccctcgggcgcgccgtgtagctgccgcgtggggccaggccatcagccgcccgcgcccttgggtgcggctgacgcgtgggaccgacggcgccggccggtgtgagcccgggtgcacccggtccaccgtggaccgtgaggctgccgcgtgggccccactcccgtggacccggcccgcgcgccccctcccctcggctgacgcaataaagcctttttaaattaaattttaaatgaagaaattcgcaaatattcatttaaagagcatataaacttcaaatggccataacttggccatttgaactcggaattggactgttcaagtctctaatttttccttaagaagtcaataacccatttttgtactttgttcctgcttgttatatggagttttttagagtaaaagtcttttcttttccgttggtcgtgtagacgctgcagcttcggaagatccactcttcgtggaggttgaagccgacgtttgggaaagcgagcaaggcaagtcacatcatccttgaacatattgaatccaagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctcgacactatggaattgttggattattgtggaattggattcacacctcccctctattcaaaaccctcaaaatggttttaggctgggctcggggtgcatggttttgatagtagcacctcggccatataaggaccggt

SEQ ID NO: 6920 - DNA, 1501 bp, Oryza sativa
gtaagtatttaatccatctcctactcaaaagtttgtgaatggttttctaagatatcttaagaaaaatagataccttaaattattataaaataacattatccaaactttagtttgccctaaatctattagaaaaaatttctgaacaaacaataatcttaccttttaataatataagtgcccacgcatacgcgcagaccaccttcctagttgttttaaatgatcttggatggacacatgctctacaccgaagctatataattcaatgggatgtgcaactttgtaggtgacaacgttttctttggaaaacaattacatgtccgaatatgtttataagttctcattaaaaacagattttcaaattttccaaatgacacagacgagatctacagctttgtagttgatattttttcattttaaacgatttaaagtgtgaaatacgaattgcaagttttagagagaagttaagtaaaaaggaatatcatcatttttctctaaagaagctatcataccatgtttggatatgtgcatagtacttaaacactcgtgagtgttctcaatggttatattaccttgatttaataatcatgttagttgaataaaaattccttttatctttaagaaaacatcaaactgtttcacatgacctcgtggactcttaggtcttgtttgattaatgggctttagggaaatgatttcccacccaccaaaaggcatctttgaatgctaactattcattctctctcctccatttaatcctaacacttcttttatttcttaattccaatcccactccttattttccattatctaacatacccttaaaatttacaaacacttcaatcttgaaccggagccaatactacattgtaatatataaacattcttcgaattacatgtttattcaaataatataccactggcactatttaccattttatatatttttttgtgttaaaaaatacatatgttcctttgtacaaataatttttttgaccaagcctttgtacaaataattcatcagttgcttattttatttcaggatattcattgggccaaattgacagctgttatttatagcatactttgtgtgctgtagcaccaattctgaagaatccaagtcattttaggtctgcagaatttagttatataattctcttactactttgaaaatgtcatttgcttacatcgttcatacttctactcaaatttctctatgctttgtttttgtgaaactcttatcagatacagttactccttttcaacagcattgacatcaaagtccatgctcagaatcgtaacaagcttgaaatgtctgaatatacgatcaggttaggatgttatcaaaattccagcatgttcagacaagagacagctgaaacaacaaaacagtaggatattagcaactgcaaatctgcaatataactacataagtaagtcgacttcagtgcacatagttttgtagtagaaccatcaagttcatataacagcgaaaacaggacta

SEQ ID NO: 6921 - DNA, 1501 bp, Oryza sativa
  unsure (1)..(1501): unsure at all n locations
gtcgatgatgaggcacgacgcgcggggcttccgcccctcgtcgtcggcggcgaccaccgacgcgagcacgtcgcggaaggacggcgacgactcaccgccgtccatggcgacgttcagggctacgatgatgtcgacgatgttaccattcgcggcgacgtcgggcgggatgccgtcgggcacctcggcgaacgcgagctccgggtagcgcgacgggtcgatcgcgttgaagcgggtgtggagcacggtgacggacagctcgccgccgccgccgccacggcggccgtggagcgcgccggcgagctgcagcatcgggttgatgtggccctggaacggaagcgggaacaccagcacccggcgccgcctgatgcttccatcgccgccgccgcggcgcgtcgctccgtcgacgctggccatcgtgttgctcgccgtgtctcagctcgggcgcgcgaggcaaagcagacgggacggtgtgtgtaccggtttatcagctgcgggtggggtgggccccacgtgtcggtgacgtgacgtcctgacgactgacgtgcaggtgggtagtcaggtacgtagcggacgaagacgtcgacgctgctaggactaggaatagtaggaccaggcgtacgtgccgggctcgtgccggccggcgtttcgcgtcactggtgacgtcacaggcagggggcgggggacggataaaaaatccttgtcatgttacgaacaatgatagattatagcttgaaaatcgggtcttgttcctctatttcttgattcgtttcttagggcgaatttggattgctgccgtcctaattttaccaaagtgctaaaacttatataagtttaggagataactacacagtagtggtagctggttgngtctaaaccanctaccactccatctatgagagactctatacacctatacttcaaataaaattttctcttaaactactcatccgatttacgatccgattacaccgttgtgttcgtaataattaaatctttataacaagatctcacatgattatattttgatgaaaaatcataaattacttttatgatatgtctaaattacttttagatttcactaagttacttcttagacatataaaagtaaattcagcaaagccaaaaggtaatttacatatattatagaagtatcttagaacaaaagaaagtaactttaatgcatgcatttttcattggacatgactacacagctagtcgtagctggtttatactccatctagtgtctcctttcaagttgaaaaatacaatagtatgtatcttatgtgtgtcagggttacgggtcaggcataccctctacccttcgatatacgttacatatcgacatggcatacccacgcgcacgcggatgttttctacatatcctaaggaaacctttcacgaaatctacagatgggaagagtccttctcggacagaactgggtcgtcggcgtatcgtattgggtctgatatctccgagttctacttggagacctccagatct

SEQ ID NO: 6922 - DNA, 1501 bp, Oryza sativa
gtgagtgtagttgtctctcagtttggttcgtacaataaattaggagaaattgtttctaggcaacaattagctaaatgtgtttttttttctgtgatttgtaggccaattcacagtgagtcgaaattagttgttagcgtcctatcattttttagctttccaaatggagggccaaagacctatgtccctaataaaacgttgccaaaccaatatgttgacatgcataactatggtttgctagaattaattaatttcatagttgagcacttcatatgatgttataagcagtacatgactttgtggcgttctttgaatagtgactctggtaagattaaatcagatgaacaaatgctatattggtttcaactgaacctacgtaagggggttgtatgcattgatgcacaaataattgattttgatggttattttgcaaattgcactcataaaaccgagctgtcatctttcagtgagaaatagggcatccacagcctccaatgagaaagccactgcaattatgctttggctttcattgcgagagatacagatggatgattttgtggataagtgcttctttgttgagatgttaaaaaaggcatatgcttgaaggttcaatttttcaatggaatctaagtatgggtggacacacgttgatctaggctataaaatcaagaagcctagattgagaaagaaaccgggaagatcaaaagtggctaggataagggtttttttttataaagatggcactagtaaaaggaaaaaaatacagttattgtcatgagctataccatacaaccaagcattgccagggaactctctcagcaagtcaaattgaaacaggagaggggatcaatggcccaattgttgcacccacatcagtgtgagtcattcattgctactcgcatttatccttgtttttaactaattcttaaagattttgtttattttattattgctgatttattcatttgctagtgcaagtggaactacaagtgaaatgggaggaggaataccctgagtgtgtagattatggataccccatatctacgtgacagttataatttagtcggatatatggtaccaaatatagatagaatatctatatgaggactcgggttaggttctaaacttgtatgtcaagaaaatacccgggatcctagtcggttacgattgtattttatctataatcccatattccgttaggatatggacggtactttgtaaagcggactccttcccctatataaggagggtccatgtgcctctcggggcgcgattctttttctagtttatacaatcaataacacactcggcggaattatcctcggacaggagtagggtattacttcttgaataagaaggcctgaatctgtataaaattcttcgtctccaaacccatccactttcctagcttgatagccacccccttttattattgtcgaaatcttgtttcgacagttggcgcgccaggtaggggtagcgtcaagtttttgccgactaagtgcga

SEQ ID NO: 6923 - DNA, 1501 bp, Oryza sativa
ctgcatgcagcgtgacacgttcgaccagaccgcaataaatggtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtggacgattgtgtctgcctcaagcctctggtcacgatactcccggtcccatatcaccgacacatgttaatttgtagaattaaatagattgtagatgctcttgcatgcttgcatgaggttgaatatgtaattatggttagtgggtgatgatgtggtatggttgcatgttaagctttagagttagtgggctataagtatagataagagatatgcaagctagggttgtttattttgtttgtcttttctcactgtcctcagaagcaaatgtataggaagttaattcgtaatattttcaaattccaaaattgaatatgtcaaattgcataattttaaatgactggaatcatatccgcacgttgcaatggctcccatctaaatgtactaaatctataaatatcaaatgcaacaaataattatttatgtacaaattataatatttatatttacgctatgtaggagaccaattcatcacctataaatgtaccatcaccgccaactccctcctttaaaactaagaccaagtaagaagagccatggaaaatagatatgacattgatagggatagtatatataattatatacgggttgtacataaattaaagtaaagttgagcccgaaatttggccactattttcaagtctgagacatacggttaacctttttccttctgaaaatcaacgtgtaaatcaaaccctagcgaggcataagtagctaggcttatcgaatctatactatatatatatagttgatactcagtctacttaatctcaacatttaagtatgccacattatcacccactagcaattagtattatctaaagtatttaaaatcacgtacaagcgtgccacatcatcaccaagtagcaattattatttaagagtattttaaatattatacaaacatgacatatcttttacaattttgttgtatttttagaacttaatatcaaatcattatctccacatcattttaatattatttaaacatatacatatatcgtttttataatgtataatatgtatttatccacatatcccacggcaaaatgcaaagtatataactagttacctcatgatggtttacaatttggaagcatcctgagaggcttatttaattttgttgtcaaaaaataaaggaaacaaaatttctaaatacatgcatctttagttacttctgtcctctatagctacaaaaaatatatatgcactcagctgatccatcatccatgcattcgcatataattgcatccaatgactgatctcaattcatttccataaa

SEQ ID NO: 6924 - DNA, 1501 bp, Oryza sativa
tctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacaatagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccacattagaacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagactgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagt

SEQ ID NO: 6925 - DNA, 1501 bp, Oryza sativa
tgggactcttatggacgaagaaccacgatgaaaaatggagagccacagtcaatccaaatgaaccacgacgacgtgttaattagtagaacttagaacggcacccgatgaaaacttggatcaataatatagtactccctctgtcccatattataaggaattttgagttttttttattgactactcgtcttattcaaatttcgtcttattcaaatttttttgcaaatataaaagacgaaaagttatatttaaaatactgtagataataaagtaagtcacaaataaagtaaataataattttaaaaatttttgaataaaacgagtggtcaaacgttgcaagtaaaaacttaaaatcccttatattattggacggagggagtatcttggatcgtacgtcttacacatgatgacaagacgttgatggcgtattgatcggtcgtctcgaatttaagatcgagttaactgcggatgcaaatttgtcacatcgtgtcgtgttcaactattcatattcgtcagtgtcacgaggattgcgctgcacagactgtaaaggaaacctgtggcatactcccctccgtcaaacaaaaaaaaaaaagacaaaccctggtttctgtgtccaatgttggaccgtcttatttgaaaaaattataaaagaattaaaaagacaagtcacgcataaaatattaatcatgtttttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaaacatgtgtggtggagagaagaggggaaacgcgtgcgctcgctcgcctcgcctcgcctggcagggcgacaatcaatctagggtttgcctcctactctgtactgcgccgtcgctcgtagactactccatcccgctcgccggcgtgcaccagcgatcgggagagcaggtctccggaacctctgcctttgacgtcctgcaccggcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatatcatgatttatttatggaataaattaaatcattatatgcccataatatcaacaatccaaaaaccttattataggcactgtgattttacta

SEQ ID NO: 6926 - DNA, 188 bp, Oryza sativa
ggatcccccggtttttctaaataacattcatcgacaaaaattaaaattttgaaccacatatcacaactggactgaaagaaatatgcttaaattaaaatcctaaatcatatatcacaactcgactgaaggaaatataataataaaaataacaacatgaaactataaataactttggcccaaacgataat

SEQ ID NO: 6927 - DNA, 1501 bp, Oryza sativa
caatcgagaagaagctagggttgattcagtgcaccgaccaggagcgggttggcttcgcaactcatcagctggttggaccggcttcagaatagtgggaagtgaaccaaatgtaaagaaagtgaatccgagttgcttgttcatgagagctattcccagttatgaaccaagtgatatgttcgaagatagtctatggaggtcagattaaaatcgcatctaacaacgaagcttcagatttggcaggataacgatcagaccataacaagtccagcagcaaagtcatttggggagacgtcaaagcatgtcaagtgggataagttggttctttttagaaacataattcaaaggcaaagttaccgacccttgcatcgaatagcagaagtagctagcacctggagagcaggaaagctaatatgaggcagttggtggcaagttagaagtaaatgacaagcatggtatcctagtaatgacgagctgatctcgacgcatgacatgaagtgggtaacttgtatgaggttgactccaaagatatgaactatgcgaagttctggaactgaagccccatcttcaagcgccgcaacccagtcgaagtcagctaaaggttcaaccagggacaagtcaggcgaagagaagattccatctgcaacaagggatcgagccaagcagcctagagtggcgaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctcataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagcccttaaattttacttgaattttcagagcaccggaaataattattaagcaacaaaaacaattatcaaagtttattaaaaagaaaaacctaaaaaataatcctcttcctcctttgggccaagcccagcccaaagtctccctctcctccctctctttctctccctctccttctctccctcctcctcttgggcctcctcccctcccggcccactccctcctccctctctctcccgggctgcctctccctcctctcctcctgggccggccgctcggcccaagccgcgccccctgcccgagccgcccctccctcccgcgcacgtgcgttgcacgcgcgctgagcgcgcgccccgcgtgggacccgcctgccaggcgtttcttcctcctcccgcacagcttctctctcccccgtgcgaaccctagctcgctccctcctccaaatccgcttgattcacttggttaattccaaaattgattagggggttttaatccccattgattcctcttcaatttcccccaatttcccccttgaa

SEQ ID NO: 6928 - DNA, 1501 bp, Oryza sativa
ccggataccacccaaatccaccatccgccccggtctaaaacataggtttttaattcctttcatgtcaccattatcatggcaatgtggtgctcatgcctccacatgccgcatctcaattaccttcccaaaggtaattgcccaagcatatagcatttgataaatatgaacatgcaagattctagaatagcattttctaagcaagtgtcataattgactagggactcatacgtaattatggttacaaggatttgaaggaaaacaataacaaggcatggcataaccacaagtgggatgttgatcattgcatgcaatcttgtttgtaaacaaaattaatttcgcaattgggatcaacgtgatcaaggaatagtgatgacttgccttgctcgaggtcttgtgggtcttgaccttcgcccggatccgcggctccctcggtctctgtagttacgtgcgtaagaacaatttgaattcgattagaattcaaataaaaatccaagtaaatccaaatggaagtcgaatgcgaaaatcaattctcttatattatctttactattcgcgaattagggcgaaccccattttgatttaaactattttgcgtgtataaatattttgttgtcataagtttttaatttaatcaacccgatcaatataccaatataataggctagaaatttctattgcgagctaaacatcggacgaaatcctagaaatattatacgacttaatttagtctatgattaaatataatacacggctaaaatccctagtaattaaatacgaattgctaccgttaatcgattacttatagagattacccaaaaataatccataataatttacgagaattcatacatttgtttagttattaattacatctaaattactaccgcgaattgatttcttatagagattactaagaataatctataattaaattttgcaattctacgactataactaatctataatcatactctaattattttaaattttctaaacttcccaatctccctctaattccctatttacttctttttttcctttttcttttcttccctttctttttcttttctttttctctttttctctcttctctcttttctttcttttctttttctctctcctttcctttctcctcccggcttccttctctcttcctctcttcttttctctctctctctcggcttcttcctcccgggcggcgatgacgatggacgcagggggggggggggcggcggcttaccgacagcgacggtcggcggcgacgacagcgacggcggcgcacggcgcggcggctccgaggcgacggcgcggcggcttcgaaggcggcggcgcgatggcatggcaacagcggcgcggcggcacaacgacggcggcgcgtggagaagagaaagaaggaggggaaagatggggatgggtgtggagaggcttggggatggaggggaggggtttttgtagggcgtggagaggaagaaagggaggggaaggaagagaggggaagggg

SEQ ID NO: 6929 - DNA, 1292 bp, Oryza sativa
cgccagataaatatgaacacaaacatcaagagtgctggttgaaacaggtatcatcatgttgtcttcttttatatttgatgacggggtagttgggtacttcctattctgctttggagataatgattctgaaaattatacctaaaaatagagggactcatcagttcctgttatgttctttccatataactattttgtcctctatatttaaaaatgactgcatacattgaatctaattggtggatatattagaagttatcatgcatatcttagggcatggccctgcttgtaacttggttgtggtggcttggaggacatgcttgttttgtttgccaaacaaaccaaatcaatttggtaacagcaaaatctcacattagcaaaatttggtaagctaagcagtttccagttcctgaatattggaacatggctggacaggctggtgcataagttgtaacttttagatcacaaggtaaagtatggcacagtacttttgctgcctttaatttagtagcgaattcaatacttaaagtggcaaggttggtatgttgaattctccaatactgaattcatgatgctattcaacatttagttacttgcggttgtaggagaatcttgttttgcaacatggaagttttaatgcgttgtactatttttttttgcggggaatattgtactattttttatgcaattttatcatatctttgccaataaaggttatagaaatgcaatccgattatcttaaagtactgtatttaactgtaatatttctgtggattatttcactgacaattcctttcagatgaacctgcatttgatgttgatcctaaagattgggcctcatactgccaaagaatagcgaagtaactttgaattcattgtttgcatgcttgcaggctgatcaccctaaattgaacttcaaagacaggtattctgagtcgtacagggatgctcatccatctgctcccgttgttgtgccatggatgtcaggtgtcatcactgtatgagctgcctacaggctatctagtatctactgcctgcaggagacaggaactccgttcggatgtgcaacgccacatcaaatttggtacagttccacgaactcatataccaattatcaaaattcttcttggcttttgtagtctttagattagtctagacggttagctagagttcatgtgagatagctggtgtattttttggatggacggttggtggcgaactctttttcgaagaagaaaaagtagaaaaagtagaaaaagagtacaaatgattcaagttgaaatcattgtgtttgc

SEQ ID NO: 6930 - DNA, 1501 bp, Oryza sativa
ctcctccgaaataatcttgccgctcatcatcttcaacttttcccccatggggtcataggacgactgctcctccccatccaccaaaggaagcttcatgctgctcaccatctttctcaccgactccaatttttccccctccgccgcccgttcgtagggctagctctataatttcaagggccctacgtgaactcggtgacataggcccttaaggttaaatattttttatttgtaatatgtaactgtggtctaatctctaaagtgacaaaaacaatattactaacatagtaaataataaatcaactagttgtaaattgttatataatattttattcttgataaacaatgttgatagtatattagacaataaaaaaaccacagaaataaagtagtctgaataacttatataaatagaaattgaagacaacaagatccgatgtgtattgtaaaaaagaacttctagttctctttctttgcaaatcaataaagttctttagtttctttagcaaattaatcgacaaatgcttgtcaagtaatattgtactaacacctaaaatagtggacttgccatgtaagtaaatcaaaagaagaagaaaatcataacctaaattttggagtaaatagattatagatgcagtgagccttttttgcaaacaagatcaagaagcggagactacctggctgctggttttgcacttatgcttgacttgtcttctctcgtcgtctcgctgcaaagagaagggacagatcgagggttgcggccgtcgcggtcagggagaaaagagagagcgccaggacccacaaaccgccacatcgcgcgttgccctcgatctcaatactcgattcctgccaagtgactgggcctgttgggttggaggtggtgatggccccccctccactctggccttaggcggtcgcacaactcgcctaggcccagggccagcccggcgccacagattagggctcctccccctcctaattctttttatttttattaatatacattccgaaaaatatttctaaaaattgaaccaacgattgttttgccacgccagctatgcgtgacgtgacaaagtgatttagtcacgatctggtgtggccaaaaggttcagatttgcaaatacttttcggaaaaataaaattaaaaaaataaaaaggtctgaaaaaaactatccgaactgagattctctgccttcaaagacaccgtgtctatgtcacggacaagcgggtccatggtttatcgggtccacacatcttcgaaggtagaggagcctgatctctctcccctcccaatccggtcccaccccttcttatgatttggagtactctgcagaaagtaggttgtacaagtttcattaaaaaaaacttcctttagtgatttcccactcatatattccgaactgcttcagattttaaactaaattgttttctaattttctttcataaacaaataaaaagattgcacgtcagtaattagaagaaatagagtatttttgttacacaa

SEQ ID NO: 6931 - DNA, 890 bp, Oryza sativa
ctgcaagcatgcaaacaatgaattcaaagttacttcgctattctttggcagtatgaggcccaatctttaggatcaacatcaaatgcaggttcatctgaaaggaattgtcagtgaaataatccacagaaatattacagttaaatacagtactttaagataatcggattgcatttctataacctttattggcaaagatatgataaaattgcataaaaaatagtacaatattccccgcaaaaaaaaatagtacaacgcattaaaacttccatgttgcaaaacaagattctcctacaaccgcaagtaactaaatgttgaatagcatcatgaattcagtattggagaattcaacataccaaccttgccactttaagtattgaattcgctactaaattaaaggcagcaaaagtactgtgccatactttaccttgtgatctaaaagttacaacttatgcaccagcctgtccagccatgttccaatattcaggaactggaaactgcttagcttaccaaattttgctaatgtgagattttgctgttaccaaattgatttggtttgtttggcaaacaaaacaagcatgtcctccaagccaccacaaccaagttacaagcagggccatgccctaagatatgcatgataacttctaatatatccaccaattagattcaatgtatgcagtcatttttaaatatagaggacaaaatagttatatggaaagaacataacaggaactgatgagtccctctatttttaggtataattttcagaatcattatctccaaagcagaataggaagtacccaactaccccgtcatcaaatataaaagaagacaacatgatgatacctgtttcaaccagcactcttgatgtttgtgttcatatttatctggcg

SEQ ID NO: 6932 - DNA, 1501 bp, Oryza sativa
atcaaaattggcccctgagtctcaccaatgcatttatatggggttaagacaccaagagaaggcctatgaaacataagtctctatcgctaaaccctaaaccatagagagctcgatctatctcaaagcgcaggaaggggttcgtgaggcgatccctgaccagtgtcgccgccaatgcactgaaggatgttgtctacatgatgcatcgagaaattaagttaactatttgtaactattaggtttgacaattatccaaattaccctgttagatttgcttttatttttccccctttaataaaggggtggtttcttaactatttaccacttttgcccacatggcatgccaacatggcaacctagggtgaaaaacagtgtgggatctttactcgtgaaaaaagatcgtatagtgaggaaatcaaaggtactgatgagtggatctcacatttttcaccgtgggttatcacgttggcatgccacgtgaagaaaagtagtaaatactagttactaaaccagttctttagagagaaaaataaaagtaaatttaagaggggcatttgtataattgcatgccaaacctaatatagtggcaaatagttaaatttcccgaatacatcaacccatcggtgaccactagttgatcaagctggtgatcagtagccacagatctcctgcaatctcgagcaggcggatattgcaatatatgcatcaagaaggaagaaaataaaataaaggatggaaggagagatcaaaggcaagttcaatggcttcataaaattaatgcttagtacaaaattaattccgcaatcagcagtggtggtaaggctaagattcaatttctgcaatttagactcttaactcactagtaattagcggatcgagctagcagctggaatctggtatatatgtccgcttcactatttcatttctttttctttccgtagagcatcccagcagctcctctatcacgtacgccattccgaaaataacatatgggggaagaaaaaggggctccagcagatgcgccatcatagcctccaattttagcgcatccaccatcctggagagaggaacgtcaaattggcatctctctctccttataccatcccacaactgtcttccttcggatcaaattcgcgccacaatcagaatcacgtccttcccagattcaggaatagaggttggggaatggaggtagagtggtggtaccaacaggatctggtggaggtagtcggagtagaagcagtgtcgccgcacatcctcctccgcgtgcgccttccgccaccactcccaccgcacctccccctccgcgccttccttccatcaacgctcccaccgcacctccaatttttgcgcccgccttccaccgccgcacctccccctttgcttccgccgccgctcccaccgcacattccctccgcgcacgctttcggtcgccgctccgcccgcttagccgcatcggcagtatcgcacatctatgcggctggggactggggttggggaaagg

SEQ ID NO: 6933 - DNA, 1501 bp, Oryza sativa
aggcaggcaaaactttaaaaacacatgcatcctcctctgctgtctagtgtagttgaagagagaattgaaggggcatcgatgatcgatcgcattcaagatttcacttgaatgccggctaaggacaacagtgtgcatgcaattacgtatatatagtatcgatcctcttgcacccatgcatcctgtccctgtccctgctagctagctacatgcaattgcagcgatcactgccctcttccattccacactacgtactctctgacctctgaacgtctagccattcatttaacattaactagcaccactgcactgcgctgcagctgtggtactactgtttgtcaattcaacgtagacgaagagaaaaaagtacagcttaaagctggaacggaacctgtgaaatttacatgcatgcgcagcggtctaacagcagctcatctaaattggctactccacatctcagtttggatgactatctaataaagattccttttctatatttcttcctacttcaacacatcatccatatcatccttattatacccttcatatcgcctcttatatattttaataatactagaaaaaatacccatgcgttgcaacgggtgaagtctattttaatcttattaatgttatatatgatttagttaagatgaaattcactatgggagttcgcttggatatatactccctccatccacaaaagttgcacctatttcatatttgagttttttcaaataagttgttcctatttgtagtctttatgcattcaagacttaaatgaagagataaattaaatgttttattagaacccaaagagtcatctaaatactcattggttacatgcttgcattcactccttgattttgtaacatccaaggtgatttaatttctccttggtattggtgtcaaaagtaatatgtgtaacttttgtggatggagggagtatatttttacaaaatcatgagctatagttaggagtctgatcgtctcaagttagcatgcgagtttttttaaacagatttcttatatgattccttctgtattaccaaaagtgaacgaccttgaaaatcgacttaaatacggatatgtatttccaaaaggaaacgaacataaaaaccaactcatacacggatgacgtaccaaaataccggcaaaaacatcttcaatttttatatattttaataatatattgtaaccaacttttctatgtacgtgtttttttaaagcctggattagttaaaagaaacaatgtatcactattctctagacatgcttcactgatagttactaatttaatctctcacatatatggatggttgattaataaaacaagtactacgtttactatgaaagcaaataataataataataataataataataataataataataataataataataataataaaaagaagagataacgcctttccccaaccccagtccccagccgcatagatgtgcgatactgccgatgcggctaagcgggcggagcggcgac

SEQ ID NO: 6934 - DNA, 1501 bp, Oryza sativa
gatttatttaaattatagaaatgaatctggacaatcgattatgcatggccatggggaatcgatcgatcgactgatacaataatctggccaaccaatacatgaggatcatatcggatgtattgggcgattatattggataaggcacatccatcgataatcctgcactttatttctttccctcaccctgcgcctgagggacctccgcctatcactctctgctttctagctctctctattaattaggagtattactgcaggcagcacagtaaacactcgctaagtacattagtttgagtacttgctagctagtaaatccacaagtactattatataccagaaaaatatttagtacatattaagttatatggagtatatatgcatgcagcagagagctggcctcaaaatcaccctgcccgtcagcttaattttgcatatatatatatatatagagagagtaggttagatattctacatgcttgcttaacgaagaaagaattgaacgattgagcaaattaattacttctttcctcaaagtagtgattaagctactccagctagctgcttatagtatattattaaccgatcgataaatcggtccacaaacgtacgatcaatcgaattcagtaaattcagcatatatagatatagatatagatagaaattaagatactagctagtagtacatacctttggaagccatggatgaaataagcgagcgaagagcctctgctggcctagatgagatgagcctctgctagctctcaagtcgatctcaactcaaattaattgcctcccagtacttggattctccttcttcctcctctccgatcctctgtctctcgatcgatctcttgtactggagcctgtacctaagctcttcttctccctcttcctcttataattaaattcctcttctttgcccccccccccccggcccctctctctatctctctatatatagtcccagccgccgccgctcaattaatttatcgatcttgtcttgaacaattcagtatatccccgatggatccatccatgaattaattattaatcagatcgattcacttcactgcttaattaattatacacacacattaaaaaggacatatatacaggacaagagatgcacatgtatatggagtgggcgtgtccacaattattatagctagagctagctagctaggcgttcatctgtaatttgtacagtacgtatttgtgaaaccagccgtacagcatggacactccatactctactgtacatccatactcgatcacgtttcatctaaaaatgcataacttatctagtacttatagtacaccaaaacaaagcctcctcgatttagtatttactttaattttattttattttagaagatcttttttgtggaaaggcgaagatctagaccactctaactcgggagatagcctgattaactggcaaactgtctgcaaaccgaaggttctgggaggggctggtctcttggaattagaacacttttct

SEQ ID NO: 6935 - DNA, 1501 bp, Oryza sativa
acttaagaagaaaggaggatcaggggggcttgaaagcaagcctgcgcaagtccatatcttgtttaataaggtgtgctacttcacctactgtgaggcaagaattttgaaaaattcttctgtttctttctagccatatattccaccaagtagttagtaatgagcctctgatcgcttgcacttgatctttgcttcccacagggttggctctagttcaccaagtttcaacatgagggggggtggggcgtagccaaagggcccagattttgaaattggcagattaaactccaagtttgtctagtaaaaatacactcattgagcaggtggtttgtgtcttcaaaagaacaagtgcaaaggcggcaaatccaagtgcacggccaatgtcttcgaagtatattttgtgcagtgagggttttttgatgaaggacaagccatccaaagaatctcattttgggctccgctggagccttccaaagtgaaagaaagtcaagttttgcaaaagaaccttcaaattggtagagatacgcactcttggctgtgtaggaaccgtaatcagtccagttccaggtaatgtcatccggttcttgggatagcgaggccaattgaattaagcctcctagctgtacgagctcatgaatttcctccacggaagtaaattgtctaaaagaggctagccatttgttgtctgtaagttcaagttgcacagatctttgttttctcttcgccaagctaaaacatcttggtgcaatgtcttttgggaagcgattttgtagccaactatcatgccagaatcttgttttggcgccatttacaacctaaatagttgttgcagcttggaagagtctattgccggattcgtcacagggcaggttcatgcccacccaaggcttttcttcctctttccaattaagccataaccaacgaagatgtaatgccctagaaaagtgttctaattccaagagaccagcccctcccagaaccttcggtttgcagacagtttgccagttaatcaggctatctcccgagttagagtggtctagatcttcgcctttccacaaaaaagatcttctaaaataaaataaaattaaagtaaatactaaatcgaggaggctttgttttggtgtactataagtactagataagttatgcatttttagatgaaacgtgatcgagtatggatgtacagtagagtatggagtgtccatgctgtacggctggtttcacaaatacgtactgtacaaattacagatgaacgcctagctagctagctctagctataataattgtggacacgcccactccatatacatgtgcatctcttgtcctgtatatatgtcctttttaatgtgtgtgtataattaattaagcagtgaagtgaatcgatctgattaataattaattcatggatggatccatcggggatatactgaattgttcaagacaagatcgataaattaattgagcggcggcggctgggactatatatagagagatagagagaggg

SEQ ID NO: 6936 - DNA, 891 bp, Oryza sativa
cctgcaagcatgcaaacaatgaattcaaagttacttcgctattctttggcagtatgaggcccaatctttaggatcaacatcaaatgcaggttcatctgaaaggaattgtcagtgaaataatccacagaaatattacagttaaatacagtactttaagataatcggattgcatttctataacctttattggcaaagatatgataaaattgcataaaaaatagtacaatattccccgcaaaaaaaaatagtacaacgcattaaaacttccatgttgcaaaacaagattctcctacaaccgcaagtaactaaatgttgaatagcatcatgaattcagtattggagaattcaacataccaaccttgccactttaagtattgaattcgctactaaattaaaggcagcaaaagtactgtgccatactttaccttgtgatctaaaagttacaacttatgcaccagcctgtccagccatgttccaatattcaggaactggaaactgcttagcttaccaaattttgctaatgtgagattttgctgttaccaaattgatttggtttgtttggcaaacaaaacaagcatgtcctccaagccaccacaaccaagttacaagcagggccatgccctaagatatgcatgataacttctaatatatccaccaattagattcaatgtatgcagtcatttttaaatatagaggacaaaatagttatatggaaagaacataacaggaactgatgagtccctctatttttaggtataattttcagaatcattatctccaaagcagaataggaagtacccaactaccccgtcatcaaatataaaagaagacaacatgatgatacctgtttcaaccagcactcttgatgtttgtgttcatatttatctggcg

SEQ ID NO: 6937 - DNA, 1501 bp, Oryza sativa
gtatctatcaacaatcatgtagtgcacatcataacaagaccagtgatagacaaaaaaataattgaatcattcttttagcatgaacagaaagaatatctatcaatgaatttacatggaaatttatcaaggtatttaaatggaaagaagctgcagcatttctttaagatcgaaatttatcgaggaaggcatttccaaatgaacaggcactgaaacaaactagtatgctgaaacataacaagacaccatgtgctggagtattggagaatataatatttttgagttaacaggacaacaacatactacccgtagtcaaggcaaatcaatattaatatggttacgatgagagcaagcatagatagtacattacatggttgtgcagcggcttgttgtcagtgaggacgttgagggtccggatgccgagggcgagcgccgcattgaggccttccaccagcgccatcgcctccagcatcatccgcccttgctgcgcctgcgcctgcacgggcttgtgtatccggagcaccacctccccccttggcccgcagatggcgacggcgagcaccccgacgccagggtcacggtcacgcggccccaccacctccctgctcgccatgcccttgaacagcacgcggaagagcgcgccgcctccttccagggggaggggccgctcgaagtagtcgccgtcgtgggcccacctgtcctccgggatggcggcgaggtcgcgcgcgaagagggcgtcgtgcgcggcgacgcggacggaggcggcggcccgggcgtggtaggcgcggcaggcctgggcgtcgcggcggtcatgctcggctcgcgcgaggtcggcggcgtgggatttccagggcacatgaggcgtgggaaggttcctccggtggcgcgggggcggcggcattggagggtagggaggcctggatggcctcggtgagctggaggtggaaggcgaggtcgtggtcggaggcggagagggcggcggaggaggcgagggagagctggtggtggagggcggcggacatgatcgactccactcccactgccgtttctttccttctcaaagaagactcagaaaccaaaaaggaaaccgctgctggttgggcctgggcctgggccggcccatcgattattggcccatgtagattttcatttcccgctggctggcgacgcgaggtttcttctccagaaaattcaacttcaattccccatccaactcaaccgcatcgccggctcgccgccgccgccgccgccgctcgccgacggtgtcgtcctcgactcctccgccacccacctgctccatctcctcgtcttcctcttgccacattctcctcttcctctcctcgcagcttccttccctgcctcctccgctacaagccagatccatctccgctcaccaccgccctcgtccacgactccgtgggtaagcactacggccatcttctccgctacatcaggcgccttcaacatgcctatttccccctttctatctttttcttttttattt

SEQ ID NO: 6938 - DNA, 1501 bp, Oryza sativa
gcgagcggcggcggcggcggcggcgagccggcgatgcggttgagttggatggggaattgaagttgaattttctggagaagaaacctcgcgtcgccagccagcgggaaatgaaaatctacatgggccaataatcgatgggccggcccaggcccaggcccaaccagcagcggtttcctttttggtttctgagtcttctttgagaaggaaagaaacggcagtgggagtggagtcgatcatgtccgccgccctccaccaccagctctccctcgcctcctccgccgccctctccgcctccgaccacgacctcgccttccacctccagctcaccgaggccatccaggcctccctaccctccaatgccgccgcccccgcgccaccggaggaaccttcccacgcctcatgtgccctggaaatcccacgccgccgacctcgcgcgagccgagcatgaccgccgcgacgcccaggcctgccgcgcctaccacgcccgggccgccgcctccgtccgcgtcgccgcgcacgacgccctcttcgcgcgcgacctcgccgccatcccggaggacaggtgggcccacgacggcgactacttcgagcggcccctccccctggaaggaggcggcgcgctcttccgcgtgctgttcaagggcatggcgagcagggaggtggtggggccgcgtgaccgtgaccctggcgtcggggtgctcgccgtcgccatctgcgggccaaggggggaggtggtgctccggatacacaagcccgtgcaggcgcaggcgcagcaagggcggatgatgctggaggcgatggcgctggtggaaggcctcaatgcggcgctcgccctcggcatccggaccctcaacgtcctcactgacaacaagccgctgcacaaccatgtaatgtactatctatgcttgctctcatcgtaaccatattaatattgatttgccttgactacgggtagtatgttgttgtcctgttaactcaaaaatattatattctccaatactccagcacatggtgtcttgttatgtttcagcatactagtttgtttcagtgcctgttcatttggaaatgccttcctcgataaatttcgatcttaaagaaatgctgcagcttctttccatttaaataccttgataaatttccatgtaaattcattgatagatattctttctgttcatgctaaaagaatgattcaattatttttttgtctatcactggtcttgttatgatgtgcactacatgattgttgatagatacaatacatacaatctggtgtttatttcctaatgatgttgggaattgggattgcagatgagtggtatatggcgcccaagacagaagaggcttgtggatttgatcaatgaggctttctcaacaaaacagaaatttgagcaatgtgagatcctctgtgttgcacgaacccaagtcaactatgtcacaaaattagcaacagattctctgcatactcaaattgccaaagctgctgctgtgagtgctggcaagg

SEQ ID NO: 6939 - DNA, 1352 bp, Oryza sativa
gcaatggccatttacgcggatgcaatacgcacggagtggtttttatgagagcggtgcgttcgtgttcctgcaaagacgttagtatcagcaagtttgctcttattggcatgtttcgggtgctatttatatctgcaggtattgtgaccgaaatagggctaaacctataatcgaactcctccctgctattcacgtagatttggaaaattcttcgcttctttattactactatatgttggggcctgtttggtttccagggacttattccaagtccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctcttatttatgaaattagtttttttattagtctatgtttaatactccaaattagcgtccaaacatctgatgtgacataggctaaaaagttttagccccatctaaacaccccctcacccccttagtatgttaccgagaataatagttgtatctggctgagctagctacagttaatagactgtagaaacatgaataaaaaaataaaattatatgtacaacttttatatccatactgctaaatatttaaaagcaaatgttaactccaatttttaatttcaaaattggttgcagttgataaatcaacaaacaatgacgagagccgatatctacttatgtatctaccaacacttataaggagacatatctagtgagtagtgaaaccagatatgaaagttttgtaaaatcatgaaaaaattagatatatgtaggcatgaaatacattatcaccaaatctgaatttcaaactgaactttattatggagcaaagaaaacaattttcgagtgaatagtaagaaaaacaccattcacctaaaaattgtcattttttctctcaaataaagttttttgagtttgaacttaagatttggtataaatgtatttcaggcctacacacatatctctagttattttttcataaatttacaacacatttagatatggttttcacgagtttttacttatttaatgattttctctggagatttccctccctataaactactattttgcactctaaggtaactcttacagtcctacattaattagaaaaaatcatttatataatggcatgagataatataatactacataagtaagtagaacttagtattaatataatactacataagtaagtagaacttagtatttattaattctaaaattc

SEQ ID NO: 6940 - DNA, 1501 bp, Oryza sativa
ggtctcgcgtggggagagtgcgagaccaagcaatcttgcgcaaaaagcatgcaagagactatacccttctttaatatgggaagaaaacaaggaggggaaaaaaggaggaggatgagacaaggacgatggaggatattgaaagaatttttttttctagaccgtcttacccacactgtcatctaacaaaacactataaaaattggacgaccatctcccatccagctccatgtacccaaccaaatttagacttcactctaattttgtagacaatgtttcaagctaaaaagacaatcttttaggaacattttttttaggaaaaataaatttgcttttgatggttaaagactactcaattgtgtgatttttaataacatgaccgctacataataaattattaaaacacaaggtatataacaaccacgtcattatgcttatacttattatcagcaaaatggattattattaaaaaaataattttgaaatatttatatgtgttcttagtaatttaaaagaaatgctagaaaacaaaatacaatgaaaaaaaacccgaaatcgactctaaaattatgttttaaaattcaaattgttgcttgcatttataaacaaaaggctaaacaatgggttgtaaatttccacaatggaagggatttaaaattcaaattctttcttgtgcttaaaaactgaaggctaaatgatggattgtaaatttttacaatcgaagggtagtccattcttaaccgtgtatccgcaactttcaaacaaactaactagtacatacgactcaatactgtattagagccaaaaaggttttaagtttgaattctagctgatgcaattaaaaaaattactccctccgtcctataatataagggattttgagtttttgattacactgtttgaccactcgtcttatttaaaaaatttgtgcaaatataaaaaataaaaaattgtgcttaaagtactttggataataaagtaagtcacaaaaaaaaataattctaatttttttaaataagacaagtggtcaaacggtacaaacaaaaactcaaaatcccttatattatgggacagagggagtagaattaacttatagaccctccatgtcgtctatattttatgacgaaaggagtatttcacacctaaaaccctataaaacttgcacatatatattaggcttgcagcttgcttaaagtatatagtgaattttccgcccctattcatcaactcaaacttttggatgggatgtgtgatgacttccctatctatccattgattgaggaatagtgccagctttagatttgctcctagcgtcataaagaaaagatacttttgtctggattagaaacgtgagtaatatatgcatatcttgtactaacatacagtaagcatgtatcttgtgcaccgggccttcgttggtttcccgtacaagctctctataaatatcaggttcagctctgcccacacttcatttctccttgcctttcataacctcctctccatc

SEQ ID NO: 6941 - DNA, 1501 bp, Oryza sativa
ctcggcaaactgatcatcattgaatctagctcttgagtttatgtagaccctatttgaaggaatttatagtagtcgcacgctctcttataatatccatcttcacaatcaatacatattctcaaccagtttctaatagtatgtataattatataatctagaaaataaactatagctacgaaattgaaaaccaaacattttcagattctcaaaagttagctaccaataagttgtttctcgtaatgttaagttcccttcagttgtaagcagttgctcaggccttctcaaaaatcatgataaaacatattagtccatctatagtagggcatacataaggacatagatatggcgaggctcctagcacgatgcggcagcctggccaagcgaatgcctagggcacgacggcacgtgttatgaaaatagatgcacaacggagacacgaattttacgtggaaaatccttgcgggaaaaaaccataggcgccgactggcaatgatcactatagaggaattggatacaaacgcaggggatacattgggttgtcgcaccctccccgtgcggcttacaagggatatatataggagaaaactaggagtcctaataggaaactaatcctataaagtaaagtcctattagataactaatccaaatatattgtgggcctaaaattcagatcacatatttaacaatctccaccttgagacgaattttccttgtagcataaaaatcttcaacctctaaacaacctcatgatgataaaatcaatgtgcgtcaaatcctgaatctactggtatgacattgtggaacccaacagagacgcgaaactgatgcagaaacttcaaactcgccatgggaataaaatcctgaatctgctggcattaatttctggaatcctagcagaaacgcgaaactgttgtgctcaaaacgaagtacttagatcccctgataaaccttctggtacattgggtacaatggtagcaaaattcgccggacaatttgatcaccttgtgatctagacaggaacaaggctccctctcgacgacttgaatgtgttgcctttttttttctctccggtgcacagcaatacttgcttctcctcctcgatggctacgccaacttgcatcttcacttgccataacgagaatattgcatctcaatccaggagcggtagattaaacttcaaactcgccttgggaataaaattctgaatctgctggtataatttgtgaaaccctagcagaaacgcgaaacactctaggtgcataaaatgaagtattttgatctctgtatctaaactcctggtaaatctggcttgtgaacgtagcaattgaaagtgaatttgggttcacctcgacagaaccaagcaatgcacagaacttgaattcctggtaaactccgtgtgtcacaaatttccaaccgtacgtgaaaattaattcacgtgaacagaacagaagcagtggctctcggtggcttctgatttttctccacctgtgtgtgctcgagg

SEQ ID NO: 6942 - DNA, 1501 bp, Oryza sativa
cagttgacatccacttcactttaaccatttaaaagttattaatggtccaagtgaaaacagtaagagtcagtagtgataaggtaaatgaagacggatttaataatataacttcctataggtttaatttgacgagtaaattaaagaaccgtgatggcaccggcaccactccctcgccatcatcttgtgttacgccactatatggtcaagcttgtgcgtcattgatcaatcatggggacaagggtgtgatgaccattacacaagaaacaacaagaggtggggggtccattgacgtacgacaatgttgccatgttgtgtgatctcggagatggatttttatttctcgcgagtatattcacctaaatagatttttttaaatttatttatagaacacattaatatgggatatatcgctttacaatgtacattattaaattcgacttctacaagttataaaaactaaattaaactgaaactaattaatattataacctatagaagtcgaatttgaatatgcatatttgtggagtgatatatctcatattcatctatcttgttaatttctttaaaaatattgatatctatttaggtgacatataagagatgagcgacgcctgtttgagggatgaaaacacttttatgtgtgatctccattgtgttatttatttctttcccggagaaatagaggtacataaagatggaaaaacatgagcctaatatgtagcctatttcctcggtaaactttctttttttaaaatatctttgcgaaagatacattacaattcagttaaaaagagttttggtagaacgcgagcgtaacttaactgattaggtttcttgtgataaaacaagcccacttgactctaagtcctagacttgacaccaatactcgcatttacggctaattattctttatggcagatgacatatctatcgacaataaggcaccaatggtgatttcgtcaattttatgatgccggctcaattttctggagatgcttacatgaataggacgtgcgtgtgtgcgtatgttgtgagcacctgtgtttatattgtttttctaaaaaagaaaaaaagagaaaagattttttttgccaaaataaattctatataaaagttatttaaaaattttgaataaatccatttttaagtttataattattaatccttaattaattatatgataataattttttattttacgtgcgctaaaaaaatggatccaaaagagaggtgatagaacgacgcagcctagtatgaaaatcacacatgttaagtccattccaagaaagcaatgtgtatagagatgcagcctcaaaaagccccctgactctccacactcttttcaccctccttacttctctataaataaataatagtaccacctcgctaaccaaacacacaccaacccaacccgagccccccaagcgcagccatggtgttcgacgcgggcaccggcagcagtggcggcggctcgccggcggcgccctccccgccgccgccg

SEQ ID NO: 6943 - DNA, 1501 bp, Oryza sativa
gcggggagggcgccgccggcgagccgccgccactgctgccggtgcccgcgtcgaacaccatggctgcgcttggggggctcgggttgggttggtgtgtgtttggttagcgaggtggtactattatttatttatagagaagtaaggagggtgaaaagagtgtggagagtcagggggctttttgaggctgcatctctatacacattgctttcttggaatggacttaacatgtgtgattttcatactaggctgcgtcgttctatcacctctcttttggatccatttttttagcgcacgtaaaataaaaaattattatcatataattaattaaggattaataattataaacttaaaaatggatttattcaaaatttttaaataacttttatatagaatttattttggcaaaaaaaatcttttctctttttttcttttttagaaaaacaatataaacacaggtgctcacaacatacgcacacacgcacgtcctattcatgtaagcatctccagaaaattgagccggcatcataaaattgacgaaatcaccattggtgccttattgtcgatagatatgtcatctgccataaagaataattagccgtaaatgcgagtattggtgtcaagtctaggacttagagtcaagtgggcttgttttatcacaagaaacctaatcagttaagttacgctcgcgttctaccaaaactctttttaactgaattgtaatgtatctttcgcaaagatattttaaaaaaagaaagtttaccgaggaaataggctacatattaggctcatgtttttccatctttatgtacctctatttctccgggaaagaaataaataacacaatggagatcacacataaaagtgttttcatccctcaaacaggcgtcgctcatctcttatatgtcacctaaatagatatcaatatttttaaagaaattaacaagatagatgaatatgagatatatcactccacaaatatgcatattcaaattcgacttctataggttataatattaattagtttcagtttaatttagtttttataacttgtagaagtcgaatttaataatgtacattgtaaagcgatatatcccatattaatgtgttctataaataaatttaaaaaaatctatttaggtgaatatactcgcgagaaataaaaatccatctccgagatcacacaacatggcaacattgtcgtacgtcaatggaccccccacctcttgttgtttcttgtgtaatggtcatcacacccttgtccccatgattgatcaatgacgcacaagcttgaccatatagtggcgtaacacaagatgatggcgagggagtggtgccggtgccatcacggttctttaatttactcgtcaaattaaacctataggaagttatattattaaatccgtcttcatttaccttatcactactgactcttactgttttcacttggaccattaataacttttaaatggttaaagtgaagtggatgtcaactgagtctagg

SEQ ID NO: 6944 - DNA, 1501 bp, Oryza sativa
aaaacttaaatccggataaactagtttcaccttaagaaacataatcaattgagctacattcacttcattatggctatctttaggtgctagaattgcgaatgacaagatcatgcattttaaattgcaagaatgagcactcctttaaatcaacatgacctccggaatttctccgacttcttctacttcactctctccctattctaagtatactataaaacatataaagaacctaaaatatacttagagcctcttataattcagctctatatgtaggtgtgtgttgtgaatgagcgagagtggggtatttataggtggagagatgccttgggattgtgaagatgctaagcatctaaatagcatcttcactctactcttgccatgtgtccagctgatgacagttgtttaggtaaaatcggtagaaaccgtcataacaagtcggtaattgccggcatgtaaaatttggggccgaacggcgaagctacgggttcggccaaacccttgctggcatgttttgctccgaattttctcgtgggctctggtggagaacccctcagcccaaatgtacttgcaattggcccatttgaatgtgtttcattaggtttgtggatccaaaactccataggcttcaatatggaagtttaattcacctcctcctctatgtatattttgtctcaactttggttgtttgccacctgcatccaaatatacaccaatgctcgtgaaagtggttagaaataaaccctaccactacattggatgttttatatttatggttttatgcatgtattgatggtgttaatttggtagttaacagccatcaacagtagcacgattaacaaggagcctaaatataatcattgatattttctttaccaatacaacaaggagtgttggaggcaagtgtggacgttttaggtttgactacggtatttgcatggtatgaggatcgtcgatatcagggtatatgcaagattgaggtaaaagagatggagacaatgattttatacaggttcgagccccttatctgataggtaataaccctactcctgttggccgaagccggtggtactcttaattatctgaatcacacaagtacaatatttgagataacctatctagctatctcgacttagcggcatggataaccaacacgtagtcgatgacatggtagtcttcctcctcgagtatgagttcatcgagatcaaagatgacactagatccctcttgtcggcctccacaggcaccatacggggtctgtctaggcttatccttaatgttgatgtctggcggcatgtgttggcttgtgtattgtgtgtctatctattgttgtgtcatctctttcccttagggggtcttgtatttatacctatagaagtccccttgtctaagtagaattagggagaccaatatggatataatccaagtagtccttgttgtttccatatagaactctacttgtccttccttatccgaaactcattctatatacgaggtatgattc

SEQ ID NO: 6945 - DNA, 1501 bp, Oryza sativa
tattgaagcctatggagttttggatccacaaacctaatgaaacacattcaaatgggccaattgcaagtacatttgggctgaggggttctccaccagagcccacgagaaaattcggagcaaaacatgccagcaagggtttggccgaacccgtagcttcgccgttcggccccaaattttacatgccggcaattaccgacttgttatgacggtttctaccgattttacctaaacaactgtcatcagctggacacatggcaagagtagagtgaagatgctatttagatgcttagcatcttcacaatcccaaggcatctctccacctataaataccccactctcgctcattcacaacacacacctacatatagagctgaattataagaggctctaagtatattttaggttctttatatgttttatagtatacttagaatagggagagagtgaagtagaagaagtcggagaaattccggaggtcatgttgatttaaaggagtgctcattcttgcaatttaaaatgcatgatcttgtcattcgcaattctagcacctaaagatagccataatgaagtgaatgtagctcaattgattatgtttcttaaggtgaaactagtttatccggatttaagttttagacttgataaatgtactcgtatttatagctaactattatttcagtggtaggcaacatatccatcgtcagcgagagcctgtgatgactttgtcaatctcaacatatattattccaattttttgaacgtactcatagcttaagcttttgtctcgaaccgaccatcgaattaacactagaaattggactagttgggcgcttgggctgggcccaactcatttcaggccaagaaagtaagaagtgcccctaccaaaatgacacaatgccatggcccatgggtcaaggcttgggatatacccaacaattttacaaggtgattgtaacatgtaacaatcaaaagtgtaggctcgtatatctgtcagaacaatccttcatatgtggcttccctttgccagggtcatctttgtgctcctctttggtgcatccgctgttcttgtattcactggagctatgcccttcatattcatccaatatgccgaggtggtgtccagggtcaccctcatcgtgggctgcttttgaggctggagtctactatggctcgctggtcacggcttctttggctcgctgatcactgttgctgccgccgtctataggatgcgctatttctggaaagaagatacgtgttgagcttatggcctcggcagggtgcaacgtctgtggcattgtttgttgggcgtttctgcatgcttggggctgtctaccatgtccaaggattatagggtgcggcagtagtatgttatagtagaggggcggccttgtgccgaggtggtgtccagggtcaccctcatcgtgggctgtttttgaggctggagtctactatggctcgctggtcacggcttctttggctcgctggtcattgctgctgccaccgt

SEQ ID NO: 6946 - DNA, 1501 bp, Oryza sativa
taacttattgaaagatgcagcctctgtagtacaggaattttcctaacaaccacatttcattcactacactcgcaggaggcccgcctcgcaatcgagtacattgtaatcccaggtggagagcccgtagaactcctcccaagatgttcagaaatagttgcccggcaactggagcttgttgagagctaccagctcctggccgaaacctttggaactgactccaactcgaggttgcagattcttccggtgaaaataaccaagaagagctcaagcaaaggcagtgcaggatcgatgcccaagcaaggcagctctgacctgatcgtcagcgacaacggaggcggctccagtttttctcggctgccctttctgccgaaatgaccattgctagattgacactctgatctgatcaccgttgcccccaaactgtacatcattcttctttcctctgcattgtttttttgttgtacataatacatacctgtgcagtgttgtaaatagtgtttgaatgttgaagaatcgaaagagcaaagctaattgtaattgccttccattcttttacagaaataaaaatatcacatttctggtgtcttagccagattaactcacagttgtaccctcatttttgtttggctgatgtttactaacgctctttgcatttcttttgtttggatacccggatgacaacgcacacactgttaggcctcctttggaacacaaaagttccccgcatcacagcagtcagcagtgacatcttcaatttcccaataaaacgaatattttacctttacgaaacccgtaaaacgaatatctcattatctaaaaaaaataaaacgaatatcagtattcttgtatatatgtatgtaagaagcaaaaaaaagaaaaaaaacttttttttcttaggaatgtctcaggagtctgcaggaacattgtttttttattctttggagaaattcaggaacattgtttatgtaaagtaggagagtaaacagtgtaagacctttgctacgaaagcaaaaaaaaaaaaaaggtttctcaaaaaaagaaaagaaaagaaaaactcaaagtagaaagaggtaacgtaccactcccgtgggccggaccaacactccttcccaaaaaagcccaaaaatatccaatcgtctcgtaaagggggctcaaaacaaaaaggcccacgaaccaatttcgcatgtgcgacccgtgcagcccatctcacgaccatctctctctatatatagaaagccccagatttttctcctctcctcctcctcgcctcattccatttcatcccctcctctctctctcaaaaccctaattccccgacccgagcaagccctaggtcgccgccgcgccgcgaggtaggtctcgcctcccgggagctcgcggaggcgcgaattggtgccctgattggttggtgcgcgtttcgggttctgaggggttatttggtttttttttggtggtttgtgtaggttggaggagttggatttgggtctgatttgattcggat

SEQ ID NO: 6947 - DNA, 1501 bp, Oryza sativa
atttttaaatgttgttaattttttctataaacttgatcaaacttaacaaagtttgactagacaaaaagtcatacgacgtataatatgaaacataaatagtattaaactggttggcttatagtcatagccgaatttaaattttaaaattgttgattttgagtgtttttatagtagttagtttttttaacatttctttaattgctaatatcacacatcaaaagaattatctataaataattataagccatagtgcttattacaagcagttattataaactgcggtccgggttctaattgttttgccaacagaagattataatccgtttagtgcaaacaaataatttacgccactaataatgttttatgtgacatttgattatttatcttatcaaaaagtgttgcttattttgttgtgacttaccttatcattaaatgaactttatgcatgatttatatttttatatatttacactaaaatttcaaaaagatgaatgatttttttaaaaaaaaatcaacggcgtaagacaatccaaaaaataaactatttcctccgttttatattataagactttattggcatatatgcttagattcattaacatttatataaatatggacaatgctagaaagtcttataatctggaacggagggagtacgatgacaaatattgaaatcaatctgtacgagagctcggaatcgctgaagtccgtcgagctcgttcttgcgtggatccggccctgactcggaataagcgagatacacatatatattgcatctggtcgattgttttctaccttatatttcttcgtcttcctcttgatcgagagataacagtgtgtgagagcgtacgtactgtgaggcggcagcatgatgatgacgacccttatcgccccgataatcatcgccgccgcgactacgccgtcgtcggtgccatcattgtcgccgtcgtctacgcagctgccgccgccccaagttatcgccatcgccgtggcgccacccatttgtcacgttctatgggccgggcttcgagcactgggatttggtctaggcaaatagggtgcatacttttaaaagagaaggcaacagcaacagatggggcatcgataaagaaatcaacacaactgaagccaaggcttcttcctcctccaatttcctctcttctctttgttcttctaatcctaggctctgctctcttattcccagtcccctgcttctcttcccaatctacattgctaattccttccaattatatccaaattacttgagtgattaatgctgtgaattatcggttgcttccggtgttgggcattgatcggtgggtgggttgaggatcgtaacattatggtatcagccaccgatccgtgggattccaaacaaggacactatgtgggggacacgggatggaaggggcgacctctgggagcgggatttgagccatggaagtgttggtgctagtggtgcccgccaggtgttcggtgaaatgccgagctggctgggagg

SEQ ID NO: 6948 - DNA, 1501 bp, Oryza sativa
atgtataaagatacaatgtaatattaggaaaagagagataattagagatagataatacttatttattccatatggtagtattccatatgggagacccatcataagttgctatattctgggacggaggaagtatatttttatttgattggttcgaaccgagatatgtttagtttacatcaaaattaaaaatttggttaaaattagaacgatgcgatgaaaaagctaaaagtttatgtgtatagaaaagttgtgatgtgatagaaaagttaaaagttggaagaaaaattttagaactaactcgacctgagttggctcctggttgtcagacaacagggttcggtggctgcagtggtatgattcgattattatgtctcacagtttgatgtttctgggacccacagaaaaaataaactcgatctcacctttcctctcgctctcacatccggtagcaacaaatatttttttatggtctgtgttcgacctctcgtttgaactcgatttttcatctgacacgaaccagtcgcccacaagtttcccaaactgccagagccagggttaccacgtgataaccgcggtaaccgtgaaaaaccgtataaaatttatcaaaaatttaaattattttttcaatttatttaaatttaaggaggttaccgtggcatttatattaccgtaccccgcggtaagcccggtaaccacggtaaccgtgcggttggcggtaaaacaaaccctggtcgccccccacaatgtgcacggttcggtttttggtgctgaccgaaatcgattttgggttgacactggagctgctctcatatatgatatccataaatcgatgtaagatgtgcatcgatttttctgagtgtgattgcagtgtgtacatcggttttttgggacccagctgtgtctacgtgtctcttagcattcttttttccttataaatactatatccgttttatattagaagttgtcagatttttttaattagttaaaaattttagatttgattaagtttatagaaaaaatagtaacatctatgatatttaattagtatcattaaatttaacattgaatatatttttagggatgtaatatttattttatattaaaaatgctactgtattttactacaatttaacattgaatatatttttgatacaatatttattttgtgttaaaaatgttactatattttactataagcttaatcaaacttcaaaatatttgataaaaaaaatcagacgaaacggagggaggggctgttcagattgatgtcattttcaaccataccatttttttaaagttttcaaaaaaatgtctgcgtttactttgttgccaaatttaataaatacataagaaatcctgttaaaattttaacaatagtaccatcttactaaaattggtaagatttattttgactgcaatatgagcagtcccggagtacctcagaaagagacgaaacggcgcgcggacttcagaaggaacacagagagagcagagtactgct

SEQ ID NO: 6949 - DNA, 1501 bp, Oryza sativa
cttagacgacggcgacgattggccgatggcacaggcgtggcggctgcggcggcggcgattatcggggctacgaaggtcatcgtcagcatcatgctgccgcctcacacgtccgttcgctcgccagccgatcgagaggaagacgatgaattcggctgtgttcttttttaactcatagttcccaattcacttcctcttgtcacgcacgttttccaaactacacaacaatgcgttttttaaaaatattttataaaatgttactgtaaaaaatcatattaattatttttttaatttttaagctattatttaattaatcatatattaatccgtctctttgttttacttaaggaggcaaaatactccaaaagaacacacgtaaaatgctccatccgttccaatatatagcaaactatatagggtattctagaactttatataaaagttatagatctcaatgagatctacaattttagagtttattaattttctatttaacattatctagagtgtcgaataagcattattaattagtttttaagtttatttgcctgccgtcaaaaaaaactttttaagcaattaaaacactaaaaaggaagggtttgaactcaaataaaaaaattgcatttaggtcccttaatgccctttggaagggcgatttttaaaaacgccctcccaaagagcgagaggcatttagatttgtaaaattttgaaaaaaaattattttttaaatattttaataaaagaatgtaaaaaattcctaagttgctacagtgtcgtgcagtactgtgttgggctactgctcctctgctatggtcctgtttggatccaaaggatattttttagccctccctcaaatagtcaaaatagctcaaaaagatccaaaagggtgagctatttgaaggctatttggaaatagcccacccaaaaaaaactatcccacccaaagggtgctaattggggctatttcaggtgcggcccactgaaaaagtgtcttttatctctatctctctccatgagaaggtacattaaaagccaaatagctttcaaaatagcccttggatccaaacaacttagggctattttattggaggactattttcttgtgctaaaaaataactcttaaaataactctagactagttctccaaacaggggctatgttggcttgctgctgggctccgagtgctttttgctgggctggcctactgctgctttagctagttgctagctagctttcctttttttttttttggtcacgtgtgtcccaattttgtattgcccggatcagcgacgaaataggaatcagaaccaaacaccgaaggaaaaaatacaacgaaaaccttaagtattttttattaggtatatagatatagatttcgcaacaaataatgtatacttctgagagggatatgtggattttcatctctcaaagggacattccctggttgtttgcatgtcatctaaatagttattaaattttttttaaaaaattgacaacatagatt

SEQ ID NO: 6950 - DNA, 1501 bp, Oryza sativa; identical to SEQ ID NO: 2522

SEQ ID NO: 6951 - DNA, 1501 bp, Oryza sativa
tacatatgcaaacatatagtactactatatatgcaaatgcgtacattaaccacatgtttttgtcgatctctaacatgcgtgcattaattaattggcatatatatacgtcgcgtgtacgatcgaatgagaattaatacgtgcacaaaatcacacacaaatgtacacagtagaatatgcgagcgacaaccttaaacaagcagctagcacatatgcctgcacctttcttcttccatcgacatatattcatatgttgcacttttgcctgaaaactacaagcgctagctctttaatttggaacaataggtaggagtacaccaccagtgatatgtgcattacccgaaaaaaaaaacagtacatctagtgatgctagctacttcctccatttcacaatgtaagttattttagcatttctcacatacatattgatgtctagattcattaacatcaatataaatataggaaatgctagaataacttacattatgaaacggaaggagcagtaaaaaacaatgcaattttggtttcattccatatatatgtgtgtgcaacgtacatgctggggtcggattcgttcagtttaatcctcaagtactccaaaaatcatcatttttgttaaattttttttgaaaggagtcatttttgttaaattaaacaaagccttatgttctatgtagggcatgcaacttaatgtaaataaattgacaataacatgcatgcacggtattaaagtataaatagcagggtgtgttaattatactgtgatatttgttagtgccccccaacacacaaaaaaaatatattctgtggaatagtatgacgatgcacagagatctccctatatatgcaatagtgataaattagaatatactaatatttgtatttctaaaatgtaatagtatatatccaacaatactaataatgctcattaattgttcccctggtaaaaaaaaaacgtatgtacctcctgaaaatagtctagcctaaaactgtaatcaaacttgtcaaaaaatagcacactatatgcataacattaaattgatatgcaataattaaatagctgttaattaatttgtatttaatttagtagctatatatatacaccgtaatatgtaaatgaaacttgaaatgccaataggtacaggtgcactactgcacattaattgtataaatacaacacatgtctatattgagagctgatatttttttacatgaacaaaggaattttctgtgcttacgtatatgtacatcagtatcagtatgcaagcataactcttaatatatagccaacaccactctgattcttaaatccatatgtacaggtacagcagtaaactaactagttagatcatcgagtaatctgatatatatgtgatatatatagaccacaaaaatcatgcatgtcaacgccagtttattccttgaaaccaacatgcatggcagatgaattcaactctcgttacaaagtaagtagcatcagtacccaaacgctaaacaatttttg

SEQ ID NO: 6952 - DNA, 1501 bp, Oryza sativa
caccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcagatccgggggcggccgaagctgccactccggaaccggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacagatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctgttacgccggcgctcgctgttgaggcgggcatccggcttctcatgctgatcctcccgagtcgacggtgtcgacgagggagtggcagccgaatgacgtgcagccgccgccgctcgccgcgccctccgccttgatgacacggaaccggtggtggcggcgccggaggtcttggtggtggtggaccgtccaccagcacccaggcgctgctgagccgtcatgaccaagttggccacatcttccagccatcgttgggctggagactccgggtcatggacgacaggcgggtgtcgtaagagcgcgccagcagcctgaagcgcaccctgaggcgtgctgccgtcgccgtatacgaggaggcggcgctccccatcttgccgtcctcctgcaccacccgcgactggtgatgccatggacttgtcgaccttctcaagcgcctccccctgcttagggctttggcgcggaggaggtgggggagtacgagctcgacggcgtggattcggctccccgtcgtcgccgctcacactcggagagaggtcgtgcgcctttgcttgctcggccattaggctgaacaagggaaacttggcgcccacggaagagtctgagagctcagaaaacacacgctgagccccctacctgg

SEQ ID NO: 6953 - DNA, 763 bp, Oryza sativa
acggatcatcaaatcgcccatatcttaacgagtggaaagagcatatgcttaacgagaaccccgccccattaccctccaagattaggctacggaaaaaggccatttgcctttcgagttggctcctgtccccttggcccatgattaacagagaaaaaaaaagaagaaatgagaggttcattttaaaagcgttaataattatctgtacttgaaggaggtacaggaagctggaggagaaaaggatgcctgtgctggtaatgtaggagtatcagtttcgtcaaggatcactgcaatggatgatcatttctggccttcttctacacctgccttggcaaactgaaatgatagagattgggtggattgctatgttaacccgtcatttcttgccaggagaaaatttgacaataatagaaggaacaaagcaactgaaccagcaaactctatcccatcacgagatgcccctcaatgctccaaaattcaaacagctctcatcatcctgaactagccagtccattaccgaagagctcaagcactgctgatgtgaggaattagcacgtgattttgatttcacagcgggctcagcttcacttcaggaatgatcagtggtaatagtagccaaacagaaaagagtgtcttcgcttgcagccttctttaattctttttcacatctctctcccaaacgaagagagtggagctctgagctaaactccagtttctgctagcttccatgagtggtaatgatagctcataccctcttactaccagc

SEQ ID NO: 6954 - DNA, 1501 bp, Oryza sativa
aaacttaaaataaaacaaacaattaaaattgaatacgaaaatttatatttgtgtttattttagaaacgagggagtactgtactactactagcggcgtagcctagccctggcctggtgatgatgatgcaacggcgccggggatttgacacccccggagacgtgacgaccgtagtgcaatcccggggaatctgcgtaacaatccccctgctgctgctgtcctgctagcctaaccgggggtggagtagactagtagtagtactaccagtagcagtgtaccacacgtagatcgggccccgtgtgacagggagagcgacgccggaggggggagatgggccgtgcaaccgctgcttatgtggtgtcgagtcgatggtgggggctaccggtcgggaggggtctcgctctcgcccaccccaccggcccgtcgtggtgtacagtgtactcctacgcggtggccaatggagagtgtgttttagggcagcgttaatggccaccgtacgtgtggtttgccgatcaaatcaaaaaccttgcgctggaattttgtggactaaaatctgtgttggcgactgcgaggggtggaagatgacgacgaacgaacgaacgaacgctacgggctcactcggtcaagtcaagggcatgccgtgctcgttttggaagttttcgatgttcatttcagggactccggagggacactcgtattgggtttacgaataggagatggcctaccgttccgggcttaaatgaaatgatggttttcacgaaatccggtagaaaatcagtagattcaataaattttataaaccaaaatttgaatacaaattccctgagtttatcgataagctcgtgaaaaccggtcggcttgatgaaattctgagcgaaatcatcgaaatttcaatcggtaactagtaaaggaggtaaactgatttttttcctttttaaattcgttattcttttctttactactgtaaatttcagtaaatacacggaatatattaatttttttgaaaatttatattccaataggttctataaatatcgttaacttctcccgtcccaaaatatagctacctagtacaggatgtgatattacctagtactactctcggtgacatggggccgggggtatcgtgactagaggcttgggtagccgcggtcacccacgtggcctgacccccttgggggggtcgggcccgagggtgacgtggccacccctccctctgtctccccgaggggtcgggtcgctcccgtttcggccccgagggctggggcgccccgaccccctgtggttttggcgccacgtgtgtgggttaggtgagcacagcgggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 6955 - DNA, 1501 bp, Oryza sativa
atatttgttgatataatgaatcatcgtatagcattcttttcccctctcaaactctcaacgagtttgacgttgtgatcaatatttatccattgtcttttttaccctactttgacaaatacatgtaagataaaatggtcattttgtatgtgttctagagctcctatcactgtccacaccaacattaaacatttcataggaatactagggaaccagttcatgcagtatcctcttgagtgggtatggagaggcgagaaggcgagtgagacgtaggctccaccgcctccaccaaaatcaagttcagaatttgtcgtcgcctcctcaaccgagcacagcagatgtaacggagccgaagcttgacctctctccaccaacaacgttgatttgttgatagagtatggttattgatgcccctcctacccaaccgcctcctccctactacgatgaaagtagcagagccaccaccgacaacattaatctggctaagctcaatgagaagagaggattgcgataacatgggattcgacgagactaagatagcgatgtggagtttgagatggctatggaggcatgtgatttgatatcatcactatcttaagggccagcacgaagcttaagttttaatacctaataggcattatcccgctcaaacgtgacctatataataattgtctcaatattttaagtgtaaattgaagtacattgattaacacatattctaccagtttatattgagtattatagtgaactcggtaccaaacaaataattttattttttaatataatatactgatgtacaccctccatcccaaaataagtgcagttttgtattattcacgttcaacgtttgaccactcgtcttatttaaaatttttttatgattagtatttttattgctattagatgataaaacatgaatagtattttatgtgtgactaaatattttcaattttttcacaaatttttcaaataagacggacggtcaaacgttggacacagatatctacggctgcatttattttgggacggaggtagtattatttagatatcgagtgttgtctttatacgtcgggtatcaccaatttccaaaaattatcgcaaactcccaacacatacgtggctgaagcctctgaagtctgaacggtgatgagagcacctcgagatttgcgtcagaacacaagagcgacgaccccaccgtatcccacacctcgctcacctcactgccctcgctttcgtcccccgcatccgcacctcgtccttcgccaattcgccatgccgtcgctcgccacggccgcggccgcgggagcgggagcgcctctccgccgcggcccgtgcgcaccacgccgccaatccgcgcacgcctcctcctcctcctcctcctccctcccctcccccgcgctcgccacgtccacgcgcttcgccgccaccgcccccatcctgcggctcgtccaacgaaggccaagagcgcctctgacggcggcaagagcggcgagccccgacgccg

SEQ ID NO: 6956 - DNA, 1501 bp, Oryza sativa
ttaaagtgttataaaaagatcatttttacttctacgaattgttaaatgatgattaaaatttttgctctttttattagcttacattaatttggaattaaatttaaaatatactgttcatttgggtttttttaaaaaatattcgacagcgaacggtctcgctacttccttccttgtgcgacagcgaatgttttgcccagtgagctgttgtttaattagtaactaattacccgattaataattaattagtaattaggaataattattataattaacgattaattgataattattaatcattaatgaggataattaatcaatttgaatgttcggtctcgctcgccggtaatgcgagagcgctcaatttaatcatttccgtgcaacggttcagcgagatcgatggtatattttcgttaaacaatttgcataccgaatacttttttaaaaaagccaaataaacagtaaatttttaaatttaattccattaatttgtatgttgctatttatactaaattattgtaagttgacgtaaatagcaaaagtttttatcagcttttaccattttgtagggttgctaacggaaacataacgaaacccgccgtagtcacctccttgccaccactgcctcggtgccagctgtgtcctagcgacaacggcaccatggacgacaacaagctccaccatggcaaccttcctcgtgccgcccattgcgtggtcaccacccttgccaactccgcccgttggggggccatccttcggcctctgctctagaccgctaccgttgtcgggtcttatccataacagtatagtggggtggctttgtctgacatggcaatttgacccaagtcaacaacgctgagtcattgtggacaacatatgtcacaacctcttacctatctctctcttcctcccctattcccatctcagcggtgcctggtgaggaagacgacgtctggcggcgggtcgacgatgggcggaggtggcaatgaagggactacggcgggtacttgagggacctgttgtgtctgatatttcggttgaagatgaaaatcgaactaagctgtcaaattaagggtcctaaaatgaacttattcaaccacctaaaccagtccgatatcctatttgccaagctcacggcccagtacgcgaacccgtccgtcgtccgccacggggccaccacgccgcccgcaccgcacgcgcacggcaagcaagcgaaccaagcgaagaaaagcacacatattcctctcctccctgttcgattcccctcctctccacgcctccgcggtgtccaaactccagactcccccaaaaaatcccccaaaaccgaagggaaagaggaaaaaaattactcttcgctctcgcgtcgcgcacgacacgaccgagccagcaaagccgcccatccgccatcccgccgctcctgcaatctacagccgcgtcgccgcttgtccgcctgcgctcgttctcgctagggttcggaagggggagggtggggatcgcccggcga

SEQ ID NO: 6957 - DNA, 1501 bp, Oryza sativa
gtgttctgacgcaaatctcgaggtgctctcatcaccgttcagacttcagaggcttcagccacgtatgtgttgggagtttgcgataatttttggaaattggtgatacccgacgtataaagacaacactcgatatctaaataatactacctccgtcccaaaataaatgcagccgtagatatctgtgtccaacgtttgaccgtccgtcttatttgaaaaatttgtgaaaaaattgaaaatatttagtcacacataaaatactattcatgttttatcatctaatagcaataaaaatactaatcataaaaaaattttaaataagacgagtggtcaaacgttgaacgtgaataatacaaaactgcacttattttgggatggagggtgtacatcagtatattatattaaaaaataaaattatttgtttggtaccgagttcactataatactcaatataaactggtagaatatgtgttaatcaatgtacttcaatttacacttaaaatattgagacaattattatataggtcacgtttgagcgggataatgcctattaggtattaaaacttaagcttcgtgctggcccttaagatagtgatgatatcaaatcacatgcctccatagccatctcaaactccacatcgctatcttagtctcgtcgaatcccatgttatcgcaatcctctcttctcattgagcttagccagattaatgttgtcggtggtggctctgctactttcatcgtagtagggaggaggcggttgggtaggaggggcatcaataaccatactctatcaacaaatcaacgttgttggtggagagaggtcaagcttcggctccgttacatctgctgtgctcggttgaggaggcgacgacaaattctgaacttgattttggtggaggcggtggagcctacgtctcactcgccttctcgcctctccatacccactcaagaggatactgcatgaactggttccctagtattcctatgaaatgtttaatgttggtgtggacagtgataggagctctagaacacatacaaaatgaccattttatcttacatgtatttgtcaaagtagggtaaaaaagacaatggataaatattgatcacaacgtcaaactcgttgagagtttgagaggggaaaagaatgctatacgatgattcattatatcaacaaatatgcgatactctaccgaatataaaaaaaaaattccttagagatgatcttccacagagttcgcggcataatagcatataatattgttttgtataagctgaaattctggctcatctatatatacgtgagacaaaatttttagcgcaaaaatggaaaaatcaaaatccaacgcgtagatagataggctcggcccatccaaaggctttgattggctatccccaacggcgatagtgggccaacgtttttgtgcataggctaccaaatctaaccgcggcaccaacacaccaagcctcgtgacacctccttcctctcgaagcaaagccgaggacg

SEQ ID NO: 6958 - DNA, 1501 bp, Oryza sativa
catgatcttgtaaaaataatatccaagcaaattcttacagtgaatttcactttagctaaaccgtataacaataataagattaagataaccttcacctattgcaacgcatgagcatttttttagtttatttttaattttaaaacaattaatatttatttgattaattttaaaactttgccgccggccacgtcacctcgctcaagctcccccggaggcctagacggtcacgtcgtgccgctcaagctcgagctctgccaccagaagtgccaccgcgagcactgcgccggcgatgccactgcgctcaagctccgccaccagaagtgctgccacgagcactgcaccggcgacgccactacgctggagctctgccactagaagtgttgctggtatttattatgagcacagaataatctgcaagcgcacatataccgttgtagcttttaccaagagtatcctagggtagcgtatccacagagaacgtatgtgcacaatttaagaacatgattcttccaagagcaacaattaaatgataggattgggatagagaggatttctatgagttaattaacttaatttaagttaaggtaaaactatatcaattacttttatgctaaaattgacggtcggatttggtacttgaggaacgtcaacaactaccgccacgagcaccgcgctagcaacgccactatgtcgagttcaaccgcctactatgcttgcgggctcgagcaccgctaccgtccgtgctgccgcactcgtcctccgccgccggacacgttgtcgtcgaaagcgtcattgcgctcagaccgttccctctcctgctcccttgctcactcgctctagaccgtaggaggaagaagagatgagcatgcatgagaggaggggatgaacaagggcagtatgatccaagaaaaataaaaaatgcagcaaagggatatgtggtggtatgtatctgatttcaacatatatttacaatgctattgttccaattagataaatggtaatgacatatttttttccggggtaatgacatattttaaaactgtcaaatttataacaacatatattcaattaaccttttttatttactcgtgagtctatcaaagatcaaaataataaagatatagatacagatacatatacatatacatatacatatacatatacatatatatacacacacacgtatacatagatatagtgttataaaggagagagatatagatagatgtagatataataatcagatagtacaagaaacagctgccggtcgtctgctataaaaacctccagccatctctaaatgcgtggcccatggtgtcggattcatagccgcgacgaaatccccatccctaagtgtcactactactggtacggtgatgtgtacatctcgcccaccggcacgagctcgccgcgctttccattattagccgctcttgcaagtgtgaagtgtccaggtagccattttgcatgcattttccggcttgtgtacagtgcttgcagc

SEQ ID NO: 6959 - DNA, 1501 bp, Oryza sativa
agaagttgctgacgccgatggcgcgagccttgccggagtcgtggagcttctccatcgccgcccacgtcgccgggatatcggtcgggaggacgttttgcccgccaaagccggcgcccttcttcatcctcactggccagtggatctgacgaacagcgtgagcatcctcaactcggatacttttaagataatgaaagctttatttaaactcagttaattacatcatacaatagtcaccctcggtctttgtataaaatacacacggctaaaaaaaaagaagaaaggaacaaccagaaccagaacatctccagaaatggactgaaacttatcacgaaatggaacatgaatctcacacgcattgcatactcacaaggtaaagatccacatagtcggtctgcaaatcctgaagcgtgctgtccagtgcaaccgggacatcctccggagcatggttagtgcacctgcaagaagttgcgagttcttcagtcatgttccaagattactgtaattgctggtgctcgcctaagccaagaatgtttggaggttttggaatgaggatgaaattaagaaggtaattaaccagagtttggaggtgatgaatatatcttcgcgcttgactatgccctcgtcgaacactttcttgagagcgaccccaatctacagagccacagtggttactggttaggctgctctgaaaactcagagatcgttcacttaactaggcaaattggagacaaatttagtaatttacctccttttcgttgaagtaggcttgagcacaatcgatgtgccgataaccagcctgtagaagcatacaattcagacagcacaaaagaacatgaaaaattaacctgcgtgaaaattcagacagcacaaaagacacatgaaaaattaacttgtcacgaaattcagacaacgcaacatcaccttgacggcggcgtagacggcattgccgacgacgcccggctcggcctgccatgtgccgagcccgaccgacgggatcttggcgccggtgttgaggacgaagcagcgggccatggtattctgctgcaagcactgtacacaagccggaaaatgcatgcaaaatggctacctggacacttcacacttgcaagagcggctaataatggaaagcgcggcgagctcgtgccggtgggcgagatgtacacatcaccgtaccagtagtagtgacacttagggatggggatttcgtcgcggctatgaatccgacaccatgggccacgcatttagagatggctggaggtttttatagcagacgaccggcagctgtttcttgtactatctgattattatatctacatctatctatatctctctcctttataacactatatctatgtatacgtgtgtgtgtatatatatgtatatgtatatgtatatgtatatgtatatgtatctgtatctatatctttattattttgatctttgatagactcacgagtaaataaaaaaggttaattgaatatatgttgttataaatttgaca

SEQ ID NO: 6960 - DNA, 1501 bp, Oryza sativa
gcgtcgccggtgcagtgctcgtggcagcacttctggtggcggagcttgagcgcagtggcatcgccggcgcagtgctcgcggtggcacttctggtggcagagctcgagcttgagcggcacgacgtgaccgtctaggcctccgggggagcttgagcgaggtgacgtggccggcggcaaagttttaaaattaatcaaataaatattaattgttttaaaattaaaaataaactaaaaaaatgctcatgcgttgcaataggtgaaggttatcttaatcttattattgttatacggtttagctaaagtgaaattcactgtaagaatttgcttggatattatttttacaagatcatgagctacaattagatcgtcttaagttagcatgcgagtttttttaaagagatttcgtatacgactccttctctatatattttcaaaagcaaacaaatttaaaaacctactcaaatctaaatttgtaattccaaaagcgaatgaactcaataactgactcaaatacggatgacgtatcaaagtaccgacaaaaacatcttcaacttttataattgtagagaagaggtatggatttatttgattcttttaaaaacttttatatataacactgtttaaccgttcaaaaaatatgcttacgaagaacgacaaagttattatagctaattgctatttacaaattagaactcacgctatagctactaccggcaatggatttaattacaaacgtaagggttagcaaccaatgctaaggacatgtttaataggttccaaacttctaaattcaactctaagagttaagtatggagacatggagtaaagttatagagtatccgaattctagctccacatttctagtttatttgtgaaaacacttcagccaactttcgtcatgttttgaatagagctgaaactgtacgactaaacctaaactgaaactttaccgaacagacctaataatggtgataagattgtgtcgggggcagacgcctagcagagcgctgcccgaacgaaacgctcgacgacgacgacgacgacgacagctacggccggtcggcgctccaccactctccgatggcgatccgccgccgcacaagacgtttgtcggtgctgccgtgctgtgtgctggagtggagcgctaatctgttggcatcttgcccacaggcccgcagcacgctacatgggcctagatatgccatgggcctcatcattttttccagcccatgtattacccgatgtcgccgctcgaattttttttatttataattttttttattaaaagttttacaaaaataattttccattttgaaaattgacggaaatagtcgcctaccgccctctgggaggacgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 6961 - DNA, 1501 bp, Oryza sativa
atcaaccatttctaccgtactattccaatctaagtttattatattttatgtaatctaactaggcatggctaagcaaaatctagcatatatctggtttgctatatattcaggttatgcatttagaatcatgtatggctaatgcacaagatactggaaatatagaatataggattattatgctcaaaggagaggaataataacttgccttgctccaacgcaaataaatgcgagataggcaacctgattatctgatctttgaaataccacaggttgccatccaaaatataatagactctactacagaagaggaagaaccaaattcaataaaagccataaaatagcaagaaagagataaacggttgggagggttaggatttagtgtatagcctatctcttttatagggtatatggattactgggctgatattttatgtgtgggttataaagagttggcagctggggtggagagggaattaagcggctaagatcacctatattttatgtgcagactttgattggttggtggatagggagtatagtggataattgaattggttgagcagatatgtgactggtattggctgatggtaggtttgtgtaagattatacctagggtttggttatatttaggccgattgaggagtagggcaatatatcggccaggctctatattttatgtataggttctgatagacaaaaagtatgaggctgagagtatggtggataagtggtattgtagagggtatgaaatttggatgacaattgggatttgactagcagggtatcggctaggatttggttgtttgctagttgttgctagagttggcaacataacgactagatttagtgtcttctctagccggtgtcagcagacatcatatcggctagagggaataggaggtaggtgcaggtttagtagggcggaagtgttacttcgacaaccgtgggtggcagcggagcggctaggatcacacagagtccgagagctaactgtgcggcgtgctatggaggtcgatggaatagtgaagctccgaccgctatacgcatcaaggcgtggggtgccaggagcagcactttgaccttgggtttggtttatgccgggctttacaaccaacggttcaacgtcggggatagaaaaccgcgaatgtctccatggaaggcgtaaagttccaaccgacagctttttagtggctaaagggtaattgggataaaggaaaatatttgaaaagtcaaatataaattcaaacggtatttgaataaattcaaataaaatcttaaaatagaaaatttgatatcaaaatgtagattttgaatttagatgaatttaggtccaagtttcactggaatcggatctacggtttaggagatatggacttctaaagaatagaatttgaattaaatagggaaattatgaaatagtactgtacaggggcccacctgtcagttctttgtctcttcttcttcttttctctttcttcttcctccttccttcttctgcttc

SEQ ID NO: 6962 - DNA, 1501 bp, Oryza sativa
catccatggccgatcgtcgacgccgtcggtcgatctccccatccgtagctccacctcccctatcctcgcgccaccggcttcgcctccatccggcgagtccgtttttcccctttcccctctccctccacctttaagtcaagccaccaccgccatcatccatgccggctcgaggtgagcccttgccgccgccgttccggctatatatctctccctctcggccagccaccgacctccccgggtgcgcgtcgctcgggaacacgcgtggccgctgtcgtcgaggccgttcatccaccggagcatcggcgcccctcctctcccttctctctgtttgctcggctggaagagaagaagaagcagaagaaggaaggaggaagaagaaagagaaaagaagaagaagagacaaagaactgacaggtgggcccctgtacagtactatttcataatttccctatttaattcaaattctattctttagaagtccatatctcctaaaccgtagatccgattccagtgaaacttggacctaaattcatctaaattcaaaatctacattttgatatcaaattttctattttaagattttatttgaatttattcaaataccgtttgaatttatatttgacttttcaaatattttcctttatcccaattaccctttagccactaaaaagctgtcggttggaactttacgccttccatggagacattcgcggttttctatccccgacgttgaaccgttggttgtaaagcccggcataaaccaaacccaaggtcaaagtgctgctcctggcaccccacgccttgatgcgtatagcggtcggagcttcactattccatcgacctccatagcacgccgcacagttagctctcggactctgtgtgatcctagccgctccgctgccacccacggttgtcgaagtaacacttccgccctactaaacctgcacctacctcctattccctctagccgatatgatgtctgctgacaccggctagagaagacactaaatctagtcgttatgttgccaactctagcaacaactagcaaacaaccaaatcctagccgataccctgctagtcaaatcccaattgtcatccaaatttcataccctctacaataccacttatccaccatactctcagcctcatactttttgtctatcagaacctatacataaaatatagagcctggccgatatattgccctactcctcaatcggcctaaatataaccaaaccctaggtataatcttacacaaacctaccatcagccaataccagtcacatatctgctcaaccaattcaattatccactatactccctatccaccaaccaatcaaagtctgcacataaaatataggtgatcttagccgcttaattccctctccaccccagctgccaactctttataacccacacataaaatatcagcccagtaatccatataccctataaaagagataggctatacactaaatcctaaccctcccaaccgtttatc

SEQ ID NO: 6963 - DNA, 1501 bp, Oryza sativa
cctcctccacaccagcttctcccgcggtgccagctctctccgccgtgaccgcggacgcagtagcgtcacagtgtattgcttagcaaggagacggcaagtgacggagagggaagcggggaggccagcggcgagtgatagggagggaggagacagggccggtggggtggtacggcggcggctcccaagtggcggcgcgtgggctcagtgctggccgagctcgccgacctccccgcccccctcgtgcgggcggcccggggagggtgggtcaactcggggcagtagggcggctagcgatgggcggcggggtggcatggcgacacggcggcggcgagccgggcacagccacgcaggacctcgatggtcgaagccgaagccacgaaaggcccgcaccgagatcgactcgacgacgccgccatcagccgtcggcgatggcgacgcgcggctgtggccggcgggggaagcggacgagctgacaccgccgacacgcctcatgccagctctgtcgtgccgctgttgtgctacgtcctcccaagcctgtctgaccctaagctcgcccgcgtggcctctagcttcctctcgacctccgactccgcaagaagggcagcgttggccctcatcgtcgccagtgagctcgtaggaactcgaggcatctagcgttggaggcttgcctcgacctcccggcgagccaagcggcgtcgcgtcgatgcgccacccagcgtcgtaagcaagggggaagggggaaaagggtgaaaagggtagactaagttgtttcactgacatgtgggacccacgtgggtcccacgttgacttagctgccacgtcagacaaaaccggggttaaaatcacccgaggacctaaagtgatccggttttgtaagttgagggatgacgtatatctggttttgcggttggggatgattttgtaatccgatgacaagttgagggactttcgatgtactttttccactatgatatgggtctaaaaaggcccacgtaacagtcactaggcctagttaggttaccacgccaaagtgggcctggatggcccagcccatgttcgtataacgtactagtcaaccagcccacggcccctctccgttttgtcctctacggctctacgccactacgtgcagacttacctagttgtacataacaatctcgatcgttttgctacggcgttgaggccggaacggagccggtcgtcgccggaaagaaacctactcgtagctgctctggtttcctccctacgttcgacccggaaacgaacaccacaagatcagagaaccttcctcaattattaaccatcctgttcttcactgaaggatgatcagacgaaaaactcgtagagtttacatcgcggattgcacatggcgcgtccacttcttccgatcacgtaccagcacgcgggtatcttcatcaacatctcaaccttcttcttttctttttaacctttgcatccgactgacgatgtgctaatgacgatgatcatcgatcatcagcgg

SEQ ID NO: 6964 - DNA, 1501 bp, Oryza sativa
aagggatgtgtggtttcaatgtcgaggtctcgtgttcaattttcaatgcgctcataatttcttatcaagaaatatttggaggcacatctctttctccaaatctcgtttttttactaggtgcccgtgtcctagagcggattggacggagggaggtgatggtggtggagaacgacactggcaccatcgagcacgaagatgggttgacactaacatatgatccccctactccctgctatcagcagagttgccttgatcgcgtcattagctcttaacaccacggtggccgatgtctccctccaactaagtggcaccacgtctctacattggatctgctcgacatagtgtgtaggcggcatcgttgtggtgttgtgtcaagagcacgttccattaccgccaatggcatgggtggcgtagagatggagcttctccacaccaatagataaggagataggtggaactggaggaaagtttttaaactttttgaacctttttaatttttagttttaaaataaatgcttctaaaaacttattctcaaaatttgaaccttttggtcacactatcccgcctgacgtgataaaacaacactaacatgccatatgcaatggacgtgacagttttatccagccacatcagtaagagcggcgtgactaaataacgttgccacgctagcgagactggcatgaccaaataacgctatcacaccagcgagaccgccgtcatagtattgttttgccagccaactggctggcatggctaaaggtttagatccgaaaataaggttttgaaaagtttatttttaaaataaaaaggttcaaaagtaaaagaaaaaacacaatggagggggccgggggaggatcctattgttgttgccgtcaattcttttttaaatattacatatataccctcacagtcacaactcggtagtggcacattcgttgctcatggattcaaggatcaccagtcactacggccgtgccgccgtggcacgtacatatttgaagaaatctaaaatatggccatccggtcgtgacgcccattggaacacagtccaccaaatctgcttaccaccaacccgagttcaatgggaacgtgcatgatgtagtgacccatgaactcagtaatggcctctctctcaagttgatgccggacacacatgtaattcgtggccaaatcctactcaacctggagctaatttatgcttcagtgtgccccaataacccaattacccggcgctatccaatcacacacgcccccacccacccaaatacactttccatggtcgatctgcaggttggccacaatcccagtatcccacattgcaaatcacgcgagtacgtggcacttcacctaacaatgtgcaatgcctggccgcgggctatatatgtgtgttaacctcgacgacttaattgccagttaattaagctagcttgtgtcagctcaccaattaagtgaccactgtactagctcgaacgggtggctaattgtgtactaatgatgcgg

SEQ ID NO: 6965 - DNA, 1501 bp, Oryza sativa
atgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaagcttcagatttggcagggtaacgatcaaaccataacaagtccagcagtgaagtcatctggaaaggcgtcaaagcatgtcaagtgggataagttgactctgttgagaaacataattgaaaggcgaaaattatcgaccctcgcatcgaataacagaagtagctagcacccggagaccaggaaagctaatatgaggcagtttgtggcaacttagaagtaaatgacaagcatgatattctcatgatgacaagcatggtatcctagtaatgacgagctgatctcgacgcataacgtgaaatgggtaacttctatgaggttgacgccaaaaatatgaactatacgaagttctggaactgaagccccatcttcaagtgccgcaacccagacgaagtcagctaaaggttcaaccagggacaagtcaggtgaagagaagattccatctgcaacaggagatcgagacaagcagtacagagtggagaagttttgctaggcaagtttgttatagaagacgcgacggaagaagtcagataagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcggaaagaaatctgcaaacactaaaatacgcacaagaaaaattcgaatgtggcccggagaatttttgttaaattctccttggtcaaaaaggagccctcaaattttacttgaattttcagagcaccggaaataattattaagcaacaaaaacaattatcaaagtttattaaaaagaaaaagctaaaaaaaaaatcctcttcctcctttgggccaagcccagcccaaagtctccctctcctccctctctttctctccctctccttctctccctcctcctcttgggcctcctcccctcccggcccactccctcctccctctctctcccgggctccctcgccctcctctcctcctgggccgcctctcggcccaagccgttccgccccctcccacctaggccgcctccgggcccaacccgagcggcgccccccctgcctgagccagccgcgtgggcacgcgcgccgcacgcgcgctgacgccgcgcgcccgcgtggggcccacgcgccaggccggccgtcatcttcttcctcctcccgctcagcctcctctccctctccgggaaaacctagagccgttcctcctccaaatccgcgcaaatcaaaccatagattccaaaattaattggggggttttaaatcccattgattcctcttcaattcccccccaatttcccccttgga

SEQ ID NO: 6966 - DNA, 409 bp, Oryza sativa
cgcgtgggacccacggcgccggccggtgcgagccagggtgcgcccggtccaccgtgggccgtggggctgccgcgtgggccccacccccgtggaaccagtccgcgcgcccctcccctcggctgacgcaataaatccattttaaattaaaatttaaataaagaaattcgcaaatattcatttaaagattaaatcggattaaaacacttaaattgattttaattgaattatgacgcaataatgaattatttttgaaaaggaaaaggaggattattgcgtcagcgggctagggttttggtggaccgggcgcacgggcgacggctcacgcgaacggacggccgagatcgacttgatccaaaacggacggccgagatcgaacggtccacgaccggctcacagcgaacggccccga

SEQ ID NO: 6967 - DNA, 1501 bp, Oryza sativa
tagcgcgtaggaatgaaaacaaacgatcgatatgcgataaatataagagaactagatataatcatactatatgtttatgtaatttcaagacatgtaacgtccaagactccaagcgcttggctgatgacaaacaaaggaagttcgagttcgcttgtacgaataatggcaaattagcaaaaccattgacataatattaagagatgaccaaagatgatggagaactttccgaaaattgaacaaatttaacgaaaacatttggcagcaaattttgttaataactacgtaactgatatatatatcatggacgtggaacactacattcataaataagagataatataattaatgacgagatgtatgcacgatctacacgtaagtaccttcctccatgagtgacctctagccagctagtttctggagctctagcacttgcttccttgtactccgatctgatttgcctctgcgcatgtaataccgtgcatgcgttctcgctctatatatagagtgtcagcagcttccatctcttgcaaccaaactagctactcttaatttccttctcatttcattcccgacaagctcggagaaacaataaactagcgcatgtgtgtcatccactatccaaagcatttgcctttccgtatggaagacgaattaaaatgcaaattttatgcaaaagcaaaataattgaagttgctttacctctttccatttgtaattgaaattaattaatgattaaagcaataccgttaaagtaggtcaattacgtaccacaccattcgctactactacggttttatgttttaacaggtacattttctgtgtgtactacttccttcgtgctctcacttattctgaacatgcatttttccttcatttggtagtctggaaaagctagctagcttcctaattggaaatgtgagcatcaccaacaaaatatttatatcattccctatccaaaaatatgaggatttatatatgttaaaaatttgctccaacatattctctaatctcattccttatcccgggattatcgttctctttttctaaggaagcattttggcttccaatcgtggcacttcacgtgcaggaagagattgcacacgtgatctagcatgagctggcgtgaggaaggagagcaaaatatattttttttccggtgaagattttatcttggcccaccttttaaattattaggaaaccaattttacctaatctcttggagagaggaaaattttaacaccttaaattattattaggattcccataataaagaaattgggaatgaaattttaggatgctgttggtcatgctctaacttgcttggtgagcatatattaaagtttacccatctataaaatcagacaataatgcccctcccggctatcacatactgggtatatgtagatcaaccctattttcctaagtgtgaaaaaaatatcaaaaaataaaaaaaattgcacatctctctctcctctacactagagatgacaaaaaaaatagg

SEQ ID NO: 6968 - DNA, 1501 bp, Oryza sativa
tgagcatcaccaacaaaatatttatatcattccctatccaaaaatatgaggatttatatatgttaaaaatttgctccaacatattctctaatctcattccttatcccgggattatcgttctctttttctaaggaagcattttggcttccaatcgtggcacttcacgtgcaggaagagattgcacacgtgatctagcatgagctggcgtgaggaaggagagcaaaatatattttttttccggtgaagattttatcttggcccaccttttaaattattaggaaaccaattttacctaatctcttggagagaggaaaattttaacaccttaaattattattaggattcccataataaagaaattgggaatgaaattttaggatgctgttggtcatgctctaacttgcttggtgagcatatattaaagtttacccatctataaaatcagacaataatgcccctcccggctatcacatactgggtatatgtagatcaaccctattttcctaagtgtgaaaaaaatatcaaaaaataaaaaaaattgcacatctctctctcctctacactagagatgacaaaaaaaataggggggggggcagccacattggcgcactcccctaccacctcaatgtcgacacgctatggtggcaggaggatggcgccagagaggctggtgctgtcctgttggacgacggcgccagcgactctagctccaaaaaagaatcttttgtgtgataagtttttttaggggtctatttgcgaaataagttctttaaaaagaacaaattgtgaaaaatcctgttttcctgcatggtgattttttactatatacagaaaatagcattccccaatacttagtctttaaaatggtttcaataaaacagatggagaattgatatttcttgatgtccaacacgtggagaccttgatccattttttaccccccgtccaatgccgcctctatgttctctctctctcttgcatagtagctaatatactaatggtgatatatattaattagatacttgttgaatcatttactaaatatatctattgcttcaaagaaacgttagtgatttttgtttccaacagtcacgtataagccttttctgtggatgtgtttgcgtttttgcatctgaatcatctagttttcgccgacaaggcacccaaaagcaagagtgtaaaaaataattactaataagtaaaaatccttctgtttgtatgtcaaaattgtaaaagctgcagtgaaatgagcatagctcaattagttgcctaccatgcatggttcaagtcttagacttgatatgaatattcgaatttacgatcaattattcttttagtggtaggtaatgtacccgttaacactaatatgtgtctatcatgactttataaatatcaaggcataccagctcaatcttttgaagatttttactattggggtagggtatacgtgtctacgttgaaaatggtgagcgtgagtgcgttgtgggcgtctgcatttgta

SEQ ID NO: 6969 - DNA, 1476 bp, Oryza sativa
ggcccatatagcagtgcttcttgccgtattttaaccacaagtattcagtatccttgtgacaataaggacacacaaacttgccttttgtgctccaacctgataacatggcatacgcaggaaaattatttattgtccagagcagaattgcacgtagcgtaaaattctttttcaccttggcatcccatgtttcaactccttcagtgcatagctgtttaagctcatcgatcagcggctgcaaatatacgtcaatgttcatccctggagatctaggcccaggtatcagaatcgatatcatccaataagattgtttcaagcacaaccaaggaggcagattataaggaattaggatcaccggccatgtagtgtaagtcacattcaacatcccaaatggattgaatccgtctgatgcaagtccaagcctaacattgcgtggatcagatgcaaaccgatccctgaacttttcatttacgtgcttccatgctaatgagtttgctgggtgccgcactttcccatcatcaaccaattcttccttgtgccaacgcatatatgtcgatgtggtctcattcatatataatctctgaagtcgaggaataagtggaaaataccgaagtattttacgaggacgaaggacctttttctttggtcctccaataccacttccttccccgagttttccagaatctatatttttccacctactctccccacatgttggacatgtgttcatcttatcatactctccacgaaataacacacaatcattgacacaagcatgaatcttttggtagtccaacccaagatctcggactaccttacgaactttatccaaagtatttgggacacaatatccctcatggagcaaaagacagaataagtgaagtatttgctccatggcattgttgctgataccgtacatgcacttaatctgaaatagcctaacaatgaaagatacctttgtagcctccttgcaccctgggtataattctttccgagcttcttccataaactgaaaaaattgctgactcatttggcaccttaatattattatctctgatatccccgtgtatagcaccactaattagcgaagaaagcaaattatcgacagagccgacatcatcaacttcggcttcactaatctcccgatcatccacaaccataggtttactaacagaacgtttctgttttatgaaatccttatcaaaccctctaccaagcaagtgttgttgaacctcaattttcgttccgtacgccatgcaacaacacctagtacatggacaggccgcagtctctcctggataggtaccttcaaatgtatgttcaatgaatttctcgaatccaacttgccacgcatcatctgactgagacaatagcatccaactatgatcatcatcacatgccatattccaagtgagaaaatccgttaccaaatttgcctaagggatagtatgcaatgaaataaaccaaattttaattaca

SEQ ID NO: 6970 - DNA, 966 bp, Oryza sativa
cagttccacgctgcatcatcatccaagccccccaaatcgagctccagacgcgcacgaactaagcgacggcgaagccgacgacactggagtactggacccgtgcgcttacctggtgcctgtagttaccgtagccggaggagcccgcgacgagcaccgcccacctcgtcccgacgccgtccttctcctcctcctcggtgccctcgctgccgcgcggcacggtggccacctcctcctccaccacctcccccggcatccgaatcaccggctcccacgtccgcttggctccggcccccgccgcggccgccgacagcgccaagagcaacgcgaagcaccaccgcgccgccatatccctcccctcttctccgcgcgcgacaataccacgcctacgactctacgggacaccgaggtggttgaagggaagcaccgaagtaggcgccgcgccatgccgccatgcaaggagggtagcctgcggcgcggacgcgtggggcgtgaggtggacaggtggcgccgccgccgcttcgtcgtcttctgcagccacggcaaccgccgcccgccgcctcggcgtgcgtggcccagcccaactaaaacaagtcaagccgcgaagttaacacgggccggaccaactgatgagaaaccagcccagcccacattggagactgtacggcggacaaagcggagagttacatcacgctaaagagttcgcttccatgaggagaaagcgtaataagcgttaatagtactaagcggaagcttcgagaacccttgagagagatccgacggcccacgccacgccgcaacaatcatagtggtcgccgattttataaaacttcatcttctccgagaccttaatcccccatctaaccccagacttttcctcccctcctccctctcctccggccccgccgccagagcccttccagaagcttccggagcccgcgccgccgatctgatcgccgccgcgtgcca

SEQ ID NO: 6971 - DNA, 1259 bp, Oryza sativa
cggctcaggctctggctccacctccctcgccttcgcctcgggctgctcctgcggctgcgacggcggcgacgagctgggctgcgacgattcagaggcctctggtctctggatcttgatgttaagcatgaggccgagcacctgcatcatccggggatcggagaggtacatgttgaggctgctggggttcctctgcacatcccgcagcatctgcatgaagtcgggctgctcgaggtatgcgcgcgtggtcgggtcggaggcgatcttggtccagagctcgggcccctggaacatctggcctatgccgtcaacgccgctgggcggcgggcggcgcggcggggcggcggccgccttcttggcatcggcgaggccggccttaaggccctcgttggtggggtcgagggcgaggcccttctcgtaggcggcgacggcgctcgcggcgtcgccgaggccgaggtgggcggctccgaggcgggagtaccccttagcccagtcgggcttcagctcgacggtcttctcggcgtcggcgagcgcctcggagtagcggtggaccgaggcgagcgcggcggagcggttggagtagaggacgtggttccccggggcgagcgcgatggcgtcagtgaagtgccgcgccgcctcctcgtagcggccggccgagaaggccgcattacccttcgccttcgcctcgtcggccatggcacgcggcggcgatcagatcggcggcgcgggctccggaagcttctggaagggctctggcggcggggccggaggagagggaggaggggaggaaaagtctggggttagatgggggattaaggtctcggagaagatgaagttttataaaatcggcgaccactatgattgttgcggcgtggcgtgggccgtcggatctctctcaagggttctcgaagcttccgcttagtactattaacgcttattacgctttctcctcatggaagcgaactctttagcgtgatgtaactctccgctttgtccgccgtacagtctccaatgtgggctgggctggtttctcatcagttggtccggcccgtgttaacttcgcggcttgacttgttttagttgggctgggccacgcacgccgaggcggcgggcggcggttgccgtggctgcagaagacgacgaagcggcggcggcgccacctgtccacctcacgccccacgcgtccgcgccgcaggctaccctccttgcatggcggcatggcgcggcgcctacttcggtgcttcccttcaaccacctcggtg

SEQ ID NO: 6972 - DNA, 540 bp, Oryza sativa
cctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgttcaatgattgtgtttatttctaagcaatttgaaccaacgtgaaaattgtttagagaatagataaatgtgagaaatgcttctgaacatgtattttgtatttttcatgcaaattacaatagaattttgaattgttttacatgttttatctctgtttaaatttgaaccaacgggagaattttacagagcgtaaacaacagagttttgttacaatttatatgaattgtatatagatcttccgctgcaaatagatgaaattaatgaaaattagtgtttctaaaattaaatttcgaaccaacgggagattttaattttaggaacattaattatgtgctatgatgttgtaatttttctgaccaacgttgataattgcaatgttatagttat

SEQ ID NO: 6973 - DNA, 1501 bp, Oryza sativa
agtttttttaatttctgtcagcgtgacattgaagttggctctaaatagatgaatttgtaaatataaaaattttccgaccgtttccgtttgttttcgaagaaaataataaaataatataccgtttccgactatttccgaccgtttggcacatcccttgaatcagcgagtccaaatcactcaaaggggcaaactgcaacaactcccacggttagagttaataccgatacagacttgggacaaaacgccaacaagcaaatcggagcaccgaagtcattgatgcaagccacggatggcgcgcaacctgatggacgcactccagaacgagtcatttccttgtttatcagtcgattagcagtctaaatcgagggaacatcaggtgagacggtgcataagttggaaatgcgtgccagtattgtatacgccttcatttgcatggatcactaatgacatcgctccgggttggcctccaaagttggtagtacactagactttatactccatgcattagatggtgcagccgaaagccttaacgcacaaactgatgagaaaataatatttacggttaattattttttatgataaaatactgtaccataaacaacaagcggccgtactgagtttgtcaatatcaaaagatacatcaatctaattgatgcaagtgtgactgcgtgtatgcgagcacatttgtttataccgtacctctttaaaagtgagatatcagatacagtagtacaacgttttccttcgggccacacagacacgggagccaaatattgcagtattaatatctggaaagtcaccggccggaagaaagagctcggcacgtcgactgcaccggtgaaaaacacaggatcggtggccgcccactgcaccggcgagcgcaggacgatccaacacatgtgttcccgagcgaagccgtgctcggacaccggagtagctagctttattctcgccctcatggaaggcacaaagccacgccctcgcccacaactaaactaaaaaaaaaatgctcgcattacaaacgtcgcgccaatgcgccatgcctctggaccatgcaagacgtcgctgattggaatagaaactctctgtgcaaaatgtgcgcattcttaatcctcgcccgatcgatccaaggagtgtcgtttacaccacaaatctcgatcaacaccaaacgtttcaacgctcacgatcacatccatgtatacgttcatttactccgtattataggtacattttgttactgcgttctgaaatgtgccaactttttcccatggtacaacaaaaagatcgcgatttcgctataaatacctctccatgactccatgcaagctccaatattcccagttcaatctccatttgtaataagctagcttagctcagcttgtcgttgatcttgcactactctttgcaaccatggctatcgaccttggttgtcacgtcggctgtgcatcgccagagacgaaacaggaggagacggcggatcccacggcggcccccgtcgtcg

SEQ ID NO: 6974 - DNA, 606 bp, Oryza sativa
cggcccattggctcggccgcgccgtgcttatcccttggcccgtacccgagccgcccaaggaagtctaaatcccatccctccttccttttcttatccaaaggattaataaatccttttccctttttcataaatcaattccttattcccaaaattccataaatcatttcctttggtcccgcgcgtctgtgactgtcaataatattcttgagaatattatttctataaattccataaaccattcctcttattccagaaattccaaataaacttcaaattcatatctctcgatccgtaactccgattgactccgttacacttccagtaattctctaaaattgagatctatctaatggcactactaattagtctaaataggatctttcttttggtcttttgtttaggttttcgattgtttgcgtatagttgcggttatcagatttttgtcgatcgcgggttttctcgaagattcgtgaagctccgtgaagaccttgagcgaggcaagtcaccctttgaccaattgatcctataattggaaaatcattattattttgtttgcaacttgcattagtagaatcacacacttaacttgcttggcctcggtttgcg

SEQ ID NO: 6975 - DNA, 1501 bp, Oryza sativa
gttacattatatcagggtccagtttggctgagatgatcatttcaaagctatatcatccaaacaagctgcacatgatttccatgatttttgtatagaacattgaatatatcaaaataaagagttataatttcagatacatgcatataaacttttccaaatatgaatttctctaagaaatgtcaatcaataataggtcagaggtaagccattactagtctatactttctgttgcttatgatcgtttgttttgtgaatattttaagaagtcatgatgattatttcatgtcataccctaattaattttaccaaaaaatatgttctaaccgtgcatggaggaaacaaggggaagtatgtcagaccttagggtgcatgccctctcagttcatttcatgaattcgatctagacagttatgattttttttttgaaataactgaataacacggattatagtgtcatatcttagggcacaaacagttaaggtctaagttatacttccatttccgaggaagctagggttatgacattaggatatgcttctcttttgtttttttagaaacatagtataaacgcagacgtttaaaacacgtgcacactcatctctttaatttgattgatgacaaataaaaatcttctaagtttacttttacttattttccacatcagttctctccctctcatgagatagaaaataaatgcattgttgtatttgaagttagacgtactatactccagagattctctacagtcaaatgcacagtgcctttgttactgacatgtgagcctagggatcatcggaaccacgtattagtaacaaattaagtcatatgacttcgactgtagaggatcctgatccatacactccctcttgtcgatagtatttaacgttgcgcaccggccggcagctaatacagatatagttgattttttgtcaaggctgtgtatttatcaaaagggatgtgtacatagatagcttctttgacacaaaaggaaacctaaaacattgaattaaccaggtaatcgtgtatatgatgaaagtatggcactttttatctagtgtcatgattgctagcttttcctgaaaatatcatcgatccaattcaaaatgaaacaaaagctaccgatccagttgtagaagaaatattacaaacgatcatgccatctaactaccagacttggttatgaagttagcaatgttacagcagacgaaaaggagataaaaggaatttttcgtgctgtttaattgcatatataatatgttttttttcttttgtgttttctcattggtttgatgatgcttatttttgtgtgatgtttttggatcattctttatgcatctagatgctttgttgtgtatttatatgttagtactattctttatcctgttgctaattactacacgtactggacttaattaatatgtcaacgccagcatttcaaaaacttatactaaaagttatgcatgtccttgcagtcttgctactagtccattagtgaataaga

SEQ ID NO: 6976 - DNA, 200 bp, Oryza sativa
tttacatacagtgaaattgacaccgtgctatgccaattcattaaaaagaactgatggattggattgaaaatggaagattaaacatcacgtatttataaagattactgccatcgaatcagcagtcggatcaattactgctgctttaaaagtggaatccttctttcatcctctcctagcctctctaatctatactacttaga

SEQ ID NO: 6977 - DNA, 1501 bp, Oryza sativa
gtgctttatgtatttgtgtactgaccgatgagtatacattgctattgaaattttgaaattttatcatattattattaggtgcattgtcctatttttatggagtattatctttatccgggtgatgcggggcccaagtcacccatgcgggtcacctacggggacgggtgatgttttccacctgattgccttcgcgtgaccggggctgaggatacctacaggaggatgggggcgggggcattccagcccaacccgaccctgccccgccctgttgccacccctaagtgtaatgcagcggcaagtagcacaactaaacaaccccatattctcaagccaaactaataatggattaaaaatgaccaaaagaaaaaggaatagtgaagattctttattgctggaatgtaaaaagtatagcaaaattcatgtcaaattttcttacattacatcaatacgtagttctatatgttcgaaatgcctccaacatactccctcaattccaaattgatctacatattttataggtacaccaagaccaagaaaagctaataactctctcatattatatttactctagcaacaaactcaatgcatgcaccatccctactattttctagccaatagcaaatcaagatattgcatgtgggttataaatgcttgtgtgcatggatgcatgcatcaatgtccatttactccaatgcacaaataacaaatagacctaatgaatgaacacaaatatgtatatcatttagaaataacctaaaaaaactatatgtagatcaatttgaaatggagggagtattcttgtagttatcctaaatttcctcttgattttctactgcgttttcccttttttttccccttccaaacagttcacaataaccgcagcttaccatgtggttaccgtctgaaatcgcgagtaactatctcaaaactatggaaccactgtcagatcaaaataatttgtttaaaattttgacgaattttatacggtttttcacagctaccgagcaacacccataatatcgtgaaggtcgataacccccgctgaaatagtatggaaaaacgatggattagacatccggctgaggtactattgcctcaaaacctcaaaatgtggatgccgtaaagattaattctccgggtttcataattcttgatattttgaacaatgaaacggcctttaaaacatatttttaactatatttttctatttataatatatacaataaataaacatttttttatttttattatagtactttgtgaaataaatctatatatgttattctagtgattataaacaaaataaattttaaagccattgatagttataaaagtttgttctcatgttcatcaagaattatcaaaccaaagagagtaaaacctactccagcttgtaaaaatacactccagtcacatgcggcattctcttcggcatttctagtaagcacagttatatcaagcggatctacaagcaaaatacgagaaactagcacacgttata

SEQ ID NO: 6978 - DNA, 1501 bp, Oryza sativa
cgcaaagatcggcaaagtgaggttaaatatagttttgacgtggccaagtgtgataagatttttgattatcttttgcaagagaaacaaattagattacctaaaggccatgtcataccatcacaagaagagttgaaacgtcgagcatattgtaagtggcatgattctcattctcactctactaatgattgcaatgtgtttcgacgacaggttcaatcggccatagataaaggacgattgaaattcaccgatggctccaagatgaagcttgatcatgatcattttccggtgaatacaattaattttaatgctaagaaggtgttgattcggccggagcaagccgaatctactaagggaaaggaagtggtcattggtgagccaagacctaagatgatggtgctaaagaaaccggaggttggcgtttagaaggagaataagggtggggcttcaacttctaaggctcctaggaagaccaaagtaaccttccatatgcttttggagaagtatgagaggcaaggtggtgggagggtccacaacaaagggaaaagaccaagatcacctcctagggagcgatttggtcattcaccaagacgatcgcgttcacttccatattttcatccacaaaatatgtcatggggttcctatccaatgccgccgccgggttatccttatccttacttcataccatggggggcaatgccgccaatgtacaatcatatacctccaatgtgggaaggaccacggatgccaattcatgagcgtttgtcttcaccaaacaaaagccgattttatggtaaaaatcgtgttaatgaagagaagagagaaggaaagcgcaccatggtggaagaaaggacttcggaggtgattactatcaaagtagggtcccatgatgtgcttataccttctggagatggagttggaaagtccccaagcaaaaaatccgaagccggtaccagctcctcgcagtcgaccggtctgaccaggccctctggccggtctgaccgcggccatgtagccggtctgaccgggatatcaggccagtctgaccgccgacttgatagcggtccgaccgacgcctcaggccggtctgaccgtgcgccaagtgttggtctgaccggcacatttggccggtctgaccggtggtctgcgaccggtctgaccgggctccagcgccggtttgatgggagggctgcaaagggcgatgtgagggcttcatcgtcttcaagcaaggttaatagaggatattatttaccttctggaacagagccgaatcctatgtggatgcctaaggatttgacggctacgcaaaagagaaggttgcaacgtcttcgggcccatgaattaagggagaaaaaggccgaagagcaaagagataaaaggttcaatgagttgcgaccaccaccggtatggaggcctaagtccatagagaaggcaaaaccgattgatgtagagaagaaggaagaacaatcggttgatgaaagtgaatcgtctccaaaagaagaca

SEQ ID NO: 6979 - DNA, 1501 bp, Oryza sativa
gtcggcataggtggcgacgatcccgctgtgcagctgccttggcctcgggcaagcaacggcggcatgtcttcaacatgccgtggattttgttgacttaggcatcaatctggcatgttctgggtattgatttagacatcaatatatgatttggacagagtatgctcgaattgagcttcttccgattttgtgaaacagatcgaggcataggagaagttggcggtgcagttatgtcgacgtttggctgggttttggatgtgagtcatttttttttcactcaaacgccccgtggctgaaaaaaccggcacctatagcagtatataagtgccggtttataaaaaaaggcttatattatataatagatgatgtcggcgaatgatcaatcgtgtgcccagtggttaatgatgtgatctaacagatgtagcatgtgccggttttgttaataagaaaaggtgataaagtgttgaaaaaaatacagcaggaaatttttcacaaaaaaaaggttaggaaagggaagggaaaagaacagtctctaaccatagagattgtgggaaacgaaccaacgacctatcggtcaaatgtttcataggctaaccaattgagaatcatgaacattgtgctatgcggtgtagctacattttaaaaatatgaatattcagctgagcgttgctatgtccacccctgtatccgatgcatgttggagtgcacggcaaagaaaaatatcagtgtggacccggactcagtccccgtgtgcgggcggccgcctcctgctgcgcgccgcccgccgcagtccgcccgccggccgcgcgccactcgcgccgtccccgatgtcgcccgccgcctgccgccgtccgtccgccaaccgcgcgccgtccccgatgccgcccgccgtcaacctcgccgccaaccgcgcgccgaccgcgcaccaacccgccgcacgccgcccaccacgtgctgctcgccgtgcgccggccgccgtcgaccccaccgcccgacgtgcgccggccgccgtcgacctcgccaccaaccgcgcgccggccgccgtcgagctcgtcggagtggagagtgagggtgacggcctgatgggagggagagaggggtgagagatgagttaggggtagttgagtggcatttttgtgtaaatatgtaaaaaatttaaagggtagtgggtcttttggtttggagtggagttgtggagcagcaaaaacccagctccacccccgtagtacaaatttgtggagtagctctgccaactccgctcccaaaaatagaggatctggactgtttgacatagctcctgctccaggtaagttggagttaggagctggagctgtgccaaacggggccttagtataggcaagtcacaacgtgacataccatgcatcaaagccgtccaaaatggatcgaacgggagatggcgtttgggcccgcctgcaggtcgaaatatcgccgctcgccacccatccagccgtcccgcgtctggccgtcgccgggagcgcgagcc

SEQ ID NO: 6980 - DNA, 1008 bp, Oryza sativa
gaaaagttacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgaacatgtagagctcaattttagatgaattttgcaagttgaatggctcaattcggagttcgaatgaattagatatgaattttagaagttttgagccatttgaatgaatttctagaattaaactcgatttattgcgcaattactatttatttttacaaaggaaaaggtcctcgctgacgtcagcaaaggggaggggcggcgccggcaagcgggccccaccggtcagcggcacaaaggcgccggtccaccgtggaccgggaccaccgaggcggtccaccgccggtccacgggatccgacggcccggatcggcccaaagccgatcggacggccacgaggcggcgcggctggggcacgggcacggcatgaagccggctcggccgagacatggcgcggcggcggcaagggggaggcggcaagggggaggcggcaaccggctgcagcagccggcgacgtggaacgg

SEQ ID NO: 6981 - DNA, 1400 bp, Oryza sativa
atagattttttttttaaaaaagaaaacattgtaggggaatcccccacagtaaatgaatttatataaagatcaaaagaataaatttacaataggcttaaccaatccgaaagaaaattcctatctcctagaggtaatctataaataaggatataaaggtccttcttaaagaaacccctccaagaagaaacagatggaatcacaccatcaaagataagcccatttctctgattccaaatatttcaaaccacatagagaattttttcaacaaagtgccaagaccgataagtttgttttgcttaaagcaacatttgctcaaaagcaagagatacatcccagactattccaaattgagcccaacactgagagctgaaaggacattggaagaaacgatgcatgaaggtttctctaattccataagaacacaaaacacaagttaaatcactgttcacaggtgcacaatgctttctatctagcatatctcgggtatttaatctgtcaattagaagcagccatcgaaaaaccttaactttcatagtgcatttacttttccagatccaattcagataaccaggagcttgaatatacataaaatggattgcatatacttttcaagaagagaaagaagagttttcccaaacataactccgtaagtctctatcatctgaaagttgacacaaaggatcattagctgacattaccaaatattcctgaaaagcctgttctgacgttggaagcatgaagagttgtgacagccccttagtagaactcataaaaacagattcctttgtatttttagcgaaagagtaagctcttggataaatgactgatctaatcttgttgttccacagatcatcccagaataagcaggattttccatcacccactttacatgaagaaatccctctaaaaatgtctgcaaactacatcacatccctccaccaaaaagagcctctctgggaaacgtcatgaggtactttatcaatatagtaagaaaaccaaaccagcttaacccatggaacagggtgcttattatagaatttatgcagatttttcattaacaaagcattgttctgaagcctgagatcaattacccctaacctcctcttttctttggctgacaaaccgtctctcaaagtaccaaagaatttttagtagagtttatatgagagcctctccataagcaatgccttctagctcccatgaaattccatgtatgtacataaaattttatgggttgactgtgatatatttcttatatagaaaagtataggcatacgaatcttaatttgtttgtttagttataaatagagcaatagttatattagaaatcaaatgtgtagcatgtagcttaatcatttcaaaattataattattaattatttctcttttcgctggatagc

SEQ ID NO: 6982 - DNA, 653 bp, Oryza sativa
cattttttttttattttcgtggtgacccagtataactttgaccaatatatatttttatttttgcggtgattgagatacaataataacattatgatattacaatagcattatttctaataaaaatctaatgatacaaaatacataaatctaaatatattggtgatcaaacttcagggccgcaaggattttacggcgtcaagtgaaaaacaaccgagtcaatactatcactagttcattgaagaccggaaattcatcggtctaaaaaccgaaattaaaactctcgtctggggagaatttcctttcagcagtcaatcttcttggtcagcatcatatgaaatcgaattgaactgattgaatcgatcaggaactgcttaatatatataaacacgatactacatatatatatacccatagcacgtaattaattaattaactgcgtttaatttaatttgcttagcaaagttatagcatataaacacacgcacttgctgacttcaaattaacacactgacactgactctcccgccgttgcacaagacgcgacggcttcaaacttcaaaattaacgcggcttcccgggctatatatatactacctctccccatgcaattagcacacacatcttttccctgtctctccatctgtccgacaaga

SEQ ID NO: 6983 - DNA, 1501 bp, Oryza sativa
tatctcttattcactgtgcaagttaaaatgttgatcgagttaagttgtttgtggttttgctacaatagtgttgatgtcgcaccatagtcgaaaatcaaccagagaaaaggatatgaaatgttaaaaattgtatgcggcggttatatttatcttttacatgtccagtctattaacatggtctaaagtttggcctccaattatgaaaccggataactgtgtacattgttttgctaatacaacgacatctatgcatgtggagtagtatttatattgacattaatatcagcgttatgtccttagttacttctctctcacccttgctcaagatctatgtatgaggcgtagtatttatatatgcctttgatcatctatcatcttccattagaccttgttcagttaatctctaagaaagataggtatgaaattaattcccttttgatgggattaaccaaacaaagtcttcacaaacacacctcgatcctattctcactcttatctaaattatctttgatggtatgtaatgtccttctagcactactagaaaacacgtttttactggcggctaaaacacatttttgcaggcgtccatagcctccgcctgcaaccaaacgcctgcgaaaattaatgacttttacaggcagctaaatccacccgcctgcaaaaatatttttaagcgtaaaaaaaaattcggtgccctagccctacccaccgctgccctccactctcggttagtgtttttggagagagagagggaggagaggggagctgccggatgtgggaggtggggacgccgccactgccgccgacctcccgcctccacgccgcctccgcatgcggccgccaccaccgcccagctgccggaggccgccgccgccatgtcgcgagggaggggagcactgccagccaccgccctccccctgccccctctagccagatctgggaggaaggggccgggagtcgccgccgcccgctgccgggagcacgccggggaggggaggggaggggagggggaagggccgaaggtgagggacgcaggagaggagtgagggagaaagagagaggacttagaaaaaatctcccctatgtcgcctctatttatattccaagtttatttttgtagacggggcacataagagatttgcctgcaaaaataaagggtacttttgcaggcggaccgcttaagtggtccgcctgtgaaaatagatttttacaagtggacagcgagcttaccccggtttgcattttttaggttgccatttagctccaaagatcatgtctgcctgcaaaaataaatacccaacgtcacaaaaatgttttttctattagtgcaggtcactgtcacatttcttcgcatctttatatgattctcactcgtacattgcacatcatatctactcatttttaataccttgttcgttctgtttaacgtatagatcttacatcggtttccgttagcatgttttttaaattgttaaatagtgtattttatgcgaaaacttta

SEQ ID NO: 6984 - DNA, 1501 bp, Oryza sativa
ctttgatttgatcatgcaagaacgtactgtgtgtcaataaaacaaatggcacgggggtagcttagagcattattggagtactcttatataggagttagtagtgagtgatatatctgttctaattaagctccttcatcttattgggttaagggtttttatttttggtaaactggtcactaaaatacactgatacagactagtcctaataattcataagcacattgatgatgcagaggaggccatatgtaggggcatgggcaaaagtgctttgacagtggcagagcagttaagaaagttaaagtctaggagaacttgtgaacgaatgctgaggcccaatcaggctgaagatcgatgtgtgttctgactttggctagtttctgcttcccctttgcagacagcttattaatcagatcccccacagtctcatagttgcatagggtcgctagtggtgggcttgatctgcctctgcctctggaaacaatggaggagtagatccgatgtgttttatggaacatgatcgattgatcatatatcaaaggcggcttggatatgggtgtgcaaggcaatcagagatcctgtactatggttcacgtatcagtggcacaattgcaaactatacaaaatgacaatcagataagccacatccacaaacgtaaggatggcgatttttcaagtgcggtcgtttagatgggccgctgatagaaatatatttttcaccggggatactttgaaagggccgtctgtttaaaaatcaatttcccttaacctattttgctgatgtattttcacattcttaaccagactatcccgacgtatttacatatatagacgtgcatgttttaatccgcctctaaaaatacaaagggtgtcactaaaattgattttttttaacagtgttggccactaatactagtaagtacatgctaatttatataagcacattgatgtagagagggaccataaacaaaaggggctttggcaacggagggttgcggcgtggactgtagcgtagcaacaaagttactaagtctaggccaaacttgtgaaagggcgaggcccaactaggctaaagattggcctttttgcttacgcgtttgttgtgttcctctttgtatttagcttaattagatcccatgcatatggttcaattgtcagcgatctcccaatagttgcgcagggttgctgctggtggctctgcctctgcgtcaggaaagagtggaaaagagaacatcgggacatgcaacttcactgaaaataaatatcaaatatggatatgtaaaataaaaaaactactaattaagttttaataatttcaaacttgaaaaatgttttatctgatattttaaagcatcttctatttatatataaagttttcgcataaaatacactatttaacaatttaaaaaacatgctaacggaaaccgatgtaagatctatacgttaaacagaacgaacaaggtattaaaaatgagtagatatgatgtgcaatgtacgagtgaga

SEQ ID NO: 6985 - DNA, 1501 bp, Oryza sativa
tacagatcgagtgaatatgagcggaagggacatgtactgattcttcattttgtactccatattttaatgtaatgacaccgttgactttttgtctaacgtttgatcattcgtcttattaaaaaaattatgtaattatcatttattttattgtgacttgattcatcatcaaatgttttttaagcacgacataaatattttcatatttacacaaaaaatttgaataaaacgaatggtcaaatgttgataaaaagtcaatggcgtcatacaaaatatgagaggaagggacaaacattgactctcaactaaaggattgtagtacaataggcatctatggtaagaatccatgggccatttgagaagggaatacttttaggtgaattatattgtaggacaattcggttgcgggaaataaatattgaggtcgtttagcttaaacgaaggagatacgtataacgtgtccatcagtaatgctcctctgtaacaactgagtataagacttttgcaggaattagttcaccttccacataaattctccattcaaaggagacattactccctcggttctatacagatgttttgagttatcataagtcaattatttttaagtttaattaaatttataaaaaatatagtaatattattaataaaaaagtactccattagttctaaaatgaagttatttctaccactggagtattatgctaaaatagagctatttttcacctatcctctcatatcaactaatcagaatcattttttatttaattttattacatattttctcttctcaaccaatcacagtctttcccaaatcatttacatctactttcttatattattcatacccaactctataactgtttacattctggacttgtaaaatatacagaatttctaaatggccattgacaacaaaattgggatcaaaatctttcaaatttttaacctcaggacatgtgtcatgattcatactccagcgaccccttctgtgtccctggcgaagttccagcaatcagaaacggcacaatgagttagggtttaagatcttggtttagggttgggttgggggaaagggaaaggggagggggggtcaagaggcttagagggatggccgtgggaggcggcaacccgttgtagtgggggacatgagcaggcgggtttagtgctgcagtaaaccgaagtttgtagttaggaggtgacagtcggtgatggcggatcggtagtggggagcccaaaaggagataagatggcgggccatgagcacttgctgtcatcacctgcttaggaaagagaagtgcgagggaaggaggctagccatgggtgcatcgctgacgccattgacaactttaggccagctggcgaggctatgcggcggcgcaggcatcgcacgctaggaacgacgagagaggagaggagatgggtcacagctagaagtgtagtgcacgaatctcaaagcgataaaatggtccaaaatttacaagattcagcttttctatcaaaa

SEQ ID NO: 6986 - DNA, 462 bp, Oryza sativa
tttttccttgatcgatggaacaacaccctgttttttttatactactccatccaaaaaaaaaataatcctagcaatgaagctgtaccgtatgtgtgtttttttgattggttgcttggattggattttatgggacggacggggtatgtatgttaggaggggtatgtaacatactgaatataagatgtctcgtgtaaatgaaacaaagtgaattatgtacatttttttcttcctaaaaagttggaaagaactatgtcctttttcccctaaagtacaaagtaaactactaaattgatccaagagcgaattatgctccggaactaggtgcagtggcgatcgagtcctcgatctctgccgatgcttcaaggaatcaaggctgctcgatcccaaatctgaaccaacaatgttcaggaatttacagttcgtcggaattattgattttgatctctgctccctccctctagg

SEQ ID NO: 6987 - DNA, 1501 bp, Oryza sativa
gatgggccggtgttaagagcaggggcatagtatagtgagtggtttgaaggctgggacgccgatgacgtttctccaatggtgggaggaaggaaagccagtgtggcagggggcaccttgctgatgcacgctggcttgaggaggaggaaaggagggaggtctggcgggccttgttggcaccgttgagggaatcgaaggattgatgggagttgaggctgtgagggttgcatgaatctcaaagtagattccatattctagaaaatgtaagagggtatggttttaaaaagataaagaaaacataagagggtgagatgaaactttttcagcatgtttggtaagagaaggaaagggttttttgggagttgggggagggattcgcttttggagtgagtttcatatttactcttcttgctttgtttagtcatagagatgagaatcatgggaaatatcccataaattgaattttatgtgatgatttatgggttggtatagttggccaaaaggcctgaggcccgatagcccaacccgattggtgttgggcacatgccggcatggcccgaccgttggaccatgtctgggcctctgcctcggcgcggtgggccagcccggcacaacacagtccaaagatcagggagctcaatagacgagggagccaaaatagaataattccagccatgtatggtggccgaaggagatgagggatgcaaaatagacttactccagccatataagagatggccgaaagaaatgagggaggtaaaatagactttttccaagaaggagcacaataggctttcatgcctttgggctagcccgtcatggcccacaagtcttattgggctgtgcctggccgttgatctagcaagtgggtggcccggcccgggtggcccgtttggccatttatagttagggatgataatgggttgaggcccatggtccctttcatagcccatctcaaccctttaatatttcgagcattagaactactaaatttcagttaaatcctttttttacgtagccctcatagttttttagaccaaaaatttggatcaattatcacccatatgtacagttcaaatttatctcgtcatacttataagagaaattcccttccaaatacgtggtcatatcccggtattgaaaaagtgagagtttacacttgaactctttgtcctagtctctcctaaaactctcacgtccaccaacgaaatactagacttaatggtctcaaactctcatttctccataacaattcccccaaacagacgcatgcaccggttctatataggtagccgatccttctgctttactgaggagtgaggagagtgataaacctggtcagtgtccagtggcctcgtccaccggactgcgcggacgcatggggtgcgtgcacgtgcggtgctcgcgtcggccgtcgcgccgcgcacgcacgcacgcacgcatgtgcccaccctgtctgtcccgatgtccgtggacatcaaccaaaccatatgcatatgcacgc

SEQ ID NO: 6988 - DNA, 1501 bp, Oryza sativa
atgcgaaagttgtggtggagttgggttcgcctagctcgaattgcaactgcgcattcaggaagcggcaccactggtgcctctggtggttgttctgatggccctggctcatcggcgggtttccggcgacggcgctcggggaggcggagcaggtgcacgtctccgcacctcgtgaggcagtagaccttacctttgtcgtggtagacgacgtcggtgagctggtcgccggtgacgaggcggacggggtcgaggacggcccacctcctggcgcccgcggtgacgtaggcgatcctgtcgatgtcgcagatggcggcggcggcgtagtcgtccttggcggggctgggcgcgaacacgaccttggagacccacctgctctcgtagatcaggggcgggaggacgatctccgtggtggtgatggggttgaagagcacgaacgcgctctgcccgccgtagagcgcgatggacaggacgagccacccgttgctggacccgacgcatctgccccccgtcagtatcgccgcgaggtcgaagcaccgccgcgtcgggagggacgccgccgaggggcacatcctggcgtcggacagcacgaggagcgccggcgacgccggcgacagcgccgaccgccacgccgtgcacgccccgcgcgcgctggcgtagcacttgaggtccagcctgtcgccgacgcggcacagcaggtccggcggcaggtccgcccagcgcctgaacggcgccatggcggccgcgcccgcgtcggctgcgtcggcgatgggcggcgccggcggctgatccggggcggctaccccgctagggttcgaaggctccaggcgattgccaggttggggaattttatgctcctcctcctcctcctccatgctcgaatccggtggccatcttgcggattacccccttcactccccccgaattacccaaatttggcgtcgcgtggccggcttcacgccacgcgcgggccgaaggcccactcggctaaatgggccgtccatggcgcgctcgggatagaccgcgtccacgcaccgggctcatctcagccgtccacgtcgtacaaacggacgtctggatggggggggggtcttggcccatgggtgagccgtggaccggtgattttggctctccgccacgtttttcgccgaatcgaaaatttgagtttttcgagaggagcccgcccatcgccgccgcaaaatttttccccaatttctccctcttctccacttcgcctatttgagcaatccgcttcagagattttgcggcgggttggatgtcatagcgccatcgtggaggggttcgaagcggcaggattagaggaagaggcgagcaaatggtgagtggttttttgagatttgggggtccgttgttttgtccattttttgatgaactgtttgctgggtgttctgatgcgtctgtttgcctctgtcgttgcagatctggtgaggtttttgaatctgagcaggaggctgaggagggtaagtgagaagtatggcagattctt

SEQ ID NO: 6989 - DNA, 1501 bp, Oryza sativa
gatgcaaaaccacctcttttatagatgttgggggtcaaaggctaattgaaacaacttctcaaatttaatttacttcccttacctatttcttctacatcttactcctttcttcatgtattccacatctattcactctcgaatctcctaattgcttatcatctctaaattctaatctctatgacatcagagaacattctaactgacctaccaagtctaagataaatcagcatgccttcactttaatagggtcttaccctaatgattatttggaaacgtatgttcccctgcaacggcatgtctctggttgttgctatggggtactcacagggtgctaagtgtgcctaggcagactagaacccattttcacatgaacacatccgttttgatgtgcacaaataacatcaggcctatcatcatcaagaaaaaaaattatcatggtcgtcttcattccattcaagcaaaaaaaaaaaaaaacaacagccaagtgagcacacataaaagacaacacattcatcgtgtgatcacagaaacttcatactttgttgagttagaacttttgtcctaaataaggattgagattatataaatttttatacagagtacatattttaacaaattttattgaaaattttcaaacttgagtaaactgattcatattatttttaatcaccttatttgtagcattattttcttttaacaccccccccccccaacaaaaaaaaaacatcaaaaaccacctatacggcgatacgtgttcgattctggatggcttcatagccgtgatctggtggtcgccggctcgccgatctctgctcccgcggcggcgccattgctagcgccccgtcggccggcaccctcctctccgcctccgcccccacgctccgaatccatggatggctaccaccgcacactccgccccccgcactccagccgccctccgcgctcttgcccttccccccaccggagaaggcggcaacactgcaagctaggtagcagcgacgaccttgctaccggctcgcctcatcagccatagcggcagcctcccgatccccccagggtgagcatccggtaagtaccccgtctgcatgtgccgatttctttctgatcgctcaaacttgcagatagatctgaactaccagtataccactgcttgattaatgccgtataaaaagccaattccgagtgcgttgtaggcattatggaacgcacatttctccttttaccacaaggagtacattttttttttcatatacgttgtgtaataatccttaagtgcgaagaactacttctcatgtccatctttcattagagcatccctcttggatacaaacatacatgcccatacggtatttatcctttgcttagctatgtacatatagttaagagatagtagatgcaaacatgcaagaagaggagagtgagatttatttacgaactaatttcatttatggcacttaactcataaagcttatatactattttgatgttcaatgagaaaaag

SEQ ID NO: 6990 - DNA, 1501 bp, Oryza sativa
gagagagaaaaatgagaagaaaagaagaaaaaaggaaaatgaattttaagtcggtcccatttgtcagttaagatgatgccatgtcacgtctgtgcttgtggcataccacgtcaacaccacataggatcttagaggggctatgacaaaatgagacctaggcgacactttgacaaattctgggatttggatctgcatttttagagtttagggacttagataaaacacccctacaagtttaagaaccgcatgtgcactttactcttttacattttacatttataaagtgtggtaaatgagcaaactatgatgactctccgatgtctcaaatcaaagttgtagctatatatatacaaaacacattgtggcttgaggcacttttctgttgcattggaagacagatagcaatcaaagcagaatactggaaaataggaattagatcttcctagtctagtaaaaccttcacatttgaaacctactacagactcatacttgagtctagttgaaggttcagacgttcagctatcttgaaaataaacaatctgaagtgagctttatgaaagctacactcatatgttacctgggaatttatctaacagttgtaaatattgtaccacacatattagtccaacaaataggggaaattcatatatttgtcaattaaatattgacggaaagaatcagatgtttttcattgtgccatacagcatatctcggaaagccaaggagacagaaatataccttacctttcaaaaaatcatcatcctcattcttcagaagatatgttagcattggagttattagtatccatggagccctccacataaagcctagacttgtatgcatttttatgtggaggccatcaatccatgtctgatcagcaaaagaaattattagtcagatccgaaacaccgaaaacaatggtgatctggcggcgacattgaaacttcagttaagtctgaagacctgaaacagcgaaacaattcatagttgaactcccgattgatttgttaaactatcctagactcaattgggtaaattattaaattggattgaatacaagattggttgcaggacattgagtcaaagtactgaaacatttgtaaaatcaaaattgtaatcagaaaacctaaacagatgcatacacttccctgtgatgtcacagtagtagttgcatgcccatttgtaattggattgatcctgtccaaaccggttctccttctccatcatctaggcccgcttgctctgtggcaacgggaggaattccactcattagaaccctaaacccacgaaatacagagctaaaaactgaaacaacacttccatctatcagaacactaaatccacgaaggagagctaaacactgaaaatgcagttaggattgatgtgtttcacctttacttttctgcacatgcaggatgacaccccataaaaagaaccaaacgctgatccatcgtgcttgcccattgaggacggctagatgagactccgggcaacggtgata

SEQ ID NO: 6991 - DNA, 1501 bp, Oryza sativa
ctgaacccgaacaagttgtcagcggcaagagtacaacctgttggaattaatgaataggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcagggcaggcggcgcgtgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgtcggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagttttgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatgtaataaattaaatcattatatgcccataatatcaacacaaccaagaaccaccaaaaatcattttcctatctctcttcgtgcacgcttaggtcattttcaacccaatgagtaggatagtgtccatagtattaaataagctgtcatttagaatgaaagatgatgtggcaaagtgaataaatgatgaaagagaatgaaaccatgtcttgcatgagatatggtttctacacaacatccaaaatatcatgtgagataagtagcattaaatttaaatatggaatagtggtgtttgtattagaagagtagtgcctagaactagtttcttgatgatatgaagtttattaaaactatgtttagtgtcttgggttaaaaatggccttagcacgagcatctacaacagttttttttcctgattactagtactcccacgtggccacgtcctaccccatcaccgccgacaagtccaaactgatatgcaagtccctatttaagttgagctgtctgtgttcatcagcccatcactctcttctgtctatgtaggtca

SEQ ID NO: 6992 - DNA, 1061 bp, Oryza sativa
aaaaacctccgcgtcgctctcgcacgggcggctcgggggcgaaaaccctagctgcccgcgccgccactccgcctcctccacctcgccgcccccggagctcgccggcgggaaagctgccagcgagcagggaaggcggcggcgaggcacatcaactcgacggcctccacctcggcgcgacgaggacaggggaacgacgaagctctccgccgcggtcagaggcggagacggtggggctgcttggagaggcggtggatccggcttctttgaggccggatttggccctccgacgcctggatctggccggagcagctgctccggcgtggcggcgcgaggcagctggccggcctgggcatgttggcggcgtgaggtggctcggcggcgtgcggcctgcctgggcgtgaatacggcgcgagctgcggcggcggctcggcagcggctcggcagttgggaacggcggcggcgtagcctgcccgggcgcggagacggtgcgagcggcggcggctcggcggctaggaacggcggcggcgtggccggcccggagctacgggctgggagcgggcggcagcatggcgctggtgcggctgcccgggcgcagcggcggcgtgccgcggctcggctgtgcggccgcgagcagccccatggcgcggccagtcctcggctgccggggtgccgccgcgatgccctgcggccgggtgggtggcgtggcgtggccaggtggggcgcggcggccgggcaacaggggcgccggagccggaggggtagtagcttcaccggcgtcggcgtaggcctagaaggcagtgcaaagggagctggcagtggtggatcgtcttcctcgttaccggtcggcaccctcgccctttctggagctcctccccttctttgcggggagtttctgggttggattgaggcggcagcttgtcagcgggggaagcttaggttgccgaaactatggcacccagtcccgggttctccttctgccagatctagcaaggaggctggcgggtggtggaacagaggggtcctgggccagctctcagggatggtggttcgttggcggaagc

SEQ ID NO: 6993 - DNA, 673 bp, Oryza sativa
gttgcgatgaagcctggtatgaatatgccgggactgacgtgctaactccaggagtcagcacgacggctccggctagggacgagtgcctagaggctctcatcattccgacgggacggggcgaggcgtgcaaaaggccgcctgttgccacctaacccgcgatctgaccggtctgtgaccggtcacacactgtgacctgtcacggaccgaacgagtgtgctgcgctgcattaaatgcggcgtggggcgctcgtctaacccgcaataaacgcggttaggtgagcgccgctgtgctcacctaatccacacacatggcgccaaacccacagggggtcggggcaccccagcccttggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccttgtcaccgacagtagcccccggcgttatgccagggcgatcgccctcctcgaggaaagcgctcgggcatgacgccactccttaggcctggtgacaggtggggccggtctctacaggcgggtaggaatccagtggtcgcaaatcgcgcacatcggcaagggaaaaactgaccgataataa

SEQ ID NO: 6994 - DNA, 1501 bp, Oryza sativa
gattgcgtgcttgaattgatctccggaaggagacgtcaagataaatcctgctcctgctccttggctgttgagtgcaccatcgaacgccattgtccatgtttcgttgtcgatttggttgtctgatttgttatcgggcatagtccaatcggctactgtcggtgacaagggaccgggggtatcttgactagaggtttggggcagctgcagtcacccacgtggcctgaccccctcgggggggtcgggcccgagggtgatgtggccgcccctccctctgtctccccgaggggtcaggccgctcccgtttcggccccaagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgtgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccgatgtcaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccacttaagaaggggggagctcgggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaa

SEQ ID NO: 6995 - DNA, 1501 bp, Oryza sativa
ggaaatcactccccgtgattccctccctcttttccccctctttcccctctctctctccctcggattcgtccggattcactcccgcgatcttcgccgacgcatcaatggcggccgagatttccgcggccgattccttcccctccggccgctctctccctctcccggcgctatataatcgttccccgtgcttcgctcctccgtttccgccactcgccgcctctcctccccgtcggaatcgagcccgcgccgtcgcaccttctctccgccgtcgccgccgagctccggtcagccgccgtcgtcgctccggaccgtctcccgccccgacgccgcccccttcggcttcgccgcgtcctcgccgacctcgtccgctcctccgtttcgcccgccgaccgccggagcgccgtcgtcctcgtcgacccgagccgcgccgccgccttcctccgctccggtcgtcgtttccgccgccctcgtcgtcccggggtgagccgtggaccgcccctttcgcttcccccttccctcctctctctcgggtgccgctccgccgcgccgttggtcgccggcggcgaccatcggggcgcgggtgcgccgcctcctgtcggccgtgccggcgaggccgccttcgggcgcgccccgcggctgccaggtgggcccggccgtcagccgcccgcgcccgcgggtgcggctgacgcgtgggacccacggcgccgaccggcgccagccgcgtgcacccggtccaccgtggaccgttcggctgacgcaataaatccgatttttaattaaaatttaaatgaagaaattcgcaaatatccatttaaagagcatataaacttcaaatggccataacttggccatttgaactcggaattggaccgttcaagtctctaatttttccttataaagccaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccctatgattgttattgttattattaccttgttcaccctagaataaacaaaacctcaactagtggacactctactcatggcatcactagtttaattttaggtagatgcttcgcaatttaattaggtaacattaggtggtttttcaattttagactttgggaaatattcatatcacctggatactctggaatggtctggttattgtggaattggcttcacaccgctccctcttttcaaaacccccaaaatggttttaggctgggctcggggtgcatggttttgatagtagcacctcggccatataaggaccggt

SEQ ID NO: 6996 - DNA, 838 bp, Oryza sativa
  unsure (1)..(838): unsure at all n locations
tttttaacacgaagggtgtaaatgtttttttatctatggaaggaagccccgccccccaaagccaaccaaacacggcgaagttgaggggggaccacgggcatttgcggaaggcccaatttagacacaaaggcttccatcctttaggaactcttttctgagtttgggaaaaattgagcagcttgagtacaccccggtcttcaacaagacacaccnccaattgcagaattaatgcaaggaagtacaaggagtttatatataagggttagggttgcagtaacagcatttaaaaatattttagtggcccaaagctattttgtaaacacgattctagaactattcaatattatttatcaaggcggtgaacccacacgaacctgctttaacccagggcntacgatgattcagaccgaactggcaaccggacctgggtcccagctcgtcccaagccaacccaggccaaccattccacattttacttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggtaggcaggactgagcccctagcagcaggacaccggccctgtgccatgacatctcgactaccgaaccgcagcccgtgtagccttcatttgtcctaga

SEQ ID NO: 6997 - DNA, 578 bp, Oryza sativa
  unsure (1)..(578): unsure at all n locations
tgtggtnnnnnaatggtagccctctacctcccgcgccgcctcaccatcctggacatcgcgtcgcaccggtggtcgaagcccaacgcggtggcctcggcgctcctctccccgctcctcctcgccgccgccaccgcacccaccacaaccgccctcctctccgccttgctcgccggcatcctcctcgccgctgccgttgcggtcgccacggacgctgcctctgttgagttgtgatccaaatttatttgcacttaataaaggccagcttctgctgtagcgaagcggaggcccattgccagaggcttgggccggagcccccgcggtacggatcgttatcccttttagggttccaccatatatatacctcttgtaagccgccatgcggcgttgaaacctcaccccgatatagtaaagatattttgctggctggcgcctgtgtttttctctctcatgctttgggagggtttttccacattaaatctcgtgtcttttgtgattgatctattgttctttattgtttatttgcccatcgtttcctaacaagtggtatcagagcttgttatcagattagggtttcgcga

SEQ ID NO: 6998 - DNA, 1501 bp, Oryza sativa
gttgaatcggcaccccacaatattaaagttcttttctttacccccaattttattttttttatcaagagaatggcgtagctttcactagttcaaacgaaggagtggcggatcttaacatgggacatgggggttcacttcagttgaacccccaaacccaaacctcttttttttaaaaaaaaaaaaagaaaaaccaaacctttttgggaaccatcaaactgttattagtgttaagggttagggaaaatttctagaacagaagcggtttgacgcaaattcgagaaaaaaaagtgcgtgggtaaagagagagatgggaaagaggatgtggttcctcaccaggatggatggatggatggatgcggcgaggaagcagccgtacgaacgacggcgaccctgctcggtcggtcggtcgctgggtggatggatggatggggatcggcgcaggcggcggtggcggaggatgaggatgggatgcgacggcggaagcagcagggacgaacgacggcgctgacgcccagctcggtcgcgggatggaatgaattgggggatcaaatcaagggcaaaaactgcacgaggagacgcaccacagaggcgtcaaaatggcgagggtaacctagtaacttcgcctaccactcaaaatgggccacacggcacggcccggcccatgcacgattaggcacggctcatttaggccgggccgtgccgtgccgacatgtaaggcctcgccccaagcgtactactacaaatttcagttataggaataagttcatctaaggtcccttaacttgtcagcgaattcaattttcgtccttcaaccccaaaaccatatacaacagatccctcaactatcaaaaccggtgcagataagttcccttgccggtttagatggcggttttagctgacgtggcgactacatggctattttgactcggtcttcatatgacgtggcactaacatggcgcttacgtggcaattcgatctagaaaaataataaaatctgtgggacccacacatcagtttcacacatataaataataataaaaaggtgagacccacgtgggccccacatgtcaacctcaccccctcctcttcttcctcctctctctcccccatctcccgtcgtcttcatctctcgcccccatctctctctatcgccggcggagataaggcgcggcctcctccatgggcggcggcgggcgagctcccgcttccccacctgcttccccgccgccgccgccgtgggaggggaaagtgattggcggatattcttgttttctttttttgtttaatctttgattgtgcgtgtatggagttctggattaggagaaaaaaaaggtacttaactgtcggtggattaggagaacatattagatatagcgttggtggatccaattttaatttgcaaaattttgtcagtacttagctgtcggcggcagtagatctgcagaaatggagtcttttttctgattgcttggttgcaaccgatgcagtgggcagatagaaa

SEQ ID NO: 6999 - DNA, 1501 bp, Oryza sativa
ctgtgtccaacgtttaaccgtccattttattttaaaaaattacgatttttttaaaaattaagtcatacatatttgaaaaatttatgattttttttaaaattaagtcatacataaattactatttatattttattatctaataataataaaaatactaatcataaaaacgatttcaaataagacggaaggtcaaatgttgggcatccaaacccacagggagtactcttagtgcactccactagctggattaggtatggagatcagttagtactcttgacgttttggacagtgacatggtcttaaaaaaacaattttgaccactattttttataacaatatatataaaaatataaataaatatatgattttatcaaggtattttgtaagacaaatatttttatgttatttatagtcaaagtttttaaagtttgataatagactcattcaaaacgacaaaaacgacaagtattattaagccagcgggaaacgacaaaaacgataagtattattaagccagagggagtattcatccacctgtgagtagtctgcatgtcgatctgagcttctgtttaactgagtgaacttgtgggaactaacatggatttaggtgggttttaaactctgtggcacttccaaaatcgccatagaaggttaaaggtttatacagtacggaagaaaagtttactcagacaaattttcttcacacattcatgataatttcaaacaacgtctagatatgatccgaaattaaaggtggctggacaattgggaagtcatcaggaacctccaaatcttaatagtttcccgtagtctcagtagtatcattacatgagactagtctttcagagagcgaacaaaccatggctgtgtgaactttgtttcctcctcttgtctgtaaaaattaaaaaaacaaattaatgtctcaggtacactagtgtcttctgcatttgtatctccggtagctagccacacggacgattgcactcatacttccgtcatgaatcgcttcgcggagaaagaaaattgatcgaagcattgcttattctaccttgctcgtaggctttaatatatttgtgtatttttatctcctaacaccagtacaccacccatgccggtcgaaacagtcggtttcactaatgagctagacccaagaagaagaagaagaagaagaagaggaggagaaacagaaagaagaagatggaaggcatgcatgatcaaggttggaaatttcggaccaaaatttcggaaatttcggtcatttcggtgacccccgatacgatattaattcggccgaaaattttgaatttttcaattttttttcatgaatttggataatatttgttcaaattcaactaaattttgttcaaaattttgaaaatttcagaccgaaatttcggtgacccccgatagaaaaccctgaaccgatatagtgaaccctgtgcatgatacatcctcccagtgaaggagggataagaagtaaagtggaaatatgccatatgaa

SEQ ID NO: 7000 - DNA, 1334 bp, Oryza sativa
ccctgtgtggtgccggcgcaaatctttctcccccccttaatttatacccccccccggaaacacaaaaggaataaattcatttaaaaaacctcattttttcacaaaaaaagttaccacatttttttttggttaccaaggttaaaaaagaaaattaactcctgttttcccggaagccaaagttccaaaatgccatacatccaccccattgagtattaaaagggcctattgggggtttgggtcaaaaaatttaatttaccctcccccatttaaaattttgatggtattgaagcctacaaataaaaaccacttatttaggaaaactaaaaatatgaattatgttttaccctttctaaataaaggaaagtagttgtttaaactacccgcctaggaaaaaagaatacgggcaggcaagtccaagggatttattatagtcaaatatattcagcatatatttgataatgggctcgtccagtgccaagtgatactaatatagagaatttgcatttttgcaccagccaactacaagagaatctctaaatgagactatcttaagaaaaactgccacaagtttttttcaaaaacttttaaatatacctttaaatatagtgtaactatatactataacttttataacttatatttaaatattgaaaacacatataacttcaatataaattttaagtaacttttagtttttttattaaaattataatgtagttacaatataattacaccataactataaaatagtcgtatttgaaagtttttttttccaaaaaatatttactaattcccttttagaaaactttagcataagatacatcatctataaataatactaatgactacaggtaaattctttcatataaaccaatataattgatgcgagttacacttttttttctagaaaaatctgtatttgaggtgttttttccctccaggtaataaaaaatttaaaaaagtttatttgacagtagtagagacaactttatttattgcctttgcagtacagtacagacctgccttgtgtatgatcagaagtcagaacacagcctgtataattaaggtaattttatcgcgaataatctaagacctccttgaccgctacatcgaccattaattaattaacttgcttaatcattatattactcctcgattgtaccactcaaagcttgtgctagctgtggatgatcagtggataagattatgtacattagtataatattagtagtattgagcaccaaaacaaatactaattaaaaatttgtatatgaccctacaacgcaatattattaattaattgtgctaactaattttacaacccggtccctagc

SEQ ID NO: 7001 - DNA, 981 bp, Oryza sativa
gagggatttggagaggcgattgagtggggataggaaagggaaagaagactagagagatcgaggcgagagagttggtcagggagggcggcctagaatgggagagagtagtgggaagcaggagaggaaaaagtagaggtgggggagacgaggagagaaaaaaaatgagaggtaccaacgattacgaccgatgtggtcgaggcggacaagaaaaaccaccatatgtgaaaatagcttatttttgtaaacaggcttcttgacaggtctacctatgaagggcctcgattgaacatttcttgtatatttgtacattttgacagatggctctctttatagcccatttgtaaaaataagggaatattaaaaagttgttatttatagtgattgaaaataatatcatctactattattttttccgaaaacaccatcggaacgtaaaaaagaattcctgcaccgttttcatcccttgaagtagacatataacgagttgacggtaacaatacgggataatcaggagctcaccctgtacacaattaggggagaaaacagtcggaattagtagcatctcttctgaaatatcgctcgatcgaccggtaattgaccatatttatcatttaaactacttagtctcaacattaatacaatgcagaaataaattaaagaaaaaacaaaatttatttacagccaaaaatgataaccaccagaaatggtatccctcatacggacgtcactaggttgattgggaatttccataacctacattccacagatacggcaaacacctcacgtgtccgtatcagatacatcctcggatacggatttatatcggatacgctttgatatgtatcccacacgtatctccgattaacaccattttcaaataaacaaaataattaaggatacgctctcgatacgtccgatgcgccaccgccattccccctggcctcgacgcggccacaaccatctcacgaagtgcagtaacga

SEQ ID NO: 7002 - DNA, 1501 bp, Oryza sativa
ccggcgagctggtcggggccgatcccctcctcctcgtggaccttctcggcgcccttgtagaaggtgaagtggggcacggcggtgatcccctcccggcggcacagctcccgggtggcgtccgactcgtcgcccatgacgaggaggaagtcgacgtcgccgcaggtgcggctcagctccaccatgcacgggtagatgcggctgctgttcacgctgtggctcgccgcgaactccaccaccaccagccgctccttcgccgcccgcagcgcgccgtcgagctcctccgcgctgtgcacctgcaccacccgctcgtccccgccgccgccgccgccgcccttcttcttcgtcgtctccggcgcctgctccgtgccggacaccgccgccctcaccgcgccgccgcgccgccgcctcctcaagaacctcgccgtcttgctcctcccgctcccgccgccgctggccggcgtggcgccgcccaggctggtcgagccggcgagcgtggacaggaaggcggcggtggatgccatcgacgacacacagctgctagctcctagcttgacaagctagctagctactggctactgtggctactgcctagtgatgaaggagaagaggagaagagaggatgaattaaagaagagagaattcagcaagaaatggatggcaaatagtagctggaatccaatcagagttcatccacacagccactagttcaggattgggtttgtggctggggggtttcaagcagctgagatttttcaagttgggggggactgattattttgcccatgcacttttgttggtttctcgccttgtcaatattcctgtcttgtttttttcccttctagaaatatatattcatggtttgttggtagctagcacaagccctgattttttccccccacatttaatttatagtcatggtcagaatttgttttttcaacttttggagaattgggggctggtattgagttcatgcatgcatgtaaacttggatatttttgatttattgtgatcaagaacatcaattgggtcaccccagattttgttgtgaaggttattccaccaggtagtggatttttaccccctatcccagccctgttgtagctctgcttcttaaaaacaagacaaatagtgataaaaattctgaaaaaaaatcaacaatatagagtactatattgcatctactacgactctcaaccaactaaatgggggaaaaagaaggcaaaatatatatacccatgaatagtgcaatatttacaatttgaatttgtcatttatgtttctcattgtgagtcgaacttaattagtcctcaaatcttcggatagtagacatatatttattataccaatgctaccagttttttttcataactagtattggcatgtattttgatacaatgaatcaatgatgagacacccttaaggcgtgaaaaatttctcaatccattgtgatgtattatcacaactagttccttacttaaaagagggattttgaattttttga

SEQ ID NO: 7003 - DNA, 1501 bp, Oryza sativa
ctcacggtggcgtcttccccaggagcgaggtccgccgaacagagggcaccaggcagcaggcctccaggctcccaatggcgacgggcggccagcctccagatcttggcaccaagcggcagcggcggcggcggcatcttccaggtcggcgcgctttgtcctttttccccgccggccattgctcgtcgtgtcgcccttccggccgccgtgacatggatcccaacattggggagaaggaggaggagacggggtggccgccgccgtgccgccgcatttggggtggtggtggtaggcgcggcggcgggcgtggggtggtgtgcgctgcggcgggggcgatggtggcgaggaagccgtagatgttggaggtgccgagggagacggcgcggccgccgttgaggtcaatggtgtcgaggaagccgagggagagggatgaagggaggagtgaggctgacatgtggggcccgcgtgggccctaccatttttaaattattttctgtgtgaactgacttgtgggccccacgggttttattattttttcgaatcgaattgccacatcagcgccacgtgagtgccatgtcagttgaagacgagtcaaattagccatataagtgccacatcagccaaaaccgccgagggatctaatttgtaccggttttgatagttgagggacgaaaatcggattcgttgacaagttaagggacctcagatgtacttattcctttttttttcccatcagagctattagtcgccccgcggcccatcccagcccattacaccccaaaccacacccctcctcccttcgccctcgcctctcaaacctcgccgcgacgccgccgcccccacccccgtcggctcggcctcgccgccggtggggctgtgcgctcctctgctccggcggcgcagcaggggcggtgcaggcgcgcggcggcacggccgcacggcagcggtagtcctgctcttggcttcccgctttcggcgcattcgcttgtggttagcacttagtatagtctgtatagaggcttgctgctttgctcttagtatttgctttgctgattttatctgaagttctattttaccgattcgactgaatgattagcctagttagccatcaggaatcgaggattcatttaaccgcttattgttattcaactttaacacttgcttatctagttagctaaggggattcaactagcatatggttaagtgtggctaagtgtatatcagtaattcactatattttttatatgagacacaatcgtttggaattcagagaatttaatgttcattttgtgtattagtatgttattatgaccaattttatcaatatactatacgaacctatgctcaatgttacggtgcatatactatatactatataattactagtacgtgatattatacaagctaattattaggattttgggtgtagacgtgtagaaaaaaaacccatgttattttgaatacacagcttctaaatcctaggtccgccactttagcgcagaga

SEQ ID NO: 7004 - DNA, 1284 bp, Oryza sativa
ttatagcatcttttattatggtgagaagtgtgaaactaatcacgaaagacattgttagacccgcccataaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacga

SEQ ID NO: 7005 - DNA, 963 bp, Oryza sativa
  unsure (1)..(963): unsure at all n locations
taatccgtttttaattttcccggcgaagaagcaaaaaaatatttgttttaaaaaaaccctctttgttggcccgaaaaacccccccaaagttcccaccccccctttattcttataaaaggtgatttttgagaaaacccccccccccaaagaggtttgattttttctgagttcaaatgtttattccaatttttaaataatatatttattgggccactattatnnacggtcttagcccatttctttttttaatttcaaaaaattgattaataagggtcaactggaaaccaaacttattcctttgtgttaggggagggagggtaatattaggttctctaagaaatggatgcaaacttctcctgttttgaaaacatgagcacgtacctttaatgtactcgaaaattacgtttttttagaaagatgttcaatatcaaagtaccggtttgtatattgtagaagtttttgggtaaaattacatgcctatatcaggccttttacataatatagaagtgaattcgaaattttagtaatgncttagcttcttcttattgactactcaggttttatgagatcagagaaacaggaaaggcgtcgtctttgaacctatgtttgcacgtcaagacaaacatcctatgcgtaccacagcatggccaccccagagcacgccgccccccccccctggggtggtggggcctcccgtcccaaaccccaggcatcttcaggcctgaggcctggcccagcacgaaggcgaacaaacgcattgtgcgcgaaagccacaagcagaaggcgaatagaacacgatgccgcgattgccaccgcccacgtcttctgatcttctcctcacggcgccgaattcgcgcggcgcaacagcgcaaggccacgcatcggagcgccggcggccggcttcccattttccttccactactccgcacaacggtcgatggcagtagggcacgaggtgcagca

SEQ ID NO: 7006 - DNA, 1047 bp, Oryza sativa
cggaagtcccacaaagatgagggctcgcttcggataaaggggaggggttaaaaacttggtgagtgggagaaacaccaaggccttgtgtcgggggttttgaataagagttccataagagggcgggtaccccgcgcggggggggaaattccatttgtccggggggtgggttgggtcttctttgccagggataggtttgggcgcggttttttacacagagagccgctgttttacgctcctccaaaagggggtcggggacttggttttttaaggaaggcaggttatttttcgctttgagaaacctttttttcatgaactatttggggatgttcccaaacaaacagtgggggggggttcgagcagataaggctgtgggctttgtttttggcgggcaaatggagggaaatggcctcgattagaatagaatagggacagggtgaacagttagataatgccggttttgggattaatacccttaggtgatttattatcggtggaacaaatatagccgtcccacattttttctccaataaattggggtggaagtagaactagttctcacccctacgattaaatacgatcaatggccgggattattttctactccaagtagaaagcaccggagcgagtctcgagtttgaattgagggggtaccggtggacatattgtgaacatagatgaattgtagctaaaaaatttttcttaactggttcctgggcaccctcccccttcctacctagctttgcccctgcctattacatgtggtcaatgatgtcattgtaacaagatagctttcgtggttggatccaatgacaacatcaagctgagaggcttttacttcctgaatgcattgcctcggagaacctattccatgagatgtaggaagaaaacatgttgagtttgagatgaatatgtgaatgtagtcgatgagcaggacttgtagttttcataaatgttagaatagaattatattcggactcatatcataagcacctaatcatctggtgtactgtcgcctcctttgctctgaagattcttgcatttcgttcc

SEQ ID NO: 7007 - DNA, 192 bp, Oryza sativa
  unsure (1)..(192): unsure at all n locations
attacagcccctctaaatgtatgcatatgnacgttagaaattatattgttccctcggcatgcaacatgtcgtcgctatatataaacgagcacatctcgtcgtccctcgccattcgatctcctcaagcgttggcattcccaagttgttatcattcacaagcgtggtatatatagggatcgaccgaaacagcca

SEQ ID NO: 7008 - DNA, 1501 bp, Oryza sativa
cgcgggagtgggggaacggcgtcggcgtcggcttggtgtcggtggaggtggtgaaggggcggtcagtggtggcggcagcgactccatctccagggaaaggtcacatggctcgccgggcagtgtcaccactgccgtccatccgtggtaggcgcagtactgcaccccctgcacacagatacggcgaggcacggcggcaaccggagacgaaggcggaggaggagcagccggagtagtggccaccacgatgcgtcggcgagggtggtggcgacggccaccagccctagcccgacgttcatggtgttagtggcgaccgtggtggtggcggcgactcctctccgatcgacggagaagatggtgaaggcgacgggcgcgctgattgcgagggaggccgagaacggcatccataatccaatgaaaggtaggcatcgtaccttctctgttgaatctcctgttcgcttttctgttagatcaaaagcgatgtttcttccttctttcacttcgcgatctccttcgcgagagcgaaagtgctgataacgtgttgaatgtggatagaattgattgagcgagagagagaattgaacacaaacagagcgaatcgatagatttctcattgatcaacagtacatttatacaatgtgaagcggtgtcaactgcaggggacgcgatatttaggaacatcgcgtcggttgtcgagagggacgctaaagggagagagaggagcgatctcctcttctctaccggttagtataggaaccgttgttcctatttccttgggtggatgagatcacccgtagtttcttaacaaaaggagcggaattgttgtgtgagaaaccaaactggtttgttgttcgtgtggacactggacagagctgttgactgatcgatggtggtgcggtggtgccatttcaaacttggcaaaagtaggtgacacggtagttgaatgttttgtacgtagtggccggccgctggggccacgagcgtgccacgccatcatcaaacacgtttctatctttttctttttggaggtttcgttttctcttggtcaacattaatccgctcgatcgccacgtgatcctgttgtgtcttaattactcgacgctttgatcaaacagcttgaccagcaacgtcgtgtggcatatgcatgcaggcacgtacacagtcagatccaccttggcaagctataatcctgatccaaacctgcctctggaactctattataaatacgtgccttgtatcggtgctctcgatgaactctacaagtcattttgtcgccatcagcttctttcatcaccaactcgatcagaccgtgagtggagtaccttttaattccttagttttccttagtttatactgcctctattttccttttaaataaactaattaaccaatgcaacaccgttcattaaagaatagaggaagtatattttgttctcatgtgtgtatatatatatatagctagaagttatttaactacctttaaggcatttaacttatcgatcca

SEQ ID NO: 7009 - DNA, 1501 bp, Oryza sativa
gaggtatatttttgctcttacatttttccttttgttttttattttcttatgatatatgtaagggtaaattggacaaatcatataaattttgcatctttttttttcacccttttgaggtatatttttgctcttacatttttccttttgttttttattttcttatgaaggtgacatggcatgtccatgtggcgattttggtgggaccaaggactatatcagcccacatgacaaatttaaaggacttgtttggacaaaatgaaagattaaggactaaaatgacccatgagtgaaactttaaggaccatattagctattctcccatttttttcactcattgggactcagttttacatgtcctattgtgtactgtccccatccatcctaaatcgtggcttaaccactgtccacggcgccgcctccgtctattggggggactaataggcgatcgatcaccaagcgatcgcccaagcgatcggatcggcccccctcccctatactccatacactcctccctcctcttcccccttcctcctccctttcttctcttcctactacagtacaccacacaattttttttaaaagaaacaaaaagttagaaaaatttatgtatataaatactatatataaaaaaatttgaattcaaattcaaatttgaatcgggtatgtaaacttttgacttataaactttaggtgtataaactttagaggtatagaaatactatatatagaaaatatttgaattcaaattcaaatttgaatcggatataattcaaattcaatttaaattgggtatgtaaaattttgacttataaactttaggtctataaactttaggtgtataaactttagatgtataaaaatactatatatagaaaatatttgaattcaaattcaaatttgaatcagatataattcaaatttaaatttgaattgggtatgtaaacttttgacttataaactttgggtctataaactttaggtgtataaactttagatgtataaaaatactatgtattaaaaaattgaattcaaattcaaatttgaatcggatatataaacttttgacttataaacttttggtctctaaatttagatgtgtaaactttgggtctctaaactttagatgtgtaaacttaaggtatatgaactttaggtgcataaatttattaaatagaaaagtaatgcggtgccaaaaaatgaaatcaggtggagggagggagggggagggggattgatcgctacccccgtccccaggcgatcgatcaccgatttggatttccggcgatcctgttcatttctttgaaagcgatcggaactgagacggacacggatagggggagccacacggacgagccaaaaaacgaaattttgtttattttgactcaatccgactcatcctcccttattactccgactcggctccggcgcgttactcctgtataagagaggaggcaaatcaactcgacagtgcggaacaaaccaattaggccataccacacga

SEQ ID NO: 7010 - DNA, 1501 bp, Oryza sativa
catattatgtatgttttgacttgtataaataataataattttctttgttaatgatattatatttatggtaaggcactttattgttttttaagaactggaaagatatttttgctaaacataatctagaatgctataaagattaataatattgaataatacatagtcatataaatatatataatttttatggataaattagagaacgacactttttatgaatccaatgatcacaatgcactatatatattgttgaagtcagttgttactttgactatttgatagttatatggcaatgcattacaataggattttttgagacaaaaatacggattagtttttttagtcctttttttcatgacgagttgggttttttacatttctttagagaggtttttagggtatagtttttctaagggggacgaatcgattttttaagggaaaaaggagaattaaagtgcagttgaattgtttcagtgttttttaaagttttaatggaaaggaggcattttttaaagaaacatttagtgatcgtgcttttaaaataattaatataaatacatataccttatattatcgagatcatgcttttaaaataattaaaataaatacatagactgtatattatcttatagagattagatttaacgataataatgtgaatttaatttattagttacttatatatatatatatatatatatatatatatatatatatatatatatatatatgtgtgtgtgtgtgtgtgtgtcacatatccctatcttttatctccaaaatcgattccttagtcctaacgtaagccattcttaaccacggcaccgctgctagttgccgccgtggacgcagtccaagcaagaagctcaacggtaatgacgataagcaatatcttcctgtaccgtcagaattctccattgtatattatggtttgattggtttattccacggtagtgtaatatgtacttgactatatatatatgtgcatgctaatttaatgtcatgaatactgttgtaaaaataacttgtctccctcgccggaattctccattgtgtattatggtttgatcggtttattccacgggagtgtaatataggaataggcgtacttatatatatatatatatatatatatatatatatatatatatatatatatatagctacatgctaatttgatgtcacgaatactgttgtaaaaataactcgtctccctcgcgttttggaatcgtatttgaagttgaattgcgtggtttaagctaatattaattttgttttacagttgaagttctatcaactaaagatttatacacaaagtaaaacatttgaaatttttcaaaacaatgaccaatattattctgtactgagttgttcgtgtgttgcaacggaataacctaaaattaaacataagatgattatagtttatatttatgatatgagattttaagaaaaacatatattcttcatttgttcattaactcatctaaaatgtctttttatttct

SEQ ID NO: 7011 - DNA, 1199 bp, Oryza sativa
ggggtgagggtccattgaagcgggataggagtgaataaagatgtgtagatatcaaagttttggtgaggtgggagcagagagaggggggggggctcgcgagagatcgtaagcgaggaggaggggtggttaagatagtttgtaggatgatatagacggttgcgaaaagcgagatgacagcgagggagaaggggagttaagagagagcggtggagattaagaaggtagtattgtaaggggatgggagagtaggatgggagggagggggaagtgaaaaataaagggatggagagtggggtgtagaagaggaaagagagaagtgcggggcgaggaatggcgggaggataaaatagtagttaatgatgaggggaaagggagatagaagtcggagtgtaaaagtgtaaggtagtgtgttggacataagaaaggagcaaagaggaggtgggaagaaggggtaggttgttgtgattaaaggaaggggaagagaaggaggatgatagaataaggttaagaggggagagaaaagggacgggtcgtggatgggtggtaggaggagtgtgtaatgtgtagattagtatagtagaaagcgggagagggtgaggaagggagaggtttttatgtgggatgggaatagtgtgggagtgaggggggaggtagaatgaaataaagagcggcgttgcagggagaagggggggggtagagagatgtggaagaatactcctttcggccatggaggagggcaatttttgccccccccccctataaagcccagtccctcctctgtgaaatttcattatattcactaaaaatccaaaaaaaacgaaagagagagaggggagggcagcaaaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagatatttagaggacaatattgtagagaatgtaacttagggcgtagtacagaaatgcgaggttaacgcagttaatgttttcatcaggcacaa

SEQ ID NO: 7012 - DNA, 1501 bp, Oryza sativa
cggtcatgggcggatgtgaggtgattcctaacgtagttttgtttgactactgcttgtgaaattgctgttgtgaaaaggggtttgatgtttgaaaaatctgtagctgacgggatcagctaggcccgggtggccgtttgaaaagttgttggcccgggtggccgttgaaaagctgttggccgagtgccaaccttgttttaagatctaaagactgatacattgcacatactccgaccggacgggacgcactgtctcaaccgtgtcgtttgagaagcactcacttagttgtttcagaaaagagttcaaataaaatcaattgcaaaaataccagcctttctttgaagcctgcattaaacacttatttcccctggcttgctgagtactcctgtactcacccttgctctatataaataacccccccagttgctgaagaagatgaagcggatcctgctgatgacgagttcttccaggagcaagccggttacgatgagttttagggtttcggcctagttcccaagtcgcgcctgtgttgtttggtccaagccctggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacaggctaattccagtcgggactagctcggggcgtgacagttcctgagctggcaaaggagagcgggccgagcgtcctccacacccaacgcgccaccctgcacagctagccgccatcgtcgcctccgtgctcatgagggtggtagtcagagagagagagggagagggaaggggaagcgacaaataagaggataaggtgctagatttttatttgtagtagttatcccgtgtgtacgggatgctgttgagtagttttttttttgttggatataaggctagagcaagcctagcctaatttggcaaggttagttgtttggtaccattaagaaaatcttgctattaaggataagataacacgaaaagacaagaaaaaggtagcttacgagggagagccgattcggcttgtgttcaatgacgaccctttcttgtgtgatcctcaattagttagacacataagcctaacaaacatcaaagaatcggtttactttactagactatagttcagaatagcaaacaacgaaatgtacacaatattattagtgttacacgcaaacaattaagaatataacactcaatggctgagcatgggtcaaacacatgaaacatttatattaaagttacaagaattaccataaaagaatggcatatactccctctgttcttaattaaataagtatagttttaattagttaaagacatattaacttattaagcaagatattaaaagactaactatagttttagttattaagtactccctccgtcccctaatataatggattt

SEQ ID NO: 7013 - DNA, 1501 bp, Oryza sativa
cttccaaaaataagtctttaggcgatgcttcacttggcctagttttttagtgatgtgatcaggttttgtattatactacctccatcccatattgcttgtcgctttaagttttattttaatgtttaatcattcgtcttattcaaaatattttgaaattattatttattttgtttgtgacttgttttatgatcaaaagtattacttatcatgttttatatttgcactagtttttaaaataaaacgaatggtcaaacgttgcaagaaaaagtcaaagcgacatctattatagaacggagttagtaacctctttccatctggactcaagcttgctaatggataaagtgcatgacataaatgggtactcaagcttgctaacggagtgcttctttgtttctaaatatgtattgtgtggatgtgctaaatctaaagaagattttattgagaaaaaacaatagttaccagcctattgaatgacacacaatgtggtacagggacgcgtagagtggatgagcattggagtggagtagatgtggacctgtttagcaggactactccatctaaaaaagaacagagaggattaaaatgatgtaaaacaaataaattaaagaggtgaagcggtgttgggttacttcataatttcacttcagacttcgctcttagagttatttataggagtgaaaatcctaccatgttgaatccaaattgattttacatcttccttttaagaattaagtttagataaatattttacttgtgttattagcaatcataaaaacagacccaacagccaagcactgaaacctacgaaggtaatccctaaacttaaccataaaattgaataccaaaatctaaaatcagatccttttttttctttggcgagtacaagtagattctgattcacaagctgagcaaaagatgcgttcacgctcaggtgcacgttttgtacagtgtgaaatgtattgttcatgttgcccaattgctggattagtttagagtaaataaaattcttaatttaacttagccactgtcctagcacagcagcgaccactctctttggacatggaccggcgatctggggtgtgttgggaatcctgttcctaatactaagtgctcgcacggaaaacgtagtagcgattagcgagtaattaattaagtatttactatttttttaaaaaaaatagattaatttaatttttaaataactttcgtatacaaactttttataaaaatacaccatttaattaattgaaaagtgtgtgtgtaaaataaggaagatgggttgggaagaaggaccggtgatctggtcttcgtcctcctcaagaagtcaaaaacacaaccattccgagctcccccaccaaacaccatttgcctccactataaatccgagctctccagctgcttccactcctcaggaatcggtagttgtcatcacgcgcacttccattccgctcacctacccaccggagaagaggtagtcgccgccgccgccgctgtcgccgtc

SEQ ID NO: 7014 - DNA, 1010 bp, Oryza sativa
  unsure (1)..(1010): unsure at all n locations
cggctcgcgaatagaacgcgtatatgtagaaaactcgcccctccccnccccacacgcccccataataaacgggagcgatttaatgtgttgtccccaccgcaacacgagacgagtatagacgcggccggccaantagtttaccaccacgcggtgtgtgtgcgccacatatataggcgcgcgcgaattttgtgtgctctttttctacgcgcgccaccagaaagagcaaagattatatgttgccgcgtcttctcccttcttataaagaggtttgtgtgaggaggccccccctatttgtgttatacaaagcggcgtttttgtatntgtttttgagacccaccaatagtaattgtctatatagtttccgctatagaaaagggatatgagcttcccctcccccaccccgttaaccccgtttatgtgcgcgcgttttccgccctttccccaagggtagagggtggaggagttaagtacgcccgtccccccgcttatttacattccctttgcaatcccctttgacgggcctttattcccctttcggaaaaaaaaaaagtaaaaatgttgtgttttttagaccaaaaagaagtttatttgcttccagctttagggttaacccatcccccgttcagtccactgcaaagggaggcctgtcgttgtagccaacccttacgatcggctcctcccccggaaagttcttcagcggggagtccgcgcgccggtcccacgcgcgcaagcagcggcacctcgacgagctccgcgcgcacgcagggcaggggcgggggtaggggcggaggcggctgggggcggcgggcgccgagtccggggctggcgggcgcagaggagaggccggagacgggcgccaaggccgcggctggcgggcgcggaggcgaggccggcggcgggcgccgaggcctcggatggcgggtgcggagacgaggctggcggtgggcgcggaggcaaggccagctacaggacacccggttcggctcctccgccaccggtcgcccggtagc

SEQ ID NO: 7015 - DNA, 1228 bp, Oryza sativa
ataaaaagatttggggggggggcccccgccgccctccttttattgtaagggagggcggctcctattttgtgcccgaaaaagggggaaaattctcgcttgtgggggaaaaactaaaaaaaagaggccgcgtaaaacccggggcaataggaacccgcggaaccccggaaggagaaaaccctttgtggccgggaaggggtttctctgtataagggtgtgggccccaattcccgccagaggaggggccccccttataaaccacacgggtggggaacccaaagagagaggtttgcctcttttttattcttttccggggcaaaaaaagggggtattagtttttttggcccccttggaaaacgcctaacccctttcctggtggggggccccgcccaggggggtccgaaaagggaaccgggttacctggttgaaagttgacataaggttccaagggggccttcccagtcgggttgaaaccaattgccccctattagcgaggccccttttccatttttgtttagggttaaggcaaaaaaggcttgttgacccttgggttcacccgcccgggccccattacttgcaactcgtagaggctgtaagtaaacagtgccccactaaattcaaagtgacggtggggttgaaagacgagagtgcctacctccgagccgagagtgcccgccctttctgtcaagtaggctactttttccggaacgcagtccggaataagcgttcctgtgtatatagatatcttcgatgctgtcatttcgaaatgtccgcttcaacccctctttcacctcccaaaaagctaagttggcttgacgagcgcagatgaggagcaataaaaccaagaatctctttcttttccaaatactttattaagttaaggggcaaagagaagcgcttttgctactgagaaagtgaatggtcagcgcgagggttcgacgacttagccgagcgttagcgaagcgtcattctcatagcgaggcgcttcgagttagcgaagcgctgtagtagcgtcggagactatgtgctataatgctgaactaaggacgttccgccttatctatagaagcagtcaactgagttctgaacgaatgggatccttggtgggtaatggctcaatcaatctatagatggaaagccttatgatgggaaactaccacgttaggtttggagagagatgggacctgttatagtttaaggggagcagatgcaagctttttctttccatagc

SEQ ID NO: 7016 - DNA, 917 bp, Oryza sativa
atgatgctattttgtcactgaagattttgtgtgaagccttggagacaacgtacccggggctggggtgagcttaggggggacagcgtaagtgagcgaatgtgcgtaagcccagtcaaagattcctattctaggcggggcgggccatcaaccttcgaatggtgttggtcctacggaccgtgaacggattcgcctctggcctctgggcacgtcggaaccgcatgagttcaccggggtggagcacggtccgccaaaatcggcataggttaggtgctattgatggaacatggtaagcccatctttccccatatgaaagtgctgcgggcacatagagatgtgggtagaggaagtctcaaaaagcgaaagccgagctgtaggtcacgtgacctgcaccgaaaaggtggctgactgggctttctcctggatcaaagcagatcagctcgccaaattcgtcgatcgaatccccggaacgtcgaatgaaaatacgtggtctttctacaaccctatttatatgataggcccggcccctttccccctatccctcccttatgtttaggagcgggatctgcccaagaacgacctgtggtggtacggaaggcacggactccgcaagcgtcccgcaccctctgagaaagaaactcctcaaccattacaagataaagaagtatgacgctctgtgtctgactctattggtcatagttccttgctgttgcggccggtgctcgtttgcgcgcgtgtgaaccaccagatcataaggaaagatgcctctcgtggcatctgagaatgattcgagccgtatgaagggaaactcccacgtacagtttgttttgggggggaaggagcccgatagggtccccccactgacttggcccgggcctaagtgaaagtgaaaaagtgaagtggtgggcctacccatccca

SEQ ID NO: 7017 - DNA, 1501 bp, Oryza sativa
tttacctcgttccgggttgatgaacccaaacctacaacccttgcttttctagatccgggtatctccattttcgtaaccagcttgccttctatctccacccacgaatcgaattaacccgataatccgtagttggcaacccctgtcaatgtatgtttgatttgggaggctaccaattctggaatttcttctcgagacatccccgtcagtcaacttctcttcgggatgggtcgttggtttttgtggagataatgtgtcagccatggtagaagtagctccctgagtaggcatgagcgcccgcctagatgaagggattttctcatcttgaggtgtcgggaggagtaaaggagattgactcttctcagtcattagcctttttattgacactagctctttatatagtaatttattttttgagtatcgtatcggtaggcacagatcattggtattggatatatcgttaggttgtgctgagtcaaatcagctccgctgatttttttccgttgcagaaaagagaccccttaccctttttttagaaaatgatgaatatgaagtccgggaggctgcgggtactatggatcctctgactcccaatcgggttaccttcccgggtctcgccggtgttgcctgtaggtcgtgatgtgcctcgagatggccgtctcctgtctccctgctcgtggggaatccgctcctggggcgtcgctctgctgcgtctggcccgtcctctaggcacctttggggggcagggagtgtgacaacgtacacgcttccctttactccatagggccttttcctcagttgcagggtttggtggcccgaaattgacttggcttcgccaaaaggccccatctccaaagcccggctcgcgaggcgtccctctcgctgtagggcggagccccctcgcctcgctcttgtgacatgctatgtttcccttcttccattctcaagtcaagggtgagtcccatgcgtcagtttgtggatcgcggtctcacgcactaatctctacaggtgcccatagtaggccggccgccctacctaaaccaatcatcatatcggtccctaggccccattgctggaaaggctcggcttcaaaaccgtacgtggagcttccgcctcatacggctcctctagggatgggggtaggcccagcccaggcttgtgcggttaaggttgttgtacacgccctcagttgagcattcagttagagacggcgatcgtaggttcgccggaggagagggtgttgcgagcaagattgcacaaacaaagccctcctgcccgcagccctattctagaaatttggctggctacgttacttataaccgcagaacgagcaatgaatccccaacgacaaacgaacaaggggcggggcattttcggggagtagcccccttcagaagaaacttcctggcacatacattaagggagccatcgaaaggtgactgaaacacctgaaacggggactacccgagctaatgatagaggcaagaacactttccggccaagt

SEQ ID NO: 7018 - DNA, 1501 bp, Oryza sativa
cgaggatgtgcatttactaaaccttttttggaaaagattgacttcagttcggaggcaaatgaaacacttccacaactcgcggatagaattgattgcccggaatcacttattggttggtggttggagtgcatttcctatatataccttttcatttcttggttgaattccactgttaatcgaaggattttcctttgcaattttggcatattgaagtgcgtgcatttcttctggtgaatttcaactagaatagcttgatttcccacacaaatacgagaaaatagattggatttccaaatagattgactcgggctttcttgggcatttgctactctgttgagttgagtaagttgttcatatcgaggttagggaatttcctagctagtaccacaagctagtcgaaatagactttgctattagcttcaagccatcttcccggaatatatcgaagtcaaaccatgatcactcctcgaaaaaagtgctagtttttgacctccctattgaaagtcaaagtcagaagtagcaagctgatatccgtcttgtaattccaaattcctttgtcttcaatttcctagtcgaatagacgaatttactgagaggagagatttttagtttatttagtttttcatttcatattttgatgccgcactctttcttgtccggaggaagaatttcatggaatagaatttcttgaattagctagctatcatagttttctttaccccaaaaccaacactgactggggttgttcaatcttaagtggagtgagttaaatgacttggcttgctcaattccttcccggtgtaatttcataaaaggaatagcactcgttctgcggcgcattgaaccttagaatgagcactttgaccagacaaagctctagtgcgtggagtatcctttcctactagtcttgatctgtctactttaataccggggattcccctgatttccttcctctacaccccgagtagtgatttatacgaatgaattgcctgagcataagattgattacctcctcgtagtgagtggatttgtgtagatggattttccacactcattgtcattcctttctttgtttagcttttcgttgtctagaatatcctaatttcgtgtactgaatttactagctttttgttcccgcggacaagagaatctcatagaaattcagtacacgaaagctgtcagccccagacatggaagtctcccttgcatccttaactgaaaaggagcccgagtagtgagttgaactctgaccagcccagacttctacataaattcctagctttttagctagttgatttgtttgacataatatcatatgtgatttgagtgtggtaccttttcacgaattccactttagagatttgccccgcccgaccgaacgaacgagtccatctattcgggctagtcaagaaattccaatgcgaaatgcaagcagagattgccccggcgcacaaccactccaatccgcctgggtcttctcgaatgtgtagaacctacttta

SEQ ID NO: 7019 - DNA, 935 bp, Oryza sativa
  unsure (1)..(935): unsure at all n locations
aagaaaataaattacacgttcccatgggttttttgaaccnaaccggtatggaatgagcccttgattttgttttgacctaagattccataatagggtttattcactgcgggattggaaaaaatccancaattcaattggattcggtcccttttaatacacaaggacagatcattcttattctggtgacggctcctcacaagtctaagtttttccggggccgtcacaattgaagtcatctcaaacaaggcccaaaccaagggcggacaaagataatacttgcacaagacatgttagattgtgcataaaaatcgagccggtcacgaatgacaccattttgtgacgggctccaacttgagggcgacaaaagatacttgatgatttcttgtcggggccctacaagaagcacgtcactgatgtccatcattggtgacgggctccaacttgaggcttggttgaaataactattatattaggcccatcacgatgaatgttatcggtgatgagcttttacttaggcccgacaaagataactaaaatacctgttaccgtcgtattttttttggccgttacagatatttattgcacagtataaataccccaactacctagtgtaatggttatcccactgttcactattttggtgggagtatgaggcggtgatttttgtctcttttctccaagaaaatcataaattgcaaatttaattgaaaaatagtagtcaattctcaaaaatttagtaaatacttacctacaaaatgtatatctaatatttttctacttttatgaagctcggggatggatcaaagttagatgtatgggaaaactatgcgacgtcataccaaggtgtatagaaatggcatattgaattttattaacgccgcggaggaggataggaaaagaagaaacaacgattgcatgtgttgtccatgtgcaga

SEQ ID NO: 7020 - DNA, 556 bp, Oryza sativa
tggttcaatgaaaacaattcctccgcatacttgagaagatataccttttctataagaaagcttatcaataatgttaaaggttggattaataagattgaaaactcacctttataggtattcttgaatttttatttcatttttaagtataagtaaatgtgttagtcctccatggtggattatacctcataactaacaatatacaatgtatatacctctctatatctaattatctaaagctggctgctgtgctgcaagctgattggtggattcatcggccatcaacgttttgacacgtgtccattttctcggctgtgatgtatgtgcgcgcttggctgtggtgactctgggtgacgacgagccaatgctagctgggcctatacagcatgggccgatctgaccatttcagtaggaacaattttaacttagcacctcaatacttaatgtggagattatgggtaccccatacccacacggcatggttatccgactagttataggggataacttatatgtatggaatatgtaacagatcatgacttgggtattacgtttcctt

SEQ ID NO: 7021 - DNA, 625 bp, Oryza sativa
cttcctcctcgagcatgaactcgtcgagatcagagatagcgctagatccctctagccggcctccgtaggcaccggatgcggtatgtctaggctaatctctgatgtcgagatctggcggtgtgtgttggcttatgtatatgttgtgtcttgttggtcttgtggcttgctttttctcctcctggggggcttgtatttatacccataggtgtccccttgtccaagaagaactagggagaccaatatggatacaatccaggtagtccttgtcattttcatatagaactctatttgtccttccttatccgaatctccttctatatacgaggtatgattccgtataagatatggtatgtggtgggccttgtcgtgcttagtcaactactattaggtatgtggtatccataacactaacagccccgcccgtgtgttggtatttcttaacgacattactagaaatataattcccagcaatggcccagaaatactcctggtatattatggttacagagttcatccacaagcgcatggatataccattgtagcatttcacccgagaatattccaagggtatcgtatttattttatcccgtgggaagataatgtagagagaacttgactaataatt

SEQ ID NO: 7022 - DNA, 1052 bp, Oryza sativa
  unsure (1)..(1052): unsure at all n locations
cttttctggggacgttttcaaattatttaaggtgttcagaagaggccattatccttgggagggcccgtgtggcaccgtgaacacatattcgcatagggccttatttggggtgttttaaagatgtgggaacgcgggtaccaattttgtgagtaagggaataatttcgactcgggtgccaaattagagggcncataatgatactcttctcccagcgtctgaactgcgtcttgagggaagaaaaaaaaactcccccaagagggtgtaatgttctcacacaaaggaaggagtgtgtgtaataaagaaaaaaaataattttttaaagacatagcccaaacacattattggcaaaaaactttccgaaaagaggggtatttagaaaaattttaaacatagattaatgaaccacatgataaccaaaaaaacccaaaaagcaacttacggtgcagacaaaaaagtttaataggttaattattgaaattaaaccatttttatttaggaatatccataaagctagaattatttaattaattaaacatctaaccatttttttatcgtggagtaaccatctatcagacattttatttccttaaataatttcttgcggtacaatcttaaaccaaatttcagtctcagaaattttaaacactacatatctaccacatacaatctctaaaagattttaaatattaaggaaaaatatgtcccaccataaaatctactctctctctctcagcagtcgattcgtaacagaggcaaactttctaagttctcgttgggaggaagggagcccgaccgtatccgagtggttctctcctctctctctcgatctctctctacgcacacagacacgccgcaaaaaacgcatgcaacacgcacgccgctatatatataattaaccatcactgcgtcgctgcggccgcccacagccaccgagcggattagtggaacaaaccctagcctgagtagattcttcctctagctttcgcgagccgtatcgtatccattggatggagccctagagcaacaagaagaagccaagaatatttgcgcca

SEQ ID NO: 7023 - DNA, 1501 bp, Oryza sativa
aaatttttaaattttgagttgaaagttttcagatctcgagttgaaagtttcaaacctgagtcgaaagttttcaaatctgagtcgaaagttttcaaatctgagtcaaatgttttcaaatctcgagtcgaaagtttcaaatctcgagttgaaagttttcaaatttaagttgaaagtttttaaaatttgacttcaaagtttaaatcttaagtcaaaagttttcaaatgtaacttaaaaattttctatctattagtaataaagtctcaaaaaagaaaaaaaatctttcattaattatcatcattacccttaaagagttagttacgttagacatgccgctatgaaaaaaaaaatcttgatcagcgctggtggcactgcgcatacaggccgtgtgggctagaagtgctcgctcgcggcgcgtacacgcaaattaggaatcctgagtgagcgttgagaccccaccgtgccatgctggatccgccctaactgttagtattaattgattgatacaggcggcgcaggcggcccatgtacgcacgcacgattgcttcttacgaaaacaacacagaacgatgaaagaacgcataagattcgctgcattgagatgagtggagtgattccggcgtcttaatcttgcaccgcaaactatacgctcatcatatcatcgaggtaattaaatatgctggatgtgtagttcggttcaagtaggagtaacacacaacacaaacaagaagcatttcaagtacccacattatttactggcggagctagaaattactaaagagtagggctaaagtaaaacttaattagtgagttgtttatcttttcttaaatttacattgtgatataacataatttagccatgattttggaggtaggcctagggctcaaagccttagctgccctacgcctgcctccgccccctgattatacgtgttgacatggcggggagtggctcgtctcccgtccttcaaccccacggcccagtactgtatatcgatggcccactcggcccgacccgtcccggcccgtgtccaacacaaactgggcttaattcccagctacaagtctactataccccgaacggcgaacacaacggaaagaatcaaccaatggatgaatttaccgcgaacatggccgatcgaatatgcgtcgtctgtacccgtacacatacctaaccgcatcaggaggacgaacaccaacacggaccaaaagtacacccaagaactcggcttagctcctttccttcgccagcaagtcccaaactccatcgctttttgagcttagctatcactgtgagttgttcttaatcctgggagagaggcaagcaaagaacaaatccgatctcgttgcaatgcgccgtggacgcatataaattgggaagccaagtcccagcttctgaaagcatcaggggaattgcagttgatctcggtactagaattatcatcagcgagattaccccagttcgtgttaattaattagcaggtactagcgaggttgcagaga

SEQ ID NO: 7024 - DNA, 683 bp, Oryza sativa
tcctcccccccccccccccccccccccccccccccccccccccccccccccccccccccccccccccctcccccccccccccccccccccccccccccccccccccccccccccccccccccccccccccctccccccccccccccccccccccccccccccccccccccccccccccctccccccccccccccccccccccccttcccccccccccccccccccccccccccccccccccccccccccccccccccccccccccccccctccccccccccccctccccccccccccccccccccccccccccctcccccccccccccccccccctccccccccccccccttccccccccccctcctccccccccccccccgccccccccccctcccccccgcccccccccccctcccccccccccccccccccccccccccgccccctcccccccccccccccccccccctttcccccccccccccccccccctcccccccccccccccccccctaccccccccctcccccccccctccccacccctccccccccccacccccccccccacccccccccccacccccccatccccccccccccctccccccccctctcccccccacatcccccccacaccccccccccatacccccccatatccccctctatatccccctct

SEQ ID NO: 7025 - DNA, 1501 bp, Oryza sativa
atatgtgtgtgtgtgtgtgtgtgtgtgtgtgtataaccatttttatgttttctttggttaaaactaaacattttagtatcaaaagtctgtgaattgtcttaagcttttaatatatctgatgcttttatcccatcaagtaattttaattcgttggattccctaaataactaatttatttggactaatggattaattattaatgaagatgcgaataaaattctctaattttaataatatatattgtaacggtagtttaatttgactgaacaatggaatcaagaggtcaaagcagatcacttattggtcaattcagctgatagaaggctttgacctacctaccataaaacctgcaaaacctttgttgctacccctgtattgtgcgcatttatagatggcctctgtcatccacaagaaaaatgtatcagctatagatttcggacgtctaaacattttaaatttttcaatcacctaaaattgtactatcaaaggctaaaactaaaatactaaataatgtgtaattgctgtttattttcattgtgatctttgctagtctatatggatttaatttaatgttgtatcagcttgaatacttttatatttaagtcttataatgtcgtttttgatttgtaaatttgttttatgcttaggttgaacaattagttgctcaaactttttatctcaaagtggtaggtgatagtactggttagctagatttttcaactgatgatataaaatgaataccggtttgatggtcaacaattcaaatcgtttgatcaaatcttgttatatatgccatatatttatgataacgagtatttaaatctccctataattttttttctgttttaaccgaagctacataatggggttagcgggaggcttctatgtacatatgcgacagataaaaatcacttactccattttttaatatagataatgttgttgatttttggatacacatttgattaggtatcttacttaaaaaaattgtataactgcataagatataaattatgtttaaaatactttaaacaataaaatagctaacaacaaaataaattataaatacctaatttattttagtaagacgaataattaaacgtgtgttcaaaaattaataacatcatctatttaaaaaaagaaacttcgacaattcttagtacatcgagatagatacataataatcgaaggtatcaaattctacgtaaaaaaatataagtttgccatattaaaaaaaatggaaatggtatatatacggtacagaactagagagcgaggatggagagaattcagtagtacccagcaagtacgtagtgatcctacgtggattcctcgtcggagtggggcccagtaaaaccaacgcacgcactcagttcgatctctttttactcgtgtcaacatcgtacgcttgcgcgccgttgcgcgcggacacacacacccacacccacacccacacctttggttgtgtcatgtgtaccgaaaaagatcatccgctgccgca

SEQ ID NO: 7026 - DNA, 1501 bp, Oryza sativa
tgacgatcctatatatactttcctcgggtactcggacctcggataaattaaccaattctaactaaattatatcatgttaattagtatatagataaaaaaattagataattaatatgtattggattcccgataataaaaccagtgttgtggtagacaagttcattaatacatcaacgtcaaacaacaatactgcagtgttcagcgacacagtaccagcagatttcatatctacatataagcacggctcatcactttgccatccaacaatgtgggcaatatagtatatatcgaggtgccacaaataaatggaaggtatccatgcagggacggtgacgatggcctgcagctggcttgttctcacggccgccatggctgggctagcctcttggttgatccgtttggtttcactaaaatggaacagcagccacccatgcaaagctgatgaaggcagcaggctgccgccagggtcgaggggccttcctcttctcggcgagtcgctcgagttcttcacttcgagcacctctcttgagctgcccgtcttctttaagcgccgtcttaataggtaaataatatgtgttctctccattaatctaaaatataagcatttctgactatatatacatgatggatggagtttcaacgtcgtctagacaggtaaatatacatcttcttcctccattcctaaaccaatatcttcttcctccattccaaaacctcagcgaaaaatgtttaattatattttaaaacagagaaagtttaataatgcacgtaagcatacatcacgacatcacgtacagctccgccagtttgtttccttggttgaatgcaaaactgtgctaacatgatcagaacgtcaatatcttgagcgcccatcgacgcgagaaagttgcatcacaatatcaacatcaacatgagaagatgaaattattacgtagctaaaaattcgtccacttttaaatgatatatccttaacatggcattcaaagagagcatgtactgctaccgaattgatttttctggacgacactttttaggacgcaagtggaccaaaactgttcctctcagtaaaaaaaaaaaggccacatgcgaaaatgtatttttacatgcggctgattaagtggtccatctacgaaaattgacttattttcccaggcgagcctcctaagcgaccacatacaaaaatgcattcttgtagacgggtctcttaaaagcctgtctaaaagtctaacatcccccctctcttctctcttagcatcttcaaaattttctaagtctctcaccttatctcctcatctctcattttttccttagcatctcctctctctccccactcattttatcccccctctctctccaaaacatctcctggccactaacctctcctctctctccccaacctctcgggcggcagtaggagtgacgtcggcgaggacgagtggcagcggtgacatcgacgagggctcggcctccaaccgtcgtctaccccgccacctctcctctc

SEQ ID NO: 7027 - DNA, 800 bp, Oryza sativa
  unsure (1)..(800): unsure at all n locations
acggcnattgtagattgacttacnnnnnnnnnnnnnnnnnnnnnnnnnnnnnnnnnnnnnnnnnnnnnnnnnnnnnnnnnnnnnnncagtatacctagtgcaagaacaaccaagactaacccatgcaagctgagagttggaacctaaaatgatcatacatttatgaacgaactgtcatcaccaataatattttccctacgagcatcacaatatgcaacctggtgaacagagaggggtgtagtaactaagaaggttggcatgctcctatacaattttgttcatacaaaacatgttcgcctctcttcctttcactttgatgtagatagtggagagcacaatgcttcacaaaagatggggctcacgttccataattttggctcacatagcacttgtgctagaaccacaaaaaagagtaattaacaagggatctccatgtaccatgcactataaataagaagttaaagatgttcacagggcagtgaagataaatgtccagctaacgaagcactctacgcatcacaaaattcagttcagttgtaaagaaagaaaaaaatccacatggaatcaggggcggatccaacttgggacatgggggttcagtcaaacttttgggtgaacaaacaaaaaaacaaacaaactgttactagctagttgtattaagagaggtttaaggctctcaaattaacaaggaggaggagaagagcttctttcagatctagaagagaagctagtagggttaacgaacgcaagcgaattcaaggtcccagtggggtgggggagagagatgaatcagaaagagg

SEQ ID NO: 7028 - DNA, 949 bp, Oryza sativa
aaagaacgagtgatgagtgaaaccacttgctacactatatggggaatagatagaggtagagaaatgggagaggtttatcctctctttctcaaaaaaaaaaagaaaagaaaagaaaggacccaaccgtgatcaaccactgcctcgattcccttggtcctccgagaatctcgccggcgatggctgggagttggttactgcgccgcgttctcccaccccagctggttatttatagtgcggcggcactcctccattctcctccattccctaatttgtataatggttctctttgcaaaaaatgtgctggtgaccaaactaataggagaatggttagggagtctaagattcaggaggtctcttgtggataggaaacatttggaatgggttaaacttaatcaactttgtcagtcaattgaactgactggggaggaggataaagtggtttggaaactgactaaaaatggcattttcactgttaaatatttctataaagcaatgatgattcaaaacactggctttcaattcaagaatatttgaaatttaaaatttctcctagagagaaggttttcctgtggctgatgttgaaaaattgcattttaaccaaagataacttgctgaaaaggggatgaaaagggaaggaggcaaaaaaatgaaactgtggagcatctttttaaaatgcccaatttcaagactcatttaaaacatagtgagttgtgtgtttgatttgaaaccaatccataatatacatcacttgtttgggaggtggctttaggattttcaaaaaaaaaaaaaagataaaaactttgtggtggtgggaattgcaggcagctattgtttggactatatggaagttcagaaatgctgcatgtttcaaaaaataaaagaacacaagatcctttagagctgatatatgctgtttgctcctggatcaatctttggtccattttgcaga

SEQ ID NO: 7029 - DNA, 486 bp, Oryza sativa
ggtatatatatatatttacatataaatttctaagtagaccacccttccctgatatatgcgtgatctatagtatcgtttattttaaaaaagaaaatacctagtcaatatgagttagaacattctagtttaacaattaaaaaataacttcttaaccaactgtaaagctaactttgtgtggcttatatatgcaataatatgcggaggaactcataatgtcatgaaagccagtaatatctaagcacttaaaagatgttatggccatgtaacatgcaatagttgttccaattttagtgaaaagtaggaaacaatgttccttttatatttcttgtttaattttatacaactcttattttaagttcaaaatataggtgttatggatctttaaattgttggtttaattatgaatagagcaattagattagaaaccagatgtgtggataaaaaattgtgtatgttttaatattattgattatttctccttttagt

SEQ ID NO: 7030 - DNA, 1318 bp, Oryza sativa
ggtatatatatatatttacatataaatttctaagtagaccacccttccctgatatatgcgtgatctatagtatcgtttattttaaaaaagaaaatacctagtcaatatgagttagaacattctagtttaacaattaaaaaataacttcttaaccaactgtaaagctaactttgtgtggcttatatatgcaataatatgcggaggaactcataatgtcatgaaagccagtaatatctaagcacttaaaagatgttatggccatgtaacatgcaatagttgttccaattttagtgaaaagtaggaaacaatgttccttttatatttcttgtttaattttatacaactcttattttaagttcaaaatataggtgttatggatctttaaattgttggtttaattatgaatagagcaattagattagaaaccagatgtgtggataaaaaattgtgtatgttttaatattattgattatttctccttttagtttgagagctataaaaatatcgaggaagggcagaggggaaagtgcgagccgaaggggactagtagtgttgtgtttgtgcgcatgtgaggaggagggcaaagttttctgtgtgtgtgttgggggggtggttctttttttataaatgatttaagtgaaaatcgatgatctattgttttgtttctaaaattttcaaatatttttttttctaattattaagatgtaacacctagcggcttaagattttcattaaaagtagatgtaatggttgaaaataatggatctacatatttaactcgaaacatgtggtcaactgtttttttcctataatttctaatattttatttttaaatttaagatgtaatatgtgacatatgtgatactgttagtgctctatagataatgtacgagatttaagatgatatagtaattattatcaattttttatttttctatttttttgtttggttgacacacgtaggtgtctacaaatgatgtactatttacagcgaaatatgggtaatatggatcttgaattatttatttatttataaataaaacaatagttcaaacgaacttgaaaaccagatataacttaaaagatagtcatttagttttctaattgctgtttgtttatgtattaagtttttaattagttaaaatttagaagaagaaagaattgaatgagaggggagaggagagagtataataagaatatttattttacaagtttaatgtgttttaattactatcgatttattgtatgaaaatagattaaatgctttattgattgattaagatgtatcttttttttcttttcataaatatatttatat

SEQ ID NO: 7031 - DNA, 1501 bp, Oryza sativa
gaaatctggaaagaacacatcaaggttaaaggtgtaaaggaatacgttgaatgctaactgaggacaacctgaagataatagtgggaagtaaactgaatgtaaagaaagtgaatccgagctgcttgttcgtgggagctattcccagttatgaaccaagtaatatgttcaaagatagtctatagaggtcagattaaaaccacatctaacaacgaagcttcagatttggcaggatcacgatcagaccataacaagtctagcagtaaagtcattttggaagacgtcgaagcatgtcatgtaggataagttggttctgttgagaaacataactcaaaggcaaagttatcgaccctcgcatggaatagcagaagtagctagcacccggagagcaggaaagctaatatgaggcagttggaggcaagttagaagtaaatgacaagcatggtattctcatgatgacaagcatggtatcctagtaatgacaagctgatatcgacgcataacgtgaagtgggtaacttgtatgaggttgacgccaaagatatgaattatgagaagttctggaactgaagtcccattgtcaagtgccacaacccagtcgaagacagctagaggtgcaaccaaggacaagtcaggtgaagagaagattccatctgcaagaggagatcgagccaagcagtccagagtggagaagtttagctaggcaagtttgttatagaagacggagcggaagaagtcagacaagaagagaagaccgcccaacctatcttcttgctagcctcctcgaatctcggggacgagattcctgtaaggggggtggatttgtcacgtcctaataattcatcccgaaataaaaatcattttctaaaaggaataatagaattaattaaaattcgaaaagaaattggcaaacactaaaatgcgtacaagaaaaattcaaatgtggcccggagaatttttgctaaattctccttgttctaaaaggagccctcaaattttacttgaattttcagagcaccggaaataattattaagcaacaaaaacaattatcagagtttattaaaaagaaaaacctaaaattaaccctctccttccctttgggccaagtctggcccaaggtttctcccctctccctctcggcccgtggccgaagtccctctctcctccctctctttctctccctctccttctcttgggcctccttttcccctcccggcccactccctcctctcctcctccttctgggccgcccctcccctccctccttcccgcccggcccaagccgcgccacccagccacctggcccacgccgagccgctccccgcacgcgcgcagcacgtgcggtcgtcttcctcctcccgcacggcctgctccctctctccccggaaacctagcgccaaacctccccaaaatccacgcgattcaaacagcgaattccaaacttgattagggggaattaatcccctttccctcctctctctttcccccttaattcccccttgaa

SEQ ID NO: 7032 - DNA, 1501 bp, Oryza sativa
tctcaccggcgattctaaccacggtatcgatcagcttggcgttcatggcgtcgatctcgttcgccagggcactgttaacatgccgtgttttctgcctcttgacgtccgtacggtcatcctctacactgtgccgcaaagcgttgattaggcggtcgatgggcttcttcttggctacaactgattcaaccctgcatcgcaatttatcctctgattggcctatcacgttgtcattgcggttttgccgacgagctgacgatggagttctgtcagtaattctttgcctcggcaggcctgcaggttgctcttgctgattgttatgacgatttgcattcatctcattaattttagcttttgtttccctgtagaatctgagtaggctatgtatggagctttcgtacttgcagaatttcaccttcatgccttcatcgatgctgctcttctggagctgcaataaatccagagcactcctaaccgcatccttgagctttgttatccgcttgtattggtcagcttgctttttaggtagtgactgcaactgttcttctgttttttggcaattgtgaagtaaacggtcaaaatccgtaagctcggaaaagaaagagttctttaaaacgctgatcttctgaaacatttcctccctccaattcacttctccaacaccagtgatcatctgtacccttgcaacattgctctgccatcctccatgtgtttggtgatgattatttgacatcaaatgcggctgctgctgtggctgtggctgttcttgcataactgtagtaggcagcctcgtttgatttcccatctgcccttgatgctgcatacctgaagaagactgcggtcgctccaaaatagccatcttcgttgatattttagaaatataatcatcaatgctgctggtctcattgaataccctgtcctcaaatgcccgcaaagagttgaactctgcaccataatgtcctgccaatttctctctgattgaacaaaaagaatagggttcagaaattcagataaatgtcgacaaaaaaaattgatgccacaatgagatcctacctagtgtcatgttatatgtttccagaacctgttcctactatgtctatacctgcctgatgaacaagtaattaaatgattcctcataaacacgtgattttgttacacacagaatgtatcaccacacacgctcaatgcaattttccaatttcaaaggaagtactgaagcaatccagaaggaagtaaaggactgagatcatacatcaaagcagacaaaattaaagcttttgatgcaactatttgttgactttaagcgacaaagagagagatcgatagatagagagagagccagagagaggagagcgagagagagaccgggagagagaggagaccggggagagaccgagtcctcctccccttatctgcctcaagaggataaggaccaacagcttagctctgctcagtttttatacgcacctataatatattataagtgtcggttctttaattatct

SEQ ID NO: 7033 - DNA, 1501 bp, Oryza sativa
gcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattatag

SEQ ID NO: 7034 - DNA, 1501 bp, Oryza sativa
gctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgagctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgaccacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactc

SEQ ID NO: 7035 - DNA, 745 bp, Oryza sativa
  unsure (1)..(745): unsure at all n locations
aactggaccgtacctagaaagatgaagttgagtagtagtgttaaaacacgcggnagctattaggcgtgtaactcggcccacggcccacgcccagcccccaccacgtcgtatcccctccttttttttcgtttttttcttttttcccgggtgtatttcccttttttgcgatttttttctccttttctgattcttttttttttcgcgccaactagcaagtttttaatcatgacttgaaatttttcaaatctggatttgaaagttttcgatctcgagttgaaaatttttaaatctcaagttgaaagttttcaaaattttcaaatttgaacttgaaagttttcgaatctttagatggaagtttttcaatcccaagttgaaagattttaattccgagttgaaagttttcaatcccgagttgaaagtttttaaaatctcgagttgaaagttttcaagtctcgagttgaaagttttcaaaccctagttgaaagtttttaaaatttgagatgagaagttgaaagttttcaaattttgacataaaaaattcaaatttcaagttaaaaagtttttaaatctagattgaaagtttttaaaatttgactttccgtgtagatctgtatttaatcttttacttgaaaaaaattaggacacgaaaaattaccaagaaatcaaaactagttatgacgctaatcacagcgttaatcgtgtttttattccgcgctaatgacacgtggcctccccggggtgaaaa

SEQ ID NO: 7036 - DNA, 1015 bp, Oryza sativa
tgccaaatgtatggtaagcgatcttgctccaataaactttaccaacaacaattaagagagtacacacgatcagttaaaactatatgcacgtaagacacatatgtatatatagttgcttcgaccaagacatgttagtcctaggtgcagcaattgagtacacaattagtttcataatattcagagatcaatttgcaactcgaatgatgtggttgttagaattaaagtgggtagacccaaattaatcatagtaaattttatgggcccacaattattgttaagagatcaataccacattgaaaaccaatgagaaaagacctcaacttaaatagactgctaataagagcacatgttgagcggttgaggtggtggtgagaatgccacatgcacatgctgagacaagtgcgggccgtggctgaggccaaggcaagcgggcgaggcaacgattgctctcctttccgacgtttcatttttatgagggaaactgtaactaacggagactcgaaacgtctctctcttgtaatcccccaactttgggataaacagatcggagactcgaaacgtctctctcttgtaatcccccaactttgggatagacagatgtggcttctcttctgttcatctcctggatactctagttcttttttggtacatatctcccactttctgttttgagcgtgaacctctatctttttttttatctctttgccctctacctttccaactatctgttacttgtcatctactcatctctcatctctacagcgttagaggacacgctattgtatctactctaggcaaatcatgcttgccatggtttccctttggtgagccatttacctattgaccagagcttcaggatcgaggtagatgttccatccataagaccgaaagttctggcatgagactaatccgctgcgaagaatgcctacacccccccaaggtgataacagtatcctttcaacaagatcattggatccaaaccattttgctgatgtgttgctattctctttatggg

SEQ ID NO: 7037 - DNA, 415 bp, Oryza sativa
  unsure (1)..(415): unsure at all n locations
atgcatttctttagtcccgagtgaaataacgggaactaaagatggatctttagtcccgcttagtgttaccactaatcgggagtagatattttttttttcctttttttcattaattttaactgcttgcatattgatttcactccatccccaaatcacgaaaaccccaaatcacctccgaatcatagatcaaatgcatcacaaattctaaaagaaacatcacacatacatcacatattcacatcaaaaattcccaaaaacaaattcaacaaaaatatacaaaaacaaattgtaaatccgcccatccgccatcgctccaccacccgccgccggctncccagcccagcacgtgccccccaaccccgcccccgccccgcgcgcgtgccgctttcgctcgctcctcgctgctgcttcaaga

SEQ ID NO: 7038 - DNA, 1216 bp, Oryza sativa
aaaaaaatcgaacggattagtgttgtttagtaggacgtatgtatctattgaaatcttattgtgctgctcattggaaatggaattgaataacttgtttttatgtctgtcgttttattactatacagaagataaaaccttttactcctgtcgttcacatttattgatttatatcataaagatcagtaaaaattgccataattttactcaagttattatatatatatatatatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagtttgaactgaatttgaacttgtttttgttagattttgattctaggtatatagcatccatacatatatttagctaggtatgtaatcatggattgtgaaataaagttaaatttgagttgttttgttgataggtataggtatgaatcgaattattataactaggtatatactcataatttgaaaattttgaaaaatttgagtgattttttgcatttgataccatggtgcccgggcaccatggtgccccatatgagtgtcctatatatatatatatatatatatatatatatatatatatgtatgtatatatatacataagttataatatatatatatatatataccaaattttttatttttcaagataatggacagaaataagatatacacagccaaatcaagttcttttaattatgtactaatttgtggagctgattgaaaaataaattaccttgacatttccagcttctttgatggcctcgacaagcttgagctggagcatgaggttgtggctgcggaggtggacgccggacatggcggagacgacgacgtccacctgccggaccgcggcgacgaggccatcgtggtcgtcgagcgacgcctcgaggagccgcgcgccttgcgccttgaaggccagcagtatctggagcttgtcgatgtcgaggccgatctccggccggagcaggacgaaggtggggtggccctccgccaagctcgccgccacgatccgccggccgatgtagccggtgccgccgacgatgaggacccggctcttctccatggccatgtatggctctgctcgatctgatgagtcacacaacgg

SEQ ID NO: 7039 - DNA, 1501 bp, Oryza sativa
ttaaaatactcttaataataattgctagtggatgatcatgtgacacacttgcatgattagttttagtagttagtggttatcaactatatagatagtatagataccaaaacaacagcatcactaggcagagttttgccactgcctggaccaaaaattttcacaatttgacactttgcaaaaactattattacaaatgaaccgccgccaaaacttatttcaaaaatgacccttatgttcagcgccaaattatgtggcgctgaaattagacacctcagcgctaaatagcgtggtgctgaatatgagttggcaagctgacttagtctcccatttgcggtggcacggcattcagcgccagttgacgtggcgctgaggtgtctaaattcagcactaggtgatttgacgctgaaaaaagggtcattttttaaataagttttggtggcgatttatttgtaaaaatagtttttgcaaagggtcaaattgtgaaaatttttgctgcctggactgctagagccttgaggagtgtgccttttaggccttttagtattttgtttaattagggtagacttgaagctatatatgtgcagatgtgctatggttgctattgggcccgctatccggctaatacccgaatagcttagcaggtattatccgtatgttttatcacatcctctttatccattgggtatcatcttttctaacccgatcacttatgcattgaaaaaatacccagattcgactcgcatatatatctgaatatatatacccctaagtatctattttttttatcccgaattaatatggacgggcgtgtgggaggaaaatacccatcatgttttagctcctacttgtgaattgtgattgtaacttgacattagaatagggtgattcttaagcgtgtatagtagaaatactataatggtgtatttgttgagttgtgatccaaattcatttgcacttaataaaggctagcttctgccgtagtggagcggacgcccgtcgcagggaggcttgggccggagcgtacggatcgtcatcccttttagggttccaccatatatatacctcttgtaaaccgccgtgcggcattgtaacctcaccccagatatagtaaagatattttgctggctggcgtccgtggttttttctcttctgctttgggagggttttccacgttaaatctcgtgtcttctgtgattgatctattgttttttacgtttgcttgcttatcgcatcctaacagtattagggggcagtacttttatatgaacgcggagctgaaacaagccgatccaaaccaacagattcaagctttgttatttacgtacccccaaacctctctaccacagtcagattgataaattataatcgctgacacagttggtacgacaacaggaccacacgctaatacatataggccgcaatcggcagtaaagctttgtcgagtcgactgcacggtagcgtggtcagttgtggcactcatcagagctgggagccatggcca

SEQ ID NO: 7040 - DNA, 1501 bp, Oryza sativa
gcgcaatgtagtgtatagtttgattcattgagtgttattgtattgttgacgaggacatcactactttagatacgcacgagactaggaggtggaggcccaattcatattgagtccacctcgttatccaggagaaggttgcactaagatcatcggtcagaccttattcggattctttattgacgtccgtgcatttatatggaaagccaataagaccatctttccaataggccaggtctcacgtcaaaatttcttctgagtcaacggaaatggtcgaaacaagagagcgtccagaatttgtcagggtgttgtgtcaccatctttaggcccgttgggttgtgtattgtgttggagtccattagggatgcatccacgtcctaggtcgaccctagaacctacttaattagtagacatcatcggattagggggggttttgcttagattattctgatattgcagtttttcccttcatcggtttgtggaaccccaacttgtgagattcatcttaaattcgcaatatattcatattgcatattctactctattgcttgtgttctcgattcgcttgcaggaaatagctttatcagcgaggtcatctgtgtttcggttcgggcgataaccaacggaggaatggtgcaatggttgcgagaggttcgatcatcaatgtcgagtctccataatcgtggtgcaatggttgcgagaggttcgatcatcaatgttgagtctccataatcgacttatctagtatctaatggaagatcaggatcttagtccttgtcaattgtataaattgatgatgggccgcactgacagaaaaaaaaagaactaaaagcttctccattttctattcagatggagttgagtccattggacaatgttaaaaaaaattttattcagatgattcaactcgaaaatatagtttaattttgccttacaccgatttggctcctgcctacggtgttgttggttcgattttaagcgtcacatgttcgatatattttcatatgccacatatagccgttacttgagaagcctgtccagattcattaaaacttcatattctatttattttatgttggttttaatgaaatagatggaataggtgaatagaacaggactggggcctagggagtcaaagccccactttgtttccgatctggccgacagtataccatccaacggtccagatgcccccgagccccaaacctccaattcgaaattcaaacagccggaatactaatggctggagccgaccgttggctgcgtcccctaccccacctctcagacacacctcacaacccccacattcacatgcccccccccccccccaaaaaaaaaaacgctttgcacatactccctccgtcagaaaaaaagacaaacactggtttccgtgtccaatgtttcatcgtccgtcttatttgaaaaaattatgaaaaaagttaaaaagataagtcgtgcataaagtattaatcatgttttatcatctaacaacaataaaaatact

SEQ ID NO: 7041 - DNA, 239 bp, Oryza sativa
agagagagagagaggaaaatgagagaggaggaaagtgagaagataagggggagagagagaggagagaagggggcggggggagagagaagaaaagtccaaattttttttaatattatgggagggaagtgctattttcctgcgcttttagattaggaggctcgcacgtgaaaatagagttatttttgcgtgcgggcctgttaagtgacccacacacgaaaatcgcgggtgatgacccggct

SEQ ID NO: 7042 - DNA, 1501 bp, Oryza sativa
tggatcaaggaagcatgtaacagcaagagccatattcgacttctcccagtacttatcatatttagtttgcatggcgtttgccatggtttttattgttccatctgtactgttacaccaatcagcaatataaagcttgatggaacaaaacttaccgaaaaaatgatttgctgttggatatgtagtaccagagaatagttcagttgcttcatgaaatggcttcaagcacttgcatagtgctattgccatagaccagtctaccttggtgggagcacactttgcatactttctaccatgccgaagaaacaacctatcaaaagcatttctgtagtagatagcattcttcaacatgagaaatgtggagttccatcttgtaggagtatccatggaaaggccctttgtgttatccaaactaacttccaaggcacacttctgaaatgcctcaaactgcagtggcgagtgctttagaattgaaatagtatttctgatctttaatacagctcatgtgatttgtttcaaaccatcttgtgcaacaaggttcaagatatgattgaaacatctcacatgaaagaagatgccatcgcaaattaaaggagagattttacggagttttaaaataacatccttaacacaaacatcattagacgatgcattgtccaaagtaagtccaacaagccttctatcaagattccaatcaactatgctgtcataaaactctttgcacatattacttcctgaatgatgtccttctacatgcataaacttaatgatcctcttttgcatcttccaagtgtcatctatccaatgaactgtgatgcacatataacttttattttggttagatgtccacatgtccatggttgtgctaaaacggcatgagagtgtaagcaaatgctgccacaatttcttttttcctcttcatatatgtttagaatatcctttctcacagtaatgcgactcttaattggaaaagtagggcgtaaagacttaataaaatccacaaagtaatcatgctcaacaatgttaaagggatactcatgcatgatgattgcctatagaactttttcaggctaaccgtctcatcatacctgtatgtctcaacagctccttcagtaccatcttcactctttttcatctgtagatgttgttgacctgacttgatgttgtgcttgttattcaagtgattccagaaaacagaagtgccacaattactctcacaccgacgtttatatgagcactagttgcatttagcatactcctctacaatcacagtgtcacctgacccattcttgcttaccttatatttagcatactcctctacaatcacggtggtgacggctcctagcctcccactgtcccacgatttagggagataggaagcacaaacaagcactagggggattgaaggccaatgcccagcaactccagcaaggagccaaggagatctaagacagccgccgccactgtcgccggcttgccgctgccgtcgtcaccgccgccgccg

SEQ ID NO: 7043 - DNA, 917 bp, Oryza sativa
tatatatatataccgcatatatatatatatatatatatatatatatatatatacatatatatacatatatatatatatataataatgccacgtcattcgcagctcctgattggccaaacacgcaacccacatgcatcgatgcattatggcaagcttgcgagactttgactaattagcactttaacaccacacaaacaaaactcagtattaaccggttaaaacacttctatgtacgtgctccgatcttctctctactaattaatttatgcagtgatcgatcgattgggtatccatggaggggggacctagctaaattattactgtcatgaattgactggatcgatcttgaacggccattagtcacagtaactgcactgattaatcatcacttctcctggcaagtgctgcgtctcgtaaaaactggtaccaatatggcattagctattcctgctagtacagcagtactgcaaaactacttcacccgtctcctctaaagttttttcaataaaattaaataagaaactatttataatttgttgagatgagtaagtaaataaaggattaaattgcgttgacggtacaagaaattagtaggagggtgcgattaggtgaaaaacttgaaaaccgagcgtagtggtacaataacttggctagatggatgcgctcatggtgcaaaagttgtcacgtaaacaaaaattgccacattactattccaccttagcacaattgccgtattggctttaacacgaaagatctatctcattttatagaaaaccccctaatatgatttgttgacgtacaaatatatccttttatctttcttgacatgatcctgatcgagaggtggttgcgctggtggtgacgcagcggtggcggcgacgtagcgacggtggcggtggtggcggctgcggcgacga

SEQ ID NO: 7044 - DNA, 1501 bp, Oryza sativa
acccggctcttctccatggccatggctcttaattagctctgatgagtgccacaaactaaccacgctatcgtgcacttgactcgacaaaagctttactgccgattgtggcctatatatactacgcgtggtccagggtcggcgattataattaatcactctgactgtggtagagtggttagggggaaggtaaagaacaaagcttgaatcttttggcttggatcggcttgtttcagctccgcgttcatataaaagtactgccccctaatacacgattatagtatatattccaactatacacgatcagcaatcaccctattcatctagtgtcaagttacaatcacacaagtaggagtgaaaacgggataggtattttccacccacacgctcgaccatattaattcgggacaaaaaattcagatacctaggggtgtatgtgtataggtaaattaactggtactacatggagtatggactccaagattcaaattgagtatatacctaattttaatgtttatttgtttatatatatatatatatagggatgtaagtaggcaatctcactcactatccttccaaaaatttatctgcaagttttgtgctccttgttgttggtcataataatgtttgccgctgtttagttttagtaatgtgaccagtttaatgcaccaaagctggtgcttcgatgtaggcgtactgtcccataatttgttcgtagaagttggagattctacaatggtgcagttcaataattagccagtcatctcacaaatctgtacaagttaaaaaggccactatggctgtgtttaaatctaggggtgaaaaattttagtgtgtcacattgcatgtacggacacacatttaatgtattaaatgtagactaataacaaaacaaattacagattccaccaataaactgcaagatgaatttattaagcctaattaatccgtcattagcaaatctttactgtagcaccacattatcaaattatggagcaattaggcttaaaagatttatcttgcaatttacacgcaaactgtgtaattagttttttatttttatctatatttaatactcgatgcatgtgtccaaatattcgatgtgacatgatgaaaagtttttgcatgggaactaaacagggcctatattttcagatcctacatccaatgagttttgccacatacaagtacttaggcccggtgtagttccgacacaaaaattttacaccccgtcacatcgaacgtttaaatgcctgcatgaagtattaaatatggagaaaaaaaaactaattgcacagattgcgactaatttacgagacgaatcttttaatcctaattgctccatgatttgacaatgtgatgctacagtaaatatttgctaaatatggattaattaggcttaataaattcgtctcgctgtttactaacagatactgtaattagtttattaattaatgcccctgtaattagtttattaattaatgcccaaacaccccatgtgaca

SEQ ID NO: 7045 - DNA, 1501 bp, Oryza sativa
cgggtattatataggctgtcacatggggtgtttgggcattaattaataaactaattacaggggcattaattaataaactaattacagtatctgttagtaaacagcgagacgaatttattaagcctaattaatccatatttagcaaatatttactgtagcatcacattgtcaaatcatggagcaattaggattaaaagattcgtctcgtaaattagtcgcaatctgtgcaattagtttttttttctccatatttaatacttcatgcaggcatttaaacgttcgatgtgacggggtgtaaaatttttgtgtcggaactacaccgggcctaagtacttgtatgtggcaaaactcattggatgtaggatctgaaaatataggccctgtttagttcccatgcaaaaacttttcatcatgtcacatcgaatatttggacacatgcatcgagtattaaatatagataaaaataaaaaactaattacacagtttgcgtgtaaattgcaagataaatcttttaagcctaattgctccataatttgataatgtggtgctacagtaaagatttgctaatgacggattaattaggcttaataaattcatcttgcagtttattggtggaatctgtaatttgttttgttattagtctacatttaatacattaaatgtgtgtccgtacatgcaatgtgacacactaaaatttttcacccctagatttaaacacagccatagtggcctttttaacttgtacagatttgtgagatgactggctaattattgaactgcaccattgtagaatctccaacttctacgaacaaattatgggacagtacgcctacatcgaagcaccagctttggtgcattaaactggtcacattactaaaactaaacagcggcaaacattattatgaccaacaacaaggagcacaaaacttgcagataaatttttggaaggatagtgagtgagattgcctacttacatccctatatatatatatatataaacaaataaacattaaaattaggtatatactcaatttgaatcttggagtccatactccatgtagtaccagttaatttacctatacacatacacccctaggtatctgaattttttgtcccgaattaatatggtcgagcgtgtgggtggaaaatacctatcccgttttcactcctacttgtgtgattgtaacttgacactagatgaatagggtgattgctgatcgtgtatagttggaatatatactataatcgtgtattagggggcagtacttttatatgaacgcggagctgaaacaagccgatccaagccaaaagattcaagctttgttctttaccttccccctaaccactctaccacagtcagagtgattaattataatcgccgaccctggaccacgcgtagtatatataggccacaatcggcagtaaagcttttgtcgagtcaagtgcacgatagcgtggttagtttgtggcactcatcagagctaattaagagccatggcca

SEQ ID NO: 7046 - DNA, 1501 bp, Oryza sativa
aacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactgtataccgatatataccatatccattaaaaataatttgaattaaatagttgttagttttcattgagttgcctagctatgtttgaccaacaatatttttaagaaatctagttagtatttagcatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatatatatatatatatatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaaaactttgaacgatatatagtctgtttcctgataagcgtccagggtgttgtctacaagatctaattaattaaaatagtgatgtcaaaagcaataatgtaacaaacgtggaaagaacggcagtgtcaagaaattagcagagaagatacttggaagtccactgagcttgtagaaaaagatggagaaagatgcagttttatgagaagatccaaccagaagcaataatgtagatatggttatctatatgtataacaactacacatcaaatca

SEQ ID NO: 7047 - DNA, 1501 bp, Oryza sativa; identical to SEQ ID NO: 752

SEQ ID NO: 7048 - DNA, 1501 bp, Oryza sativa
atcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcattgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcagagaccaaggatttagacaggttcaggccctctcaatgagaggtaataccctactcctgtttggggatttgaatccgccgggtgtagtatagatctgatgatcaggttgtctcatgccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacactccaccagtgggaggccaaactcatggagaagttgggcacactcacacagtggattgatacgctggattccaagatggaggagcagaggggcgattggatcaagtgatcaccaaagtagatctcacattggattcggtggggaagatgcagcagccagcaggaccagtcacaagctgcgcggctgcagaagcagatcgcctccacacctacatatgttgttggtgaagattaagtgactattcttgggtcctctttcggtgtttctctggccagcactgatgcaccaccaccacctgaggctgaatcaagtagacctcatgaaggcagtatttgatcaaagagttacttgccaaaaaaggatttttcgcgttttgatcggcattatgtgcgtatttggattgatgtgtgaaacttatttt

SEQ ID NO: 7049 - DNA, 1501 bp, Oryza sativa
ttcaaatgtataagatataaatcacacttaaagtactatgagtgataaaacaactcataacaaaataaattataattacgtaaatttttttaaataagacgaatgatcaaacatgtgagaaaaagtcaacggcgtcatttattaaaaaacagaggtagtatgacaatcctcctcatggtcagactcttcctcagctataacagcattcaacaactcatcaggaatcacttaagtaattttcattgatctgatctgaccaatcactgcgtgcatgtgtttaggagaatacttatccccacacttaaagcagagcccattagctcttctctttgaggtttaatggccaatgtttcagctacagcaggtaacccttccaacgtaggaccaaccctcttataagtcagtttcttcacatattgctgagattgttccaacgaaacacattcttgtgtcagagcaacagcggctgcttgctgaattgtatcaggtaattaagtggaccatcactgcatttcagatttcctcgagacccaacacaaaacgacaaaccaaaatcatgccacccactgagggatcaaacaatctcactttgtaaactaatgaatcaaattgttgtttatactcagccacagtgcatgtctgagtcaacatttccagagctagcgttttctccctgtgtgtgttaccctcaaattccagcacgactgcataacgaaaatgagcccaatcgtgcatatcttccaccaccattgcgctgcatttccagtcagatgcaacacagttgtagaaacattaaagttgacaggaattttatacttctcaaaataagtttcacacatcaatccaaatacgcacataatgccgatcaaaacgcgaaaaatccttttttggcaagtaactctttgatcaaatactgccttcatgaggtctacttgattcagcctcaggtggtggtggtgcatcagtgctggccagagaaacaccgaaagaggacccaagaatagtcacttaatcttcaccaacaacatatgtaggtgtggaggcgatctgcttctgcagccgcgcagcttgtgactggtcctgctggctgctgcatcttccccaccgaatccaatgtgagatctactttggtgatcacttgatccaatcgcccctctgctcctccatcttggaatccagcgtatcaatccactgtgtgagtgtgcccaacttctccatgagtttggcctcccactggtggagtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 7050 - DNA, 1501 bp, Oryza sativa
acttattccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacctggtctatattacccggaagatttattactcggaagcatgttacatgcgtcatcctttaaagggtgtcgaaggcatattttttggcctaggcctaatatgtctgcagcccatattttcaggtgtgacctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttattcactcggattttacaccacatatgccatatatttccaggtgtggtgaaaccatgtgtcttttagggactaaagcacgtctgttaaagcagtgtgcgcatggcgtatgcccaatactttagaaatttatttattcacaacatacaagcttctttatagctgttttgctatgtgaatttttaatgatgtaaccaactttaggttacactcatcatattttacaaagcggtcggtatatcactcggatcatgttattcagggattcacaccgcatatgctacgtattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtcttcatatttggtaaaagtacttcggagaccatggcgaagataattgaagcactcagctttggagtaatctagttcgagagaagattatcttttcgactgtgaaggtctcaggggctactgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 7051 - DNA, 1501 bp, Oryza sativa
caaactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttatttatcctagggtgaacaaggtaataataacaataacaacaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctaataaactccatataacacgcagaaacaaagcacaaaaatgggttcttgacgggggaaagggagagggaatcacggggaataattccccccactttattgcgcgtggggacggcgggaggcggccggattcgcggcggcaacggcgctagggcgcgggcggggcggcgggagcggcgggaggatagggatgacaggtgggccccacccgtcagcgagggtggcgggcgggcccgcccgtcagcggcgcgtgcgcggggagaggccgagtgggccgcggggagaggagggagaggggagggagatgggccgggctggccagagagagagagggaaggaaaaagagagggagggagagaggactttggccgcgggccgagagagagagggaggtcgggattatttttagcttttcctttttataaaatcattttaactttgtttatttcttaacaattattatttgtgctctgaaaattccactaaaatttgagggctccttttagaccaaggagaatttaacaaaaattctccgggccacatttcaattcttcttgtacgtattttaatgtttgccaatttcttttcgaattttaattaattctattattccttttagggaatgatttttaattcgggatgaatttatcaggacgtgacaaatggatgtaacaccctagcccaagacataataggattgataggatactcatgctaacaagttgtaacttcttttccggaagcccatctccaaagaactctaaagttaagcgtgcttggcttagagaaatctagggatgggtgaccgaccgggaagtcttcccgggcttcccgggtgcgcacgagtgaggacaaagtgcgcaggcac

SEQ ID NO: 7052 - DNA, 1501 bp, Oryza sativa
cagtttgtgattggtttgagcgaacaaataaagtatctaattgaactagctagatatatgaattaatttaagcaatgtagtgaagtcccagaaaaaaactgtgtcaagaggggcttactcataaggatattgcgcctgccaggcatgggaaagaaagtccccggacagtatcgcatatgctgtaaacctgtttccattggttggagatcacaagggtacgagtagactcgaggtaatcttgtgacaggggtccctctgttgtgtatgctctaatggtgagaagctccttggtgtgctcaggtaaagatgagaattggagagggtcatcgttggaccatgtaaatgaacagaagccaggtctgtcagggaggtgatcgaggaaaataaatctgccagtgctaacaatctcctcctcatcctcaaagttggtcaccattcggatctcaacaattgacaaggacaggcaccctgtaggtgtgatgcttgggcttgcaacggcggaggctggacaggcaccctgtaggtgtgatgcttgggcttgcaacggcggaggctggactgcagagacgactttgatcctgtaagcagtgattgcattggtagtgttcgataagccaagatagagcgttcctgttccctgaagagggacggcacgtccatgaaacggcaggtcattgtcgtcgagtttgcgccattcctccgtctcgacgtcgaacatgtgggtgcccgtctgcccggttatggacagcagaatgtaggaggcaactgctacatgggacttgacggtgaccaccggcgggaagatgtagtcagttggggtgaggtcccaggggaagaatggcgggcgaggcagtggtctccactcgcagcccaccagacggtccgaggcatcgtcgtccacccgagccacggagagatcgagcacctcgaaccaggggacgaaattgacgtcccccgtcacggctggcctgcgcgccagggcgtagatcttgtcgccgaatggtagcaagatcgggcagagcttggtcgacaaaagcttgggtcccgagatctccttgcgcatcacggtgtcgaagacgatggtctcatcagggccgtaattccgggctgagctgccgccgacgccaacgatccacggcgcgtgcctcctcgaccgcacggaaacgaaagacatgtagtgcttgccggtcaggtgagcgaggtagggcaggaggggtagcggggtgtcgccgccgtcgtcagcgttagctggaaggtgtgggttcaccttgaacaaggagtaggaagggcgagtgactccatggccgaccaccaggtacaccgacgacggagactccgtatctctgatacgagcatcttcttcatcttctttggccagtttctgcttcttgctccggcggagcatctccacccgccgccgctggttcgcaagttggggttgaggatcgatctctctgtctctctctcgtgaatagtttttttttttttatcttctctcgtg

SEQ ID NO: 7053 - DNA, 1501 bp, Oryza sativa
agctttagagcagcgagcgcctggctgacgtagaggatgacggtgagcttctgctgcagcgcgacgaggttaccccgcgtcgcattgagctcctgcacctggcgcgcggcacccacgagatcgccggtgagcacccggaccacctccctgagctcccggatcctcccgaccgcggcgacgatctccccgtccagcccccgcagccggccctgcgcctcgtagaaggactcggagcggcgcgcgatctcccgcacgaggtgcgcctcgacgacgtcgaggtgctggccgaggcgctcctgcagcgcggcgtcgccgagcgggcaggcggccttgaacgtggccccgtcctcgagcgcgaagtcctccttgaagaagagcgcggggacctcgcggaggcaggcggcgaggccggaggccgcggggccggcggcggcgccgtcctgggactccgcgagctcctccgcggaggcgtggagccggatatcagcgaagcggccgaaggggtcggcgacggcggcgaggtagggggcgaagtcggcgcgggagacgtcgcaggggtggggcggcggcggcgggggcgcgtcggggagcggggtgggagggggccaggtgagccagtagtaggaggaggaggaggcggaggggagagggttgttgaggagcgcggtgatggactgcgggacgccgccggggggagcggaggtgggggagtcggtggagagggtggaggaggaggcggaggtggtgcggagcggaggccgcgaggccatggcgcgcggcggcggcgggggttaggggaggcgaggaggaggaggaggaggaggcatggggagggagagatcgggatctgggaggccggaaaaggaagcgaagcgagccaaagcttgaggtgtcagatctggcggtcaggtcttcaggttggagaagggagggaggagggaaggaaggaagttgttttccttctttttgctcgttttgttatttctggttcgattttgctatatatttgtcgacaaatttttcccccaaaatttgacagatgtaattacagtacaatcgtactgtaattacactgtaacttgcatgtaattacactgtaactatagtgtaacttgtatgtaactttcaaaaatctctccgttacatgttatttcggtaaaatggaggtcgtgggaacaaattctttcacatatgtgtgtgctatgatttgttttcttcctcaccaaaacaaatcttgtaatagatccaacgattcaaaattatgtgaaacttacatataagttacactgtagttacatgcaagttacagtgtaattacatataagttacagtgtaattacactacgattgtactataattacatctgtcaaatttttagggaaaaatttgtcgacaaatgtataggtagtcccatacattctttttttaatagatgacgcgttgaattttgaacacatgtttgaccatttgtcttattcaaaagttttattcaaatgtata

SEQ ID NO: 7054 - DNA, 1501 bp, Oryza sativa
aaagggggaataatagcaaggctaagtagaggaattagtccggtgtgtccccgggcgtcggctcttgtgccgcaacgagcggttctaaggttagtgtcatccatccgccaagaactgcttaatttgtgacgatatgttctcacttgattgcttacttaggccacagaagttggcggaagagcaccgtctcatcgaagtcggtactcaggaggtgctgtctgagctcgcccttatgagttcaatctccacgtcgtcagatgggcgggaggctcaactcgagagtgaactcaatgagacgtgtgaggaccttcaaaagatgaggaacctcgttgccggacacgaccaacaacgatagggcacctagagtcaatccgggatggcttgaggcaaaattatacatgacttgaccagctggcgcggaacctaggggtaaacgtgaaggtcccaccacacttcgacgatacgacgctggtttcctcgctcatggatcttatcaagggactggaaacagtccatggtaagcatgcggaccacgtaaccgaggaaatctgcaccggcttgcgcaccggtcccagccatgtcctcacttgcgtccggcacatgcaccacgagatcgacctcatggaggtccttgaaaagggtggggccgacccgacgcgcgaggacgtgttgtcgggggtggcggacttaggggaaagcatgatccccttctttgaggagtaatatttttaaactcgatggtttgtattaacttaaatgtaatactttgggcccgctttgtccttaggtagaacaatttcgcatagaggtttttgtattctatagaggtattgttgacgaggatgtccagcatggaggaggtcctgatgttctcgatgtcgagcctgtttctcccgtgactttgtccgcctcgaatgtcaacgaacgcgctctagtggcggtggacccgacaatgtgctcgtcccatctggttagcacttaagctcactcattcggcgtactctaggttgggtcatcagcctctgaatctcagtcttcatagataaccacgaagttggatttgctaaagttgttcccttttgtaggcctcgaggatgcacttgaagagagaaagtgccgtgccacatattggaagacgaaatttgaggtggccaagcttgagctttccatcgagatcgccaaaaaggatcaagacgttgagacgctctgaggacgcaagatctggctgtagaactcgtatctcaacagccattgcgacgccatggcggatgtttgcagggatctacgagtagcgcgtcctcctttggaagaatctgtaaaatcaaaggtgtttttgattattattctgtgatgaacaattgggcattggagattattggttttgttatttggaatttattcacgaagtggttttggagatgattggatttacaggtgatcgcaggatttgtcattttatatgaccggtcagaccgggctctggtagccggttagaccggcg

SEQ ID NO: 7055 - DNA, 1501 bp, Oryza sativa
atatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggtatttacatatgttaattagagtttttaacaattaatttaatataattcctatgctaagtatatatgatgattacaatttttattaattttaaatcatgccgtatgtatatacatatgttaattagagtttttacgaatttaataatatcattcatatgctaagtatatatgattattagaatttttattaattttaaatcatatatttgcttattacgatttatccacttaatttattacagacaacagtaatttttcgaagtaattgtcattaatctttgtactttaaataattgtaatgcattatcttctattttagaaacacatatgtaatggaaaataatattcagtgcgcttatcagtagtcccggttcttaaccctaaccgggtttaaaaagaatttgaaaatagcgggaaaagatctttagtctcggttgatgagaacaaccgggactaaacaaccgggactaaatctttagtcccggttgttctcatcaaccgggactaaagatctaggggtatatatattcccgatgcgcgccctcgtcttctccactaacacttagaagtttttgcccgatcaatctctctcggcttctccttcgccgccactgcctagggcatccccgcgccgacgccgccgccgtatctcgccgtcgtctcgcgctcgtcgtcgtcgccgccgcctccgcctcctccgccgccgccgcatctttggggtgagagccgccgccgtgcagcgcccgttccgtcatggcgcctagcgggaaaactatctcttaaaaaccctaattgcgaaatctggatctttgcttgttgtctaacgtctgggccatctcagatctcgaatccccgatctatcgtcaagttcaatcccgaatccaaatccttcccaaatcaattccctctgcaaaagtctattttgcctccctcgggttcgatgggccgaatttctctcggaccatctgtgcctacctccccatgtgtatctccctctctctctctctctccccgctctgcccgtgagccgcgccgagccctccctctccactctcgctgccgttcccgccgacgccgccaaatcgtcgccgcgcgccgttgcttcccgcgcgcacgcgccatggtggccgaccggccagtcgccgccgccgtcagatacaacattaagcaacacttgacagatgatgggatcagccaggcctgggtggccgtttgaaagctgttggccggatgtcaaccttgatcaattcaaaagactgataccttgcacatactccgaccggacgagacgcactgtctcatccgtgtcgtttgagaagcactcacttagttgtttc

SEQ ID NO: 7056 - DNA, 177 bp, Oryza sativa
taaccaaagctaattaatttcctgtgacacattatacagggttttcaatttattttattgatataatattttatcacaattatttgaccattatatcttccccaataattgtggagcatccacttttgctatttggagatttaattaaactacaaatccaatcatcctatatataga

SEQ ID NO: 7057 - DNA, 249 bp, Oryza sativa
  unsure (1)..(249): unsure at all n locations
agagagagagagaggaaaatgagagagagggaaagtgagaaattagggggagagagagagaanagaagggggcgggggaagagagaanaaaagtccaaattttttttaatagaatgcgaggaaagtgctattttcctgcgcttttagattagaaggctcgcacgtgaaaatagagttatttttgcgtgcgggcctgttaagtgacccgcacacgaaaattgatttttgtgtgcgggtgatgacccggct

SEQ ID NO: 7058 - DNA, 1501 bp, Oryza sativa
atgctagtgattaccgtataaatgcttgcacagaagaaaggctataaaacctcgatgtaaaaagtgggcattattaactgaatgccaaacctctttatttttctccttttcgctgatatgcaaatcatggatacagcaaaagtgagatcatgattattacacagtcattcagattagtagtgttctgatgttccctctctgcctaaaatgtttttcatggagagagagagagagagagagagagagagagagagagagagagagagagttgagagtcgagacatgtgagtccttgttggggttggcatgcaatggcagcagcgagagccaaaaggcccaaaggcatcattcataagcatggtagcccatggcagcgaacaatctgctgctttgcaatgatggctggcttggtctggtctctcttctgctcgatcatatcactctctcctctcctgtgcgtccatgctgatgatgctactagcatttccaatactcatgtcatgtgaggggtgacctctcagtctcaattgcctatggtaggagtatatggcatgcatgaatgcatggctgtctgtgccaccttcgacctaggagtaggagtagtatatggctacatggatgatcatgctagctacacgtacgacgtcagcgcatataatttcgggccaagcacccaagattagatacgggggcttttctcatctggcctttcacattgtaaggacgtggcgagttatcagcctcccgcgtcacgtcggacctgcgcatacgtggcgacaacgttataccggccgccagcgaagatgtatttattttcgctagcggtcacttagatgtgccaccagcgaagatggataattttcgccggcggttgggttatatagtccggcagggaagatacaattatttttttttgctagcggcccacttaagcaaccgtcaggaaaaatctagaaggaaccaccatctattaacaaaaaatcacgcaccgcccatgctccttagagcaagtttaatagtatagtcttaatagtatagtccactactagcttcaaatcatatatagcaaatgtaatagccaattcatacaatagttgcttactatactattagggcctatttggcacagctccagctccagctccacccctcctggagttggagctcagccaaacagtttcagctccaccaaaactggaagtggagttgggtggagctctctcacaaattgtattagagttgtggagctgggtttagtcggctccacaactccactccagactcaactcctataactaaatttagaagttggaattgtaccaaacatgctcttaatacctggtcccacctgtcatacacacattacgtcttggagtccatgctgcagctggctacagatctatagcccgctgctcttctctctctttttttatctctttaaaatatgtttatagctggcttatagcctgctattgtacctgctcttatccacccacctctc

SEQ ID NO: 7059 - DNA, 1501 bp, Oryza sativa
cacacattgttaccaccccgttttgcgtgaaacacttaatctttatcttcatcttcattttcaggagattcaaacactattgtatcaatcaccgaaacatcttccccgtgttagtaacattcttatcttactaaaccatccatgttaatcagggccatgaaccatgaatgtcaactgtcaagtactcaagtcctcaaactcaatttatagaaacaaaaactattagaaaagagagagagaacgacgccaatcagggctgtgaactatgaatgtcatgtactcaagtcctcaaactcaatttatttatagacaagaaaaatggtcgacgcgtctcctcctcctcctctcgcccccttgccgggtgccgctccggcccaggtgcccacccctcctccgccgtccagcccggccccggtgtcctcccccgctagcacaggttccttcctcggctctcctccctttccggagagagtcagcctcggctccctctccggcgactgctcggatggggattcgccagatctgcttcgccctcaattcctcccggcagatctggtcagtgaggcagcggatgcgcgtccccccgtggtgccagccaagatccagcaagttcccccctccacaggttcttcaggttttcaggcagccccgattttgctgcgcagggtgggtgaaggatttactcctcctgtgccctccggcttgaaggtaaagggagttactcctcagggtagcttcgttcaagcagcaagaggaatgacttcgccctcgcagcttcccaaagcaatcccggtaaatcttcagtctgagactgccacccgtcttcaagtttggcagacagtgaagccaaagcattggtggaggaagagacctgcccaacggccttcggcattcatgcgccttcaatccgctgctcctcctcagcttccctttgcattcactgatcgccaccaacctttcccctcgtagcccaagcaccttcaggaccaccgagttgctttaaagagcctcttcaacctttgaagagcggggtgtcactgcttccgttgtctagctcaggaccaccgagttgcttcctgtagagacccccttaggtgcattctctgtggcggttctggccacaaagcccgctggtgcccgggagacagacaatggcataggggggtccagcctcctcgccccactcctgctcctccgctagccagtcggcttgttttccctccgctcccggcaatgacgcgcccaggggaaccagccaacaggccggacagcatccagcgcgtcctgcccaggacatcggccatccgtgaggacgaaagtttcctttctcactccgcagcggtggtacaggttacaggcaatctcccagtgacgaacatgcgacagatcaacaggttgctggcgtccaggttttaggttcctcatgaggacctcaatgttgtcgtcttcccaaaaggaggctacctggtcacctgcacctctcggtcgctcagggacatga

SEQ ID NO: 7060 - DNA, 1501 bp, Oryza sativa
catggctcctcccgtcgccgtcgccgtgcccccacctcccgtcgcagtcactgtcgcgccccacgacggctcctcccgtcgccgtcgccacgcccccccccccccgacgaccgtctctcgtcgccaccgcgcacagctgccggagccaccgccgccgacgctgcctaggaggagaggacgccgacgccgtggatctgtagaagggaggaggaaaggagaggtgggtgctagagaagatctggatctggatctggagggggaggaggagagttggagatatttttattctggagaggtgggtggataagagcaggtacaatagcaggctataagccagctataaacatattttaaagagataaaaaaagagagagaagagcagcgggctatagatctgtagccagctgcagcatggactccaagacgtaatgtgtgtatgacaggtgggaccaggtattaagagcatgtttggtacaattccaacttctaaatttagttataggagttgagtctggagtggagttgtggagccgactaaacccagctccacaactctaatacaatttgtgagagagctccacccaactccacttccagttttggtggagctgaaactgtttggctgagctccaactccaggaggggtggagctggagctggagctgtgccaaataggccctaatagtatagtaagcaactattgtatgaattggctattacatttgctatatatgatttgaagctagtagtggactatactattaagactatactattaaacttgctctaaggagcatgggcggtgcgtgattttttgttaatagatggtggttccttctagatttttcctgacggttgcttaagtgggccgctagcaaaaaaaaataattgtatcttccctgccggactatataacccaaccgccggcgaaaattatccatcttcgctggtggcacatctaagtgaccgctagcgaaaataaatacatcttcgctggcggccggtataacgttgtcgccacgtatgcgcaggtccgacgtgacgcgggaggctgataactcgccacgtccttacaatgtgaaaggccagatgagaaaagcccccgtatctaatcttgggtgcttggcccgaaattatatgcgctgacgtcgtacgtgtagctagcatgatcatccatgtagccatatactactcctactcctaggtcgaaggtggcacagacagccatgcattcatgcatgccatatactcctaccataggcaattgagactgagaggtcacccctcacatgacatgagtattggaaatgctagtagcatcatcagcatggacgcacaggagaggagagagtgatatgatcgagcagaagagagaccagaccaagccagccatcattgcaaagcagcagattgttcgctgccatgggctaccatgcttatgaatgatgcctttgggccttttggctctcgctgctgccattgcatgccaaccccaacaagg

SEQ ID NO: 7061 - DNA, 648 bp, Oryza sativa
  unsure (1)..(648): unsure at all n locations
cccattagtagtaccacaacaaaaagagggaggaaaggtttttatttattggtccccattcacaagggccaaggcctacgcaaacgcaaacccaagttgcccccgttttaagtggcttttttgtccggggaaggttcgggtgcgttggtgtacgagggggcgtgcagacagtcagcggcctgcagcgcgcatgattaggcgctgcggaaagtgccagnnngggtngggggggggggcaggcagcgatccagaggtttattcgggggtggtggaggtggactggtggtggccgtggctgtggctgcctcctgcacggcacggtgaaaggatcagcagcagcgtcgtctctgtcgatcgatcgatcgatcggcagacgatggatggcgctggggttgggttgggttgtgtgtgttgttgtgcgcgttccatctgcatgcactgcgtgcggtgcctgtgctgtgtgctttcgaggttcgtttgaataatggggtggtaaaaggcggaagagagtttcggggtttgggggtgtcgaccgacttgtttgttgccggtgtagggtcattgcctctcgacctatggaggtcaggtacggagtggtatgtttgtacgttacaacggtgtttatagcttcaaatcttacagaatctt

SEQ ID NO: 7062 - DNA, 1501 bp, Oryza sativa
tggttgggagccccacatggatgctggatttcccaaccggcgtctcaccggcggttctgatgagagaatcaaaaggtatggtaccgggacctttgatgttacacgaatgaaaaaaaaaggcggcttgatgcactagctaatcgagccgatgcatcgagctgctctctaccaaactcagaccaccatcgatgaaacaacatccacaaagcacacgacataaatcatcatcgatccatccaacaacacagtacaaatcacataaattttaatggatatccaacaatttcacacaacacaaattgctcactgggacatcgaggttgccgttgatggattcgtcgaatccgcaggagtcgctgccatcaagggcatggacgccacgacgccgcagcggtagagatgggaggaggagggtctgcgcctctgcggtggtggggtgggagagaaggagagacactgctaccgccggatccacccgcaggagaagccaccgccggatccacacgtgggagtcgccgtcgtcgcagccgtcccgtaggagccactgccatcgaggggatggacgccatgacattgcagcggcggagaggggaggagggcaggctgcggtggcagggtgggagagaggaggagagactgagagcgcggaagatgagggggctgcgagaaaggaggataaggatgaggaaggagctcggtcggctcggctcagtgctatcaagaatctcaatatgtgttggtttactaaaaaaaggcacatatagtacactataggtgccggttaaattaaaaaaagagtaaattgcactggcggttcttaaacttgtaacgaagtttcacttatatccacaaacatgagaaacacgcatcgagatccccaaatttggtttaatatattatcccggtctaaagcctcgtttgaccgtggccttgcctacgtggcatgctacgtggacgatgacatataatttctttactcccttcttcctttttttctcccttcttatccctttttctctccactttgcatccttcctctcccttctaccgctgacaggtggggcccacctgtcagtgcccggcgaggctggtgagggggcggggagaccggcggcggcaatggcgtcgtcgacgggaaggagaaggaggatgggaaggggaaggcccccggtccgaagtggccccgctgcagctgtcaagctcgtgcccgccccgctcgcgctgagctcaccgatacctccaccgcacacgtggccgcggtcggcgacccctccccaagggcacggctggcgacatcaccccccgcgcgcgcctcggccgcttccgcatgaatgacgcgccgccgcccaatgaagtgcgccatccccctccggcgctggttgcaaggccataccacccgctcctcaccatcgccgtcgtcttgggcggcggtgggagaggaaatagtgggagaagtcaaatgtcagcgcagcgggaggagaggagccgcggacagcggctg

SEQ ID NO: 7063 - DNA, 425 bp, Oryza sativa
ggcaaagaaagaagaagaacagcggaaggaattcagattcaattcatttcattcactcaatctctcaatacatgtttcttgccttatatcatggcggtaaggattgaattgtgggacccaatcctatctttagggccactcgtcattcacccaacattggatacatttatgtagtatgggtatgacataactgtgtatacagatttatatagctaaattttaggacagaggtagtatgaagagactatatttcatccagcttcgtatataaaaagtaatgtttgtacatgagtttgataattaacatactatgtttaaatttgtatatatagcatatagaagttggtttttctaaagaccgatagtgttctcgctctctgtacatgcgtcgtgtcaaagactcgatcgaagccctgcatgactca

SEQ ID NO: 7064 - DNA, 1501 bp, Oryza sativa
tgattttaattttataaaatttcagtggcacttagctgatatcacgaatagtaataatatttttctaatttggcatatttgtaatggcatggaccaattaaccctaaaaacaaatacttgaaagcaagatagcatatttactatctttatgttcaccggaaagccataattattatttgtgtgacgacaagacaccacaaattaaatatatatacgatttcatgagaaatgatgcatacggttattattttaaaattcaatcacaacagacagatgatattaaaaatatttaaatattttcctaaaagaatacatacaagctttcttgcatcttaattcccaatagttcaaccttttgtcatgccattagcaacggcatggcaacgagaggctgccaaccccaaagtttgtttttctttccagtgtggcagcattgtcctgtttagacacgtcaccaatggcgtggccaaaatgtctaggtaggaaaattacatatgagaagatttatttatttatttttgcatttttctgcttataaaattcaacagccccacacaactaaatcaaatctactataccactttaaatgaattcattaatatttaagagcaaactaaaatgacgacacacacgaaatgagcgtaactcaactaattatgatccttgtggtgaaactaaccgcttggatttaagttctaaacttgatatgaatgtttgcatttacggctaattgttccttcagtaataggtcacgtacccgttgacagcgagacgctcatgataacttcgccagtctcaagatatactagttttgtctttcggagatgctcattgagataggtgcgcggatgcgtgcgcaatacaagtgtatgtgtttgtactttgttttttttaaaaaagcatatctatcttgcgccagcaagcaaaacaaaataaaataaacagggttgtgtttagttcacactgaagtttgaaagtttgattgaaattggtacgatgttatagaaaagttgtgtgtatgaaatgtttgatgtgatggaaagttagaagtttagaaaaaaaaactttgaaactaaaaagggccttaataaaaaaacaatatttcgttttcgccttattacgccatactagtatatatctgcgttcttgtcaccatgtgtacatgtaacatgtcatttcgccgcagttcatccatcgttatatgttattagctcagctttctacctaggtcaaacccgagcacaaactgcagctagcagtgacacttcacagttcacagcaacagcagcagctgtagctcgagcttgccatctatcggccatggcgagctagctactagctagctttatatatatacctcgccccctccccttttacccccatcttcttcttcttcttcttggaccccggtctcccctcgtctcctccctgatcgagatcgagtagtagtgacacgcatacaccaccaaccaccgccgcccgccgccggcgagctgcagga

SEQ ID NO: 7065 - DNA, 1501 bp, Oryza sativa
cttgctcgtctccgtcgagcactccggcgtctgggcagtcgccgcggcggcggcgccgctctggctcgccgacgcggacgcggatgccgcgccctcgccggagcactgcggctgctgctgcgtcgtcgccgtcgtggaggtcgaccccgacgcctcggggcccttgccgttgccgccgccgccgccgcccgggcgcatccagccctgcagcagccgcgcgatgttgtccgcgctcgacgcgtacgccgccgacgaccccgctggcgtcgccgccgccgccgccgtcgccggcgacgggtcggggtggtcgagcgagagcgcgtcgcgcagcgcctgccgcgccgtgtggatgtccgtctgcagccgccgctcccactgccccttaggtgcggcggccttcacgcttttcccgccgccgtcgccgtcgccgcggccgccgccaccctccgaggcggcgccgctgtcttccccaccttcggcggcctgcatcttcttgagcttcttcttgaggtgcgtgttccagtagttcttgatgtcgttgtccgtcctctccggcaagtacgacgctatcgctgcccacctacacagccagcaacccactcatcagccatggacgccatggacaaatcaatcaaagcaaaccatgaaaaaccaagaagaaatcaccggttgccgaggagagcctggaggtggacgatgagcttctcctcctgctcggtgaagttcccccgcttgatccccggcctgaggtagttcgtccaccggagccggcagctcttgctgcaacgcatcagccctgcacacgcgacgcgcacagatgaaaacaaaaatctcggatctctcgccgatcgatcgatcaagaacgcaagaacacgcaccggtgttcgtcggcacggcgcgccagttgccggcgccgtgctcctggatgtaggagaccagcatcaggtcctcctccggcgtccatggccccttcttcaccccgaccttgtcgcagcacggcggcctccccatcctgcagctcgccggcggcgggcggcggtggttggtggtgtatgcgtgtcactactactcgatctcgatcagggaggagacgaggggagaccggggtccaagaagaagaagaagaagatgggggtaaaaggggagggggcgaggtatatatataaagctagctagtagctagctcgccatggccgatagatggcaagctcgagctacagctgctgctgttgctgtgaactgtgaagtgtcactgctagctgcagtttgtgctcgggtttgacctaggtagaaagctgagctaataacatataacgatggatgaactgcggcgaaatgacatgttacatgtacacatggtgacaagaacgcagatatatactagtatggcgtaataaggcgaaaacgaaatattgtttttttattaaggccctttttagtttcaaagtttttttttctaaacttctaactttccatcacatcaaacatttcatacacacaa

SEQ ID NO: 7066 - DNA, 1501 bp, Oryza sativa
atttcccccgtgggtactgcttcgatccatttggtgaatttgtcgatcgccacgaataggaatctgtagccaccctgtcctcgtgggaatggcccaagtatatctagcccccagcacgagaatggccaagtcagagggatagtctggagcgcttgcgcgggtagctttgtgtgtttactgtggaattgacaggcttcacatcgctggaccatgtcgcatgcatctttaagggcggttggccagaaaaagccttgtcgaaaagctttgctgaccaatgtccgaccggcggcgtgtgacccacatatgccttcatgtatgtcgaggaggaggtgtgtagacccccgattttggaaatcagaaatcttctgtgtttatccgtaccaatccctgtgtcggtgacatggggccgggggtatcgtgactagaggcttgggtagccgtggtcacctacgtggcctgaccccctcggtgggggggggggggtcgggcccgacggtaacgtgcccacccctccctctgtctccccgaggggtcggcccgctcccgtttcggccccgagggttggggcgccccgaccccctgtggttttggcgccacgtgtgtgggttaggtgagcacaaggggctcacctaccggcatttatagcagttggcacgagcgcgccacgccgcatttaatggggcgcagcgcacgcttatccggaccgtgaccagtcgcggtgtgtgaccggtcacagcccggtaagatcgcggggtaggtggcaacaggcggcctgtcacacgcctcgccccatccggtaagaataatgagagcttcctggctctcgtccctagccggagccggcgtgctaactcctggagttggtatgtcagtcccggtcagatccattccaggcttcagcgcaaggatggcaaggaagtcgctggccattaaatgaaggttgaagtgggcgtccccgggaaaagcgggcgagcggggcaggaggcgtgtgctccgcttgtcatatgtcctttccggctgtagattagccctcattgtaaaagcgtgtttcctttcttaggtagcgggaggcccatgtggtgacccctgaccagataaaaaggaggcccaggcctgagagagaaaggaggagaaaaagaaaaagaggagaagaggggggcgaacggggctagagcctgaacgctctctcgctctccggctctggatattccttcactcacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggtcgaaccggcaaaggggggcctgcgcggtctcccggtgaggagccccacgctccgtcatctggcgcgccaggtagggggcgcgcgggtctttctaagccctcgtcctctctcgtgtgcgccaagcttcgcccgctcagccgaa

SEQ ID NO: 7067 - DNA, 1224 bp, Oryza sativa
caagttcagcctgaagtgcaggaaccaaaacagaactacgccaaattcgtaccctcatttcaaaatcatccaatgagccaatgtaccaacggcacgaacgtacgattacaaaactactatcatctaaataattaaaggctgccactgccacggtcctgcaacatgccggatctaaacgtatcgaaccgtttgaaccccatccataaaaaccagacaataaagaaaaggttaaagacaagccgaacaacaactcaacaagcgtttgaatctcctgggctcacaggggaaaaaaaaaacctccagtacagtaattactccaccaccctactgtgccccccacatgcgctggcccaaatagcaaatccatactactcttccgcacaaaatataaaatgtatatagaggtttatatatataggccatgtttagttcacaccaaacttttcccaaactcccaattttccagcatatcacatcacattcaaaactttcctgctcacataaactctaatttttttttctaaactaccaacttttcccaaacttctccataattttaggaactaaacacaaccatatgtattacttctattagaaaacgttccatcggattatattgttccatcggattatattttaagactagcacaacccatttctaaatcatgagagcaagtttaatagtatagcccactgctaagtgtctaggtccaattcatttatagccaatctaataaccaatttataaaatagttgtttcctatactattagtatatggttctacctgtcatacatacattacgtctcgaagtccgtgctgcagctcgctacaaatatgtagcccactaatcttctctctcatattctatcttaataaaatatgtttatatagctagctaatagtctgctattgtatttgctctgagccactccgatgaccaaatcttgacacgtgtgacgatcccgtcggccgccgacgctgttgctgcgccggcctcccgcagcggatggacgcgtgcacctctgcctatctttccgcgctcgatgcagctcggtcaacttcgcggcttgccccctgaagtttcaaaatattactcctacgagttcggggggtgaaacttgaaaagctttgcctcgtggatgccgcgtggcccacggccacaccgtcttcctcgggccccggaagtttttcaaatagagggagccgttgcgcttgcgcagca

SEQ ID NO: 7068 - DNA, 1501 bp, Oryza sativa
gattaactatattattagcttagccgatggcatcgctgagcatttctttttcttcttcttctttagagaatcatgtgcaaaagcatgcgtcgcactatgtaattatcgccgtgttaatttgtcctatatagccatccgtaacctggctttctctgataccctgactaattcaagatgatctttttgatggttcatgcagtgctcgtaatgtgatctgatcatcatcaggttaaaaatatcagcctctttgcattattttataatcacgctgaatgtacgacaggatgatgtttaattgcgttttattagatttgtggatgtgtggttttcaacggccaatgtacatatcgggttagttgccattacaaaacaatgtacttaataaagtaagtttgaaatcctgtaattatgcccaagctggaattgttgttttcagcattcaatcgacagggtggatgatgcaatgttgaagaagatcttttctgtgcgtgcgtcttaaatgtggttaactgtgaggcccagctgccctctttgtccacactttcaaatttaaaaaattgtaggaattttttagcacgaaaaagacaatacattgttttaataaaagagagaaaaactcggtcgacacacctaaaataattacattgtattaaaaatataacaagagacatgagtatactctatgtcacgccccgagctagtcccgactggaattagcccgtgacgctccaaattaacctgttaatcgataccagtcccaggaaacagtgctggtatcacaggaggatagaatatcacagcaacagaggtctctttattatagagtaggagtacagtcatgttgggctgtggacagatcccgagctcacaactgcattacaaaagggaaacggaagccgggacttggaccaaacaacacaggcgcgacttgggaactaggccgaaaccctaaaagtcatcgtaaccggcttgctcctggaagaactcctcatcagcagggtccgcttcatcttcatcagcaactggggggtatttatatagagcaagggtgagtacgggagtactcagcaagccaggggaaataagtgtttaatgcaggcttcaagggaaggctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccaccacgaactagctgatcccgtcagctgctgattttccaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccaca

SEQ ID NO: 7069 - DNA, 863 bp, Oryza sativa
aattatcttaatcttgattaaaacactgaaaaagaggcacgcaactcctaattgaggcagtcataccactgacacatgatatcgaccaccgactaaccctcaagcaacaaacctaaacacgaaaactagcaagcaaacagactaagaagacgataaagctaagggcggcgactctgaagctcggggcggcgcttgcaatcgagggataggactgacatctaaagtagacaagggataggaaccaattcatgctcaaatccaaattaaacaaagcaacaaatgactcaaataaataacctagcatggtgatttttatgcatggaacaaccttttccacgaaccgagacaaaagacactaatgcaactgactaaacaataaattaatgcatagactagttgcatggaaaatgatgcgcataacattgccccatcgaacatagacacgacctaatgcataacccccaatagattcccgactgactgtcgaataaactccaaataaaattttactaaaaccctagactgagctaattttaaagatccgatccgaatgaacgaccaagattttttttcccaccaaccaaagaggcaaaccccaaattttcccgaaacaaaatccaagtgaaaaaggcatatgcatatgaaaaagggttcagagggctcctaggttttctagttggcttgccctacggtcaaggtcggctctgatgctaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgga

SEQ ID NO: 7070 - DNA, 307 bp, Oryza sativa
ggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttt

SEQ ID NO: 7071 - DNA, 266 bp, Oryza sativa
  unsure (1)..(266): unsure at all n locations
gtgaatctggttgatcgcccatacccgcgggcacggctattcgaatagttttactctggcaagaggtgtacanctgtacccacaagacacgattccacacatgtcgccatgccccgaagtatcaccatgatactgcaaagggggaaaatcgtgacaagaccctccacataaccctcccctaaccatccacaccacgctaaggtttcacccccacccctcaaaaggcagtagcgggtcccctcttgcgccgcagtgaatccggcagc

SEQ ID NO: 7072 - DNA, 1442 bp, Oryza sativa
  unsure (1)..(1442): unsure at all n locations
aggcgtgtgnttttgtagaacctttgtcttgtnnnnnnnnnnnnnnnnnnnnnnnnnnnnnnnnnnnnnnnnnnnnnnnnnnnntatgacttgctgagtacagtgggtagtactcagtcttgctctcttttctcccacaccagagctgaagatcttcctagttggagctgttttgtcaaagttggtttcttcgctgccgtcaaggattgcctgtggagtggagtcgcccgctgctgaagtcaaacttcccggtttagctcgcttttatcttttccgcagcatttgtaatcttttctatttttggtagacgtggatctgtatgtaaacaaattgtggttgtgtaccctggctggtcctggatagggatttaatgcacattcagcttagaaattctagttcgagaatttctgggcgtgacaccgcggggtggtcgtcgtcgtcgcgcccgacctcgccgccaccgcgctggatccaccgcgcctgacctcgctgctgccgcttgccgccgtcgtcgtcgccgcggggaggtcgtcgtcgccgctgtcgacgggtggtaccgcgactacggtatttggatggtatagggatcgtcgataccaaggtatatgcgagattgaggtaaaagagatggagacatggatttttatacaggttcaggcaccttatctaacaggtaatagccctacatcctattggccggaaccggtgttgctctttatttatctggatcacacaagtagaatatttgggaaaacctatctagttgtcgtcaacttggtggcagggataaccaacacgtagtcaacgacagggtagtcttcctcctcgagcatgaactcgtcgagatcagagatagcgctagatccctctagccggcctccgtaggcaccggatgcggtatgtctaggctaatctctgatgtcgagatctggcggggtgtgttggcttatgtatatgttgtgtcttgttggtcttgtggcttgctttttctcctcctggggggcttgtatttatacccataggtgtccccttgtccaagaagaactagggagaccaatatggatacaatccaggtagtccttgtcattttcatatagaactctatttgtccttccttatccgaatctccttctatatacgaggtatgattccgtataagatatggtatgtggtgggccttgtcgtgcttagtcaactactattaggtatgtggtatccataacactaacagccccgcccgtgtgttggtatttcttaacgacattactagaaatataattcccagcaatggcccagaaatactcctggtatattatggttacagagttcatccacaagcgcatggatataccattgtagcatttcacccgagaatattccaagggtatcgtatttattttatcccgtgggaagataatgtagagagaacttgactaataatt

SEQ ID NO: 7073 - DNA, 1351 bp, Oryza sativa
cttgcccttcctcggaacaccgaccccgtgcacggccgctcctttccctccctcccgcgggtgggatagcgccgccgctcctcccacgtcagccggcccgacgatctcgcctcctccctcgtggcgttcccgtctgccctctccgctagcgcggcgctcccgacagtggctggataacatatagttgtagaagcaaaagaggaagaaagaatgaaaaagtagggaggatgacatgtggggccacatgggcccatcatttttattacttttttgtgtatagctgacgtgggtcccgtgggttttattattttttcggatcaagttaccatgtaagcgccacgtggaacgaagacctagtggagtgccatgtaggcaacacgtgaaacaatactacgataggaccttatttgcgtggttttataagtttggggatgcgttgtatccagttttgtgatgtagggatgaatttcgaactcggtgacaaattgagggacctaatatgaacttattccacagcatgagaactgcatgaggaggaagaaaagaaaaacaaccaaaaggagtcaaagtctcaaacaaaaggaaaagagtgtgtaataaaaagagaaaatatttttttagagacatagcacaaacacattattgtcagaaaactttccgaaagaagggtatttagaaaattttaaacatagattaatgaaacacatgataaacaaaaaaaaccaaaaagcaaactacggtgcagacaaaaaagtttaaatagttaattattgaaattaaaccatttttatttaggaatatccataaagctagaattatttaattaattaaacatctaaccatttttttatcgtggagtaaccatctatcagacattttatttccttaaataatttcttgcggtacaatcttaaaccaaatttcagtctcagaaattttaaacactacatatctaccacatacaatctctaaaagattttaaatattaaggaaaaatatgtcccaccataaaatctactctctctctctcagcagtcgattcgtaacagaggcaaactttctaagttctcgttgggaggaagggagcccgaccgtatccgagtggttctctcctctctctctcgatctctctctacgcacacagacacgccgcaaaaaacgcatgcaacacgcacgccgctatatatataattaaccatcactgcgtcgctgcggccgcccacagccaccgagcggattagtggaacaaaccctagcctgagtagattcttcctctagctttcgcgagccgtatcgtatccattggatggagccctagagcaacaagaagaagccaagaatatttgcgcca

SEQ ID NO: 7074 - DNA, 382 bp, Oryza sativa
gaatgaaagaaatcgcagaatattccagcataaggagctcccaccgagtggtcttctgacaaaaatcaaggacgaggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttt

SEQ ID NO: 7075 - DNA, 1501 bp, Oryza sativa
ccgcagcttccatcgggtgccaatggcgacggcgctggctagaccttgtccgcccgcagcaccaccatgggagctccggtgtagaacgggccgacgcccagctcagacctcaggtagcacctcgctccggcgaccctcgcgccctcgccgttgagcgggaacacctgccaccaccgcgccaagacgccgtcgaggcacctgcggcacgacgccggcggcaggtccggcgagcactgcgccatggagtagatgttgcggaaccccgggtcgcgggcgtcgtcccccacgcgctgccccgtggcgaacagcctcgccgggttctcctccaccgcgtaccgcacggtggccgcgagcagctcggtcaccgcgcggtcgtacgccgccacgacgccggcgccttcggtgatgttggtgccgctgatgagcagcgtctcgcccccggcgttgtcggtggcggcgaggaagtcgcccttgttggagaatcgggcgtagcactggttgtacacgagggccacgtccttggcgcggccgtggcggccgccgcagacgcggcggacgtcggcgaggacgcgggtgccgcagtcgaagcagtcgaagacgctgaggtcgccgcggcagaggagaagcccgtagacggcgtcgggcgcgccgccgcggttgcccgtgccgaagagcgccgacggcgaggcggcggcgtccgcgcggagcgcggcggcgaggtcacggaggttggactcgtaggcgctcccggccttgtacgtgccggcgctggtgtcgcacgttggccacggctggccggcggcgagcggaggaagcagcagcgcggccgccgccgccgccgcgacgacggcgacggcgtggatgagcgtacagcgcggctgcatattggcgcggcgtcactcagtttaagttgggatcgatgcaaattaaagcaggtgaatatatatataggacgtagcctagcgtacgtagttttgggctgcactgcggcatcgatctcctacttttcgttttggatttgatcaagttccaaatcgatctcggcaacttgggcaacttgggcgtgcgataacgcaccaatctggctgaattcacagtgatagttaggtatttgtccacgcacacaccaacgcacgttcattttgacgcttaattgtcagcacatgcgcgcgcgcgccgggggggggggggggggggcttggtccgcgcgtgccgctgcctttgctattctagaagccagcaactctggtttctggcaggagctgttcataaatcacaacgaaagatgataacaacgcaacaaaaaaacgaccaagatacgtctcgaaacgtaagagagtaatggatctttgtttgaatgggtttatgtcgaaacatggattcggcaataataaaacggggtagcgcacgagacgtaaaagtggatggatgtggagacaaaggatttagacaggttcaggccctctcaatgagaggtaataccctactcctgtttggggat

SEQ ID NO: 7076 - DNA, 915 bp, Oryza sativa
gcccgcgcgctggctgcttactcgctcagccgccggcccccccccatccgcgtgcgattagcacaagctaattacgattgttactgttaaataccataattaaaaaatacatgtataatttaaaattttgagttatcagttttaaaaatttgggttaaaacttttgaattttgatatgaaagttttcaactagatatgaaatttttttaattttgagttggaagttttgaatttcaataccaaagttttaaaatttgagatgaaaatttttaattgagttgaatgtttctgaaatttgaattggatgttttcaaaaattgagttgaaactttcgaattttgacttgaaagtttttgaattttgagttgaaagtttttgaaatgtgagttgaaagttttcaaatttgagttaaaagttttcaaattttgagttgaaagtttttaaatttgacttgaaagtttttaaatctgagttgaaagtttttcaaatttgagatggtaagttgaaagttttcaaaatttgacttaaaaaattcaaattttgagttgaaagttatcaaatttagggtgaaagttttcaaaatttgacttcatgtatagatttcttatcaatctgttataaaaaaacaaatcttatcttaattattatcattatctaaaactaaccgtattagttagcatgtatccaaaaaaaatcccggaaaaaataaacacagaaagctcaccgagtgacaagggcccgccacgtctctaagtcgctagtacgcgcgaattagcaaaaccgcaatattactccatcactcgaactctgatccgaaaccaaaaaatccacctcttttcgcaagcacttgcgccactcgcaagtcgcaagccaaaaatcacctcactgtttccatggaactctcctcaatctcag

SEQ ID NO: 7077 - DNA, 181 bp, Oryza sativa
  unsure (1)..(181): unsure at all n locations
gcgtttccaaagntcattgnagngccnnccgcgnggtgggtataggcccccccccancgannacaacccctaatgaaccaatttaatagcagngatttttttattaataatagcagncgcgggggggggggtttaatcgtcagctctctttctctgcttgctggttctgtgtgggggtttc

SEQ ID NO: 7078 - DNA, 1501 bp, Oryza sativa
aattcgacatgcacactcaagcataggcaggccccgcctatttgcagaacagtaaaaaaaaaaaaagatagaggcaggatcagtagacggactcatcgaagtggtaacttcaattggtctctacaccaactaagaatgcaaaataattaactgccgcctcgtgtcgagtaacgcgcgagcggaggatttagagaggatttattttactcctattatagtgtagaattattctctcaatcccctctccaatctctttctcggattaaccgaacaaggcctcagagggagaggccgccggactcgtcgtcgtcgtcgagcgtggaggtgtagacggtgtagagcgaccagatgaggccgaacacgccgaggaggatccaccccagcaggttgttgctcagccccaggctcagcccggtcccctccgtcgacatccgctcgtccaccagcgccatcgccgccggcgccgacgacgacgacgccgtcaccgccgccgcgagcatcgacgtcgcgcctttcacggcggcggcgggcgtcgcctccttgccgtccctggaggagtagccgcacctcaccctctcacccctcctcgctctcagctgagccacccctgcacgcaatgggcaatggcagcttccatcagtgaactgaatgatctccgattcttttaccaaaattcttactcgctccgtcgctaaacatttgacgccgttgacttttaaaacatatttgaccgttcgtcttattaaaaaaaattaaataattattaattcttttctaatcatccgattcattgttaaatatacctttatgtatacatatagttttatatatttcacaaaagtttttgaataagataaatagttaaacatgtgctaaaaaatcaactacgtcaaatatttagggacacaggaagtatactatagcactgttgatagctttgtgaacttacctgacggccggccaacgacggcggtgcgggcggcggcggcagcggcgatggtcgccatggctccggctatctccttgcttagctagcaagaggcacacagcacactacactctgctggtctctaggtgagatgcaacgagtgacagcaggagtgtggctcgcgaatcgtgtttagttcttctggtctggttatccatgcgtggcgtggtgtcgtggtctatcacctctgagcgaatgggcgtccgccacctgaacgcggtagatttccgttgaaaagtaagcgggcgtttgcaccggtgaagtgcaactcctgccactatcttagattcagaaatgtaacggtgggtgtcaggtacaggaccacagatccaaatcctgaagaaccagccacccaggtgagcatgtaccaatcagagtatcagaacgtagtagtatatatatgtgccaggaggttgcacggcgtccgacatgccaacatggacattggctcaacgaacaaactatatatcttgacacaagtgtttcgatgggaagtgtcattgagtttttttc

SEQ ID NO: 7079 - DNA, 1501 bp, Oryza sativa
ttctgaacatccgaaaacaaaactgaacaaattctgccacaactactccaaaaccagccactgttccaatccaaaacataaatcacagggaaatgaatgaacgagacgaacaacagcaccttcttcatgttggcctccgtgaactcccacggcatgtcggggttgttttccggcgaatcgaggtgctgcacaacaagcaaacccacaaatccgactcattatcatcctcagacaaaacagacagatcagggaagagggtagggggtggatccgagggaagggggaggcgcctcacgtacgtagttaagcgccgtggagaacagcctggaggagcagcccgcggcggcgtaggagatctgcaacgagacgttgcccccggagggagagatcaggacggcaaagctccgccgacgaacagcgaggagatacagaggcatttggaggagggggaggggggcactgaccggagaacgggacaagcgtcgcgccgcggccgattccgaggcggaggaggtcgcgagccctaggaggcggcgggccgcgaggcgggcggccggcggcagcatggttggccggcggtgggggaggcgactcgactcaggcgaagaggggggaggggagcggagttgtggccgctcgcggaggtaagtagctcggcgtgacgtcagcagcaccggcccagtgggctctcatgggcttattgacccaatcggcccaatagtaataattccttcgtgtactggcaattataacgatctttttttttttggttgggcaattataacgatctactgtccggatttcgtaacaataggattctgatatatcatacttcatactggattgtttattttagtacggaggaaatataccggtagatcaccaatcttcaagcaaaatgaatcgtcctatatattataggccgagtttagttccaaactttcaacttttccatcacatcaaaactttcctacacacaaactttcaacttttccgtcacattattccaattttgtggagattatggataccccataccaacacggcatttataatccgactgggtatggggtgccatgtatagatagaatatctttaaagggacttgggttaaattccaaacttgtatgttaaggaaatacccgggatcttagtcggttaagattgaatcttatctgtaactacctattccgttagggatatggactgtattttataatacggaccccttcccctatataaggaggggtccaggtgcctcttagggcacgatctgctcccagatcatacgatcaataatacactcggcaaatcaatccccggacaggagtagggtattacttcttgttaagaaggcctgaaccagtataaaattctttgtttctcaacccatccacttttccagcttgatagccacccccttttagtattgccaaaatcttgtttcgacaattggcgcgccagataggggtagcgtcaagttcttcgccgattagtgcga

SEQ ID NO: 7080 - DNA, 1501 bp, Oryza sativa
tatatactactacgttctgatactctgattggtacatgctcacctgggtggctggttcttcaggatttggatctgtggtcctgtacctgacacccaccgttacatttctgaatctaagatagtggcaggagttgcacttcaccggtgcaaacgcccgcttacttttcaacggaaatctaccgcgttcaggtggcggacgcccattcgctcagaggtgatagaccacgacaccacgccacgcatggataaccagaccagaagaactaaacacgattcgcgagccacactcctgctgtcactcgttgcatctcacctagagaccagcagagtgtagtgtgctgtgtgcctcttgctagctaagcaaggagatagccggagccatggcgaccatcgccgctgccgccgccgcccgcaccgccgtcgttggccggccgtcaggtaagttcacaaagctatcaacagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcagctgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgatcctgcctctatctttttttttttttactgttctgcaaataggcggggcctgcctatgcttgagtgtgcatgtcgaatttggtgtaattaattggagacgtgcatggatattttgtaactaattaagttggtgtttaccttgagtagtagctggctaagtttttcatgaaagtttcaagccagttatgcgttc

SEQ ID NO: 7081 - DNA, 1501 bp, Oryza sativa
tcgctttaaacccctgcacaaagctgtcctgccactttggctttcgctgtttaattcttctctagcgcttctctaattcctgttccttagcacttttgtttccttttgtttctccttttggtttggcctctggctatgtacagttctttgtatttctcttactttgttttaatccaattcaggtggggtcttcccccccccccccccggtgttctataaaaaaaaattgagaagaacgtgaatccagatgaacgggtgagcagaagatattgtgaaactctatgtgtaattctagtacggtacactgtaccaattggagtcattatatattagcatttcttccctgaattttgatccttctcagaatgcaatgcttttttgtgtggattttgtgtgtgtttcatctattttcacatgattcatcgttttcatttttttttcaattattgtgaaagggtgagccatgtcgctgcatgtcatggaccgtggctagatgcagtacagccactatgttgtgcacaaatgtacacatctgtcttcgtacctctttgtcttcgcgagttgtccatggtttgtcagttccaaacttccaattaattatcggctatcccctctgtcttaaacaaaaataagttttgtggataaatttgaaaacatgcttatccaagttcaactccttgtcttgccaatgatatcgttcagagcctctcatctagttggtgtgtcattgtgaaagtgctagctagtgtacctcatcatcaagtgcctataaataaactagcggcacctacccctctttaaagaactactatagcactagtagatataaaccctggccatcgttcatctttctctgaacgtggaaaagcagcggtgagaaagaacaaaatgtttgtctcggcgattcgacaatgcgatgccctgagaataggatgcacggggaatttgagatgaagtccaaataggctccaatcggcacgctagagctcaagttagcatctcgcagattcgtgatgtcgtagacgactgtgatctagctcattctgtgtgtagagcatatgatgtggtcggcaccggcagtgttgcctgacacacggcgacagtgagcgcgtcctcgcgtgcgtgagacgatcgtgtccagcaaaacacgatcaaggcacgcatcatgtgataatatcctctccaatctagatttggtttcctacagtgattcgtgaagatatagcattataaaaaaaaagttaacggtgtcaaatcttaattgggatgtgcttcagttttgatcttgtacattgaaaatttgcgatagcgtgaaacatatgcatgtttcaccatgggtttgctactgatatggtacaagtacaacataaaataaaaaaaggagaattattaaaggtcgaacacgcctcctagatcactgtactctcttctcaacttgtgatctagtagaattattagaggtctaacacctcctagaatcaacaagttgttatatcctagg

SEQ ID NO: 7082 - DNA, 1501 bp, Oryza sativa
  unsure (1)..(1501): unsure at all n locations
gtgagtttgtgggcccagaattcccgagacgggggcgaaaattgtagagaatacaaaggctgatttacccgccatgtggttaaagtgttgcgnttaaattggcattaggatatcccccgcggtggggganggaaacccccgaccccacggaattaggggcaaggtactctctccagggcggggccccatggtgccgccgaccctgtcccattgttgaaggaaaaagccggcaattcgggggtcccataggccggggtgccgggtgatcgaccgacaggcccgggtcaagcgggttggagaagaaacgggcaagggccttttcccttggtgttccccctgttcaaagttttttaaacgccgtgtttccggttttgtcccgggggaaggccggccttcccaaggggcgggggacctcggttttaggtgggcctataccggccggcccgttagggggcccaaccccgcggttccgggtctcaaggggggagctcgtgttccttttcgaccaagttctacacccgcaacttgtgcttgtcggggccaggacctacgtttgcatcgccgccgccgtgccggggatcacaatgtggacggcgttcttcggcacgctcggcccggcctaccaccccctccgcatcggcgtgcgcggcttcgaccgctccgtcacggtgctgatcgtcgtgatcaccgccggcctcgagctctgccaggcggtggccggcttctccagcaactggaggtacgtcaagacggtgtaccgctgcgtgcgcgacgaccagccgtggacgaacaggcggcacggccacctctggtggaaggagagcatcacgccgccggcgacgaggtactgggacgacaaggtcggccagtacgtgctcctcaagcggttcggccaccggccatggaacatcctgtcgtggctgacgctctacctggtggagccgcggcggcaggggcagaagcgcggccggaggaagcgcctgccgcaggaggtccggcgagcggtgctcgtgtcgctcaaggcgagctacggccacctcaccaatggcgtctccacgctgcggaggcacggcctgacgccgcagctggagtgggcgtgcgcgttccccaagctcaccgaccagatcctggtgtggcacgtcgtcaccacccgcttagactggacgagcgccggcggccatggccggagccgccgccgcgacaacggcggcgacgtgaacagggtcgtggcgacgaagctgtcgaactactgcgcctacctggtcgcgttcgtgccggagatgctgccggacccgagctacaacgcggagcagatgttcgacacggcggtgcagcaggcgagggaccacctgggcggctgcaggacggagagcgccgtgctccagaggctgcaggagatcgaggacgaggagcggcgcggcgccgtgcgcgagagggcgggaagcgccaccgtcatcgagaaggcggcgctgctcggcgggcagctgaggcggnccgtgna

SEQ ID NO: 7083 - DNA, 252 bp, Oryza sativa
  unsure (1)..(252): unsure at all n locations
ccgtgccattgaattganattcacctcccgcnnnnnnnnnnnnnnnnnnnnnnnnnnnnnnnnnnnnnttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataatta

SEQ ID NO: 7084 - DNA, 1042 bp, Oryza sativa
  unsure (1)..(1042): unsure at all n locations
ggccaatggcaacctaagcaaggccaaccctacctgaattaaagggcaattccaagaataagggccaggaccttgggagtcccgataattacaacaagttcggatccgcgtttttgaaaaaccaaatgttttgtggaaccttgttttccaaaaaatagaggccaggaaatgggnggggcttcaaccaaaggcaaccacatttggcaagttaaaatgccaaatattggtaaaaaccaaaagggcagaaggccacaaggtggggagaaacaagtgctgttccaagttcataaagggccaaagattaatttgtatgatgtgcacaactcaaacacatagataatcgcattgttggattctcgctagtggtgtttcagaagtgaaaagcataatctatgtctggctccatttccacccctcaaaattatctatgcccaagttgccgctaatcaatctccacgccaccccattaataatatgcctatctagatgcgtgtgttgtgcacactcgaattccgcgctgtatcctgaatttttggattggacaaagtgatgaccaaactaaaaggaaatggttgtagcgcaaatttcccttacgaaaatcgacaaagaagacaaggtgaaaaaacataaatcacacattccaacgctggagcatgcgatgcagagcgccgcttatctttcacgcgaggcaggacacacacttgctctgcggtgttctgactatgtgctccccttggccatggctcgccttcccaaagatattgtcgttgggagaggaatcgaaactttatcctagctggtgacgtgacgaatggtcgaatatgcccctctattctgtgcgaaattaccggcccccaattggccaaacggtatatttacaaatgaaaaataatatgtgaataaaacttttatatacgtgttcttagcaatctaaaagcaaagactgaaaaataaattttgatgaaaaaactctaaaatcaatttcaaatttaagcctgaaaatttaaattttgaataataaacataagcataaacgaaaaaa

SEQ ID NO: 7085 - DNA, 1501 bp, Oryza sativa
acaccccctcaacgctaccgtgttcatatgcctgtttttttcttgtaacggacggttggatgtggtagagtgatttgtcctctgctatttgttctaaagttaaaactgaaggactactagctttgcacagaagagtgtggtgccctacgataccggggtgttttgtttagatgctacaatttgctaaacttatggctaggctttttcatcaagtaaaactagtgtttgatttgttgtcacatttgtaacatcacattttttctaaagcaaagtacttacaaacttttgccatgacacatcatacttatagccaacaaatactataaaaactaaggattaattagatctatatcatcgtaaatatattatattagaaaaataatattactatttagaaaatctgttagatgctattgtaatattttaaagttagaaccgtatcactccctcacaatttctctccatccccatccttcaattgtcatctccacttcttagtttttgatagcacattgccggtcaactcatcgtgctagtcgctagtcgtgtctctaatagagacgaggacacgtagcatttcctcctcaagcaagaggagcagtagcagcttgtttgcttgcgatgtcactacaaggatggctaggcatcttgatattttggtttatcgccacacttataacatgccatattttcttttaacttatatctctatataacatagtcgtaatttttttattataacttgtcacatttctagtcaatatactctctctgttaaaaaaacataattttaggtttttttccaacgtttaaccatccgctttatttaaaaatttatataatttttttaaaaaaacggtcacacgtaaagtatgatatgttttaacatatgccgcccagtgaacgttgtttactcaccttttccgtacgtgtcaaagctactccctctgtaaaaaaaggcaaaccctgaattttcgtgtctaaatttaactgtccgtcttatataaaaaatttttataattcatattttcatttttgttagatgataaaacatgattaatattttatgtgtgacttgtctttttaatttttttataatttttttaaataagacggacggtcaaacgttgatcacggaaactaggatttgtcttttttttttttttttttttgacggagggagtactggcgagtgactgacggactgactgcatgcatgcattcactccgaccggagccaacctggcgccttgagcccttgaccacggccacgttcacccctaccctgacacttcccacacactgtgccactgccactctccagcctccttcactcccctgctttgctagctgctcactctatttaacccgcctcactgccctcccagcacactgccagccagccagccactcatcaatcactcaaggcccctcctcctctctccatcaagagaagctctacctcggcccgtcctcgcccgccggccggccgccgtcgcca

SEQ ID NO: 7086 - DNA, 1124 bp, Oryza sativa
ccccccccccccccccccttcgctcaaactcaaatggtgccatctctttccccctccactggcgctgcttctccccttcaccggtgtttctcctctccactgccacctcttctcccctccgccggcttctctcctctccattgccatcgttcctctctctccccaccccgccggcggcctagcaaacgaaggcggaaagggcggtcggaggcgaaggtggcaaagccctctttctctccgcgagttgagctccagtggcggcggatcgagttctggtggcgcaaaccgagctcggaggccgtggatcgagctctgatggcgcctgcgccgacgtggatggcacgactgctcgcggtgctggcgctccatgaggacgttcgcctcatcctcctctcgccaaccgatttgattgcagtggcggcatcaccgttggatcttcttggacggcggagttggcgactgatctgttggcggcccgatggtcttcatcgacagtgaccctgacaaccctcggcgacgacgaccacgacggccctcggtgacgacaaccccgacgtgtagcgccgtcacttccccttctcccctccccgccgacttgggccctgtgtcagatgcttgcaggcgaggatcttgtagccaacataagacatgagaagcaatttggtcgttaacacatgggcccacctatttttccttccatgacagcccagtgtctttacatggctggacgagtttatacgtcacataggagtgcagtaaatggtctaaggatagacgggcctgcaggctggcccatatgcacggacctgaagatatagatggccataaggcccgacgacctggcccatggcatgccattttggctccacccaagcacggcacggcccgacgggggccgggcccgaccgccgggctgtgcctgcccccccccccgggcacgttgggccggcacggcacgatggatgggtcgccagccaggcccgacacacaatagggagtaaaaatagacatattatatgccatggtccaaagaatagggacgtaaaatagacttattttagctatatatgtgtgtcacagcccaaaagggagggagggaaaatagacttattttaaaagaggta

SEQ ID NO: 7087 - DNA, 711 bp, Oryza sativa
  unsure (1)..(711): unsure at all n locations
tgataaatatatatggtggtgcgaccccccaccccgcgcaaacatataaaacacatcttataactcgtggggaacccacacgggggggtgtttacagaaagttgaatggggtgccggacctaccccccccngttttttttatttataaatagagggcgggggtgtcttccccgcgtaaaacagccccttttttttaagaagaaactccgcgcgtcagaggggcggcgccccatgttccacaggggtaaagccccgcacccccccccccgcctgtgtatcacagccccagaaaatctaacccgtttgccggaacccctccccggtggccccgggggcttctccataaaacccccaaaagtggaggggcctgtgcccccctcccaaaataccaaggaaaaagccgaaccttgggcgcctatccgcgctgccgcnccggacggaacaaccgtagttgaccgcccgtcaggtaagttcacaaacctttccacagtgcaatagaaaccttcctgtgcccataaaatttgacggagttgattttttagcacatgtttaccattttatcttattcaaaaacttttgtgaaatatataaacctatatgtatacataaaggtatatttaacaatgaatcggatgattagaaaagaattaataattatttaattttttttaataagacgaacggtcaaatatgttttaaaagtcaacggcg

SEQ ID NO: 7088 - DNA, 1501 bp, Oryza sativa
tttcaatagctacaacttaatattcatgtaaaaaaaatatttcaacaatattgtgctttttcaagtatattgtatctctcgtattacttctctagtttcgcttgttggtactcaatgtttcatatatgtgggggaaaagtatgaattacccctcccccgaactatcgcgctctaccgaattaccccccaatccacaaaatcggacattcttcatcttgtaaaccggacaaataacccctccggctcaatccgcggtggttttgatcctacatggcagtctagtcagcaattcatttataaaaaaataggtggccccacctgtcagtttgtctctcctctatctctttcccaatctctcactccctctctctcttctttagggcgacggcggaggcagcggcgaggcaacacgagcgcggtggcgggggaggcattgcaaggcgaggctacggcgaggtgagcgtggtggagaaggaggcgagcacgagcgcaggtgagtggcgcaggggcaggcggtggtctgcggcgcaggacatgaaggctggacgtcggctgccatagccacggccgaggaggaggcggaaaaagaggaggagtgggtggaggcgggaagaagggatgaggaaccgttatgcttcccctggctgtgatcatataccttccggagaggagaggaagtgggacagcagtgttttacgcccctcttacctaagacagcctcacttgagcccgtccagtcacgtaactagttcccactcccacggccgccccctttttcatctttcttgccccatcctgagccctacatgaccgctgtggctatagcggtgctggaaggagagggtaggagcagcagtaggaggaggagtagtaagataggcgtaagcgggaggaggcctagaaatcctccaccaccgccactggccactttccccattaaagcctcatcattggccgccgcccttacctcgaaccccacctcctccagcaagttgtcgccgacgttgcccccatcatcctcctcggcatggcccatcggccgccgcgccctccccacgagcgctgccgctcgccgcctccagtgtcctcctcggtgccgcccgtcgcctccaccgttctcctcggctcggcccaccggctgccgtgccctccccgtgacaccgccgtccaccacggtcgtcgccgcacaaaatgcgagagagatgagagagagagagaaggatgaatcatggaagagagagagagagagagaaagggggtgagggggagagaagctgacatgtgggtccccccgattattttttttaaaaaataccgatcagactaccacatgtacaccacgtgggacgaaaaccacttcagaacaattagggggcggagaggaaggcgagccaacgcggacgaacagggagcagtcgcgcgaagtgcttcccaaaaaccttattgccgccttctcccggtgcagtacgtcgaaggcagaggttccggagacctactctcc

SEQ ID NO: 7089 - DNA, 1501 bp, Oryza sativa
atgaggtgggcctttgtgattttctaaagaattaattttcggatgagccttagcccatctattaattccaacactattttgttcgtggtaaatacgagcctacacaccatatcaaaaagtgtcaaataaccagatttttttttacaatttggttatttctaaaaacttattttacaatggcccctttctaaactttactatgaaagtggacccatagctcgcgcctaaggctattggcactgaagttaaatgtctcaataccaatacccaacccttatgccagttggtttggcactgagcatccatatctcatagtatttttcttctctcctcccatcccttttcaaaattttttgattttctgctaaattttagaaatatcatgattcatttccgctaatttatttcaatttataagaaacctaatttgaaatgagggtatggacgctcccgtccaccaacctctaaatcctattggttttccaaggaaattttgacaaattaaaatatcaagattcattttccataatttgttatttataggaaacttaatctaagatgagagttcctttctcctttgcccaacctatatgttgattttttgtgtaaaataaagtgggaaaattgacaatgtagaatttttttaatttatttctagaatttcagtaagtagtttttttttgaaaaacaaaatggtgattcactgtagtaatacttgtgataaagagataatttatcgtcatactatcatgatggaaaaaaaattaaaaatgactacatggaatctatttaaatttttctggaggtcttagttagaacgtgtactgtggtaaattttatttaccaaggcaagagagtcaccgatggcttagcatgaacaattactccctccgtctcacgatataatgaattttaagtttttgcttgtactgtttgatcacttgtcttattcaaaaaatttgtgcaaatataaaaaacgaaaagttgtgcttaaattactttaaataataaagtaagtaaaaaaataaataataatttcaaatttttttgaataagacgagtggttaaactgtgcaagcaaaaacttaaaatctcttatattattggtccgggggagtagttttttttttacaaacgtctcgagagggaggaaggagctagggtgatatattataaaagcatgtaagtagtgtaactcgtcctttagcggtacttcgtaatacgtacttgtactttcatttttgttaccataatcaaacctcctgttttgtactcattaattttagttgtaccaatgtacatttaattctttgtgaaaaacagaacacatctgattatgaaagactcttgtgtcttggtgctccatatagacgccattaaaaccaacacccaagaattgcgtatatatacgagtacatagagcctctcacttcccaacacagctgcagaagcatcgtcgtacaccacacacaaaaaatggcagatcttcacacctatctgt

SEQ ID NO: 7090 - DNA, 1501 bp, Oryza sativa
attgtaggatgtagggacgtacatggttaacgataatgacatgtagtaacagcaaagctgagaacaccaacgttgagtcccggccttgttcaccctccctcaccttccactgcgtgtagagtatcatcacaatttcgacgtaaacacatcacaaattcagacaaagctcgttgaatccaaaatcctaataagttgccagattttggccgcaccattacacacgaggagaccgaatcagatgatcagaggacgtcgcagtgccgcctgacgacgccctggcggccagtcttgacgccgacggcgccgagcttctgcatcgccgcggcgaagtcctcgaagaaggccgtccggttgtcggcgtagcgctggacgaacaccctcgtcgccgggtactcccacagcgcggcgtcggaggcgagcaggccgagcccgcgcggcaggttcttgaagtagacctcgtcgaacttgcccggtgtcatgatgtcgttgaagatggagatggtcgggtcgctcctgtagttggcgcaggagctctgcagcgcgcgcgcgaacgccgggttcagcgacgggtcgtacccgtcggcgctcctgaagctgtacagcctgtgcgcgaactcgccgcagtgggagaaccccacggtgtgcgcgccggcgagcgccacgagctcccgcggcgtgaccccttgcgcgcgaacagcaccgccatggcgcgcgcggacatgttggtgcgcgggaggttcccctcgacgtcgcgcgcgtcggaccggcgcgcgtcgcggcggcccagcgcgacggggaaccggggcccgccgaggatgcccacgaggtcgcgcgccgccagcgcgaggatgtcggcgcaggagacggtccccgggcaggccacctcgagcgcgaccttggcgcgcgccaccacgtcgaaggagtcgcccgggagggagaggttgatctccgcggcgcgctcgggcgaccggtcggcggagagcggggagacgaggaccgaggcgtcgcaccccccgacgaagcagtcgtggaagaagaggcggagcgtgcccgccgccgtggacgggttggcgcgctgcttggcggcgacgacgtccgcgacgatccgctccacgcgcgggcagctgtggcggtagtagttgggggacagcctccccgccgcccccgcgccgccgccgcctccgccgcgcgcggcgacgaggccggcggcgagggctaggagggcgcagcggaggagaagcgcgcccattggcggcggcggcggcggtgattcttggctcgatttgggggaggagagagaggggggaaaggtggtggagagagagagatagaaagagaggaggtgagggggattagtggagagtgggagtgtagtggagagtgaattaattgctggggtttaaggggtggaggcggtagtacgcggtggattgtaaagacgggagagcagctcgaggccgggaacggacggatgttcctcctctgcttgcggcgccatttc

SEQ ID NO: 7091 - DNA, 1501 bp, Oryza sativa
tgtcgtgcaagtggtctagtctcttgagttggcctttggtcactagtgtttcatcaatcggatagggtatgtttggttcaaggttatggttggatgtaatatagccatctatattttagaggatgaagctaagttttttttaggatgggataagcttatttgattggtaggatgaggatggattggatgaaagcaataaacttaattataatatcttcctcgaaaaaatgcccgtgtgttgcaacgggaagaaaagatgagaaaattgaggagaatttgagaaagatttacattatgtaattaaattaaatacacatttcctggaatacttgattttttaagtaggtaggtgtttaaattaatttaaaagtaaagtaagtgtggaaataaaatgatatagctaaatttaatttttaatgaagttctccatgattaattacactctctggaattttcttgaaattttcagatctcaattgctaactttaataatacaaacatcatttaagaatttattttaaaaaaatctaaataaaaactctccattctctctacgccaatttcatcccgtttccttcctcggcctgcagcctagccggcccacttttctcccttctcctcccctcttcctcggcccgcaagtacgcatccggcccagcaaagcactacaagtctaatcagcctccctcgctccttcttttactgtcatgtgggccagtgctaccgggtcgtctcctacctccgtccgtattgccgcatctgcccgatgacgcctgaatccgcctcctccgtgaaatcagtccacatccatggagataattagaaattgagtgaggggttttgatccttatcttctcccctttctgttttcccaagaatcaaaacaaaaccacgtcgtatagatgttggaagagaaaccctagctttatagttcgagtctgtttctcttcaaatctgcgcatgcacgtgctgagatggagggaatcggacggacgaaaaaagtgtgactaaagggaaaatacgaatattttagttaggtacagatatagaagtgctataataatagtaagtcatacaattaataatacaaattagcacttgtttacactagttttatcgtgctaattactaatcaatatcaaacatgtttaatatcattaatcataatttaacctacttagtaatcatacactaattagtattctagacaaggtggattatagattgccaaaaggcctgaggctagacaacctggcccaggcatggcatggcctggcccaacctttgggctgtgcttgggcctctgcctcagcatggtggaccatcccgatacgacatgttccaatgattagggaggcaaaatagatgagggagagaaatagacttattttagccatataaggcacagcccaaagagataaagaatgcaaaatagacttattccagccatataagacacggcccaaagatatgagggacataaaatagacttattccaagg

SEQ ID NO: 7092 - DNA, 171 bp, Oryza sativa
tacgggatcattgtttactatagtctatttatttatagtgattgctttagtgtttgatcggcactagagtagttattaattgcgtagatgcggtgtctagataattaatctgcagttgttgctgcgtatcccatagtacgtttgaggtaggtgtagaggtggtgacagccc

SEQ ID NO: 7093 - DNA, 1501 bp, Oryza sativa
atgtttggcacatacttgccctttttgacatgttgaggaaaattgctgactttgtaaagatgcacacaacaaatttaatttgtgagcatatggactattccttatcagaaagtttgctttgctaatctagcatatactcccaagtatatgaaaaatttggtaagataaatttcatatttttacaagctttactccctaagatttctcatcaataactaaatggaaagctttcccatttaatcatctgaaattcttacctaattaggagctaaaactcaagcaagtaaagaagtgtcgtcaggacaatctcattttgtcatctctcatttagagcaggtacaatagcatactataagccagttataaatatttttttaagaagataaaagaggagagataatagcagcaggctacagatttatagcccattgcagcacggattccaagacgcaggtgggaccagatattgattgtgtagcatatgtttatagataactattgtataaattagctattaagttgattatagatgatttgaagccagcagttggctatactattaaacttgctcttagacgacaaaaagcctaaaatgactggtggaatcttcttttgagaccatatatacacccaagggacaaaaatagtaagacaatctagagaacattttaatacgattgttgccgtgactttgtaaccccaagtttagtgttttagttgcctttatcaatgatattgcgtgcgttgaacacatgccagtaataacagccgtctctccttttcagattaaaaaaaagaagtgtacacccttctttctccatggtcgtcaaaggcttttcaaaactctttttttttttctaaacaaatatgctcccttcgttcttaaaataattggcactattaactactgctatatcatttttaacttttactgtagatgactagattataataaataaaagatttatgattatattcgtaatgctacataatttgatatgatatgtttttatattttatttgtcaaaagataggttattaaagttttaaaactgaatatatcgtgaagtgagcgtaacacaactggttagtttcttgtggtggatccagcccatattgataaacgacgtcctcactgataacgagatatccatgacgatgtgtgtggctaacccatgaactcacttatagaacaaaataagtaaccgtttattttagcctataggtaagtttgcgggttagcaacttaccactaatctgagccgtcaatctcgcatcagaaggtctccacctgtcccacgtggaccaatcacactcagccagctggccacctcccctaaccaccatcatatttaagccccaaatggccaaatcctcctcactctctgtaaaaccaagcaaacaaagaaagaaaagcatcacaaatctcacgcactgtctctcgttcgcgcaaagcacgctgcttttctccgctttgcgagcaccatagcctagcccacca

SEQ ID NO: 7094 - DNA, 1501 bp, Oryza sativa
actatgaattggttgcttccatttcccaaagaaaatgagttgccgctgtagaacaaaacagaaaataagtcctaatgatctgcaatcaatcgaattagaatcattccatttgtacaaatggtggcttaggacagcagctgtggtttcaatgttcatgtacgttctgttttgtgtataaggggatcctgcagagtcgacccttgtcttgtatctaagttttcataatgcactaccatccatgctatatttgctgtccttatgttcttttagttagttcatcacaaatattagatataatttcaactatgcttggtttagctgtttgtgacatctctgcagtttgttaaggaaaataaatgcggaccatggaaaaattcaaaatcccttatttaaataatttgtgtattaaactgacatgaatatgacacgagtgtgttttagctgaggatcttttgtcaactgtatgcatcaagcaagaattgtcctactaatattttaatacttgtttattgatgtggttaacgcgtgctataagataaccaactttataagtagtagctattatagtattgtatatataccatcttctcatttgacaatatcttttaaatattgtgcacagggttaacaaagttactttcagcgtcagagggtatttcgtacaaaaaggaactgctgttggtacaggattatcagctgtgaacactttctgtttctagaggccattctctgtaacactttggagcatcaattttgtagcgtgctatcatggactactctgctggttcctacatgtggcctggcaattcaggttctgagaactataattttgttgacggttcgtcggaatcatatgcagaagaaggaagcctaccaccttcaggctatttcatgggagctggatcagatcgcagtttaaagatcacggagaatgaaaggaaccccactatgcttgcaaatggatgcttgccatacaacacccaggctcatccattatctggccagattctacctaagggtgagctccctaacaatcttctggatcttcaacagctacagaacagcagcaatctgcgaagcaattcaattcccccaggggttcttcagtgcaattcaacatctggaacatttgatgcgaaattggatacacctggtcttgcagaactgcctcatgctttgtccagttcaattgatagcaatggtagtgacatttctgcttttcttgctgatgtgcatgccgtttcttcagccccgacgttgtgttcagcattccaaaacgtttcctccttcatggaaccagtaaatctagatgctttcggtttccaaggggcacaaaatgttgctatgttgaacaaaacaagtcttccaaatgggaatccctcgctgtttgataatgctgccatagcatcactacatgtaatgatcaccaattcaccacatatacataattgccatattatctgcttcattgaattattttttgctcttttggcaatccagg

SEQ ID NO: 7095 - DNA, 1161 bp, Oryza sativa
gactaaatattgtgtgaattgaagcatgagtttttgagtaggtcaactaatcttccggggggtccggagccggttacagtactaacttacaagcaaagtctacgcaactttcccatgaaaaaaacgtttatcagtaaagtatgcttgtctcatcctcatcaatcatcattcaaacctttgataaaagtcaaacatctttaatttaattaagtttgtagaaaaaaataatagcattttcaaccaaagacaaatatattataaaaatatatacaattaaagttttattaaaataatttgatattataaatattatactatatttatctataaactcagtcaaatttgaaaagtcaaaatatcttataatctaaaacggagggagtaaagtatttaaatgatcatattcatgcatgtcctagccctctgcctaaccactgaacccttggtttcaaaaagactttatttctatctcttaaaaattgtcaaaaagagtttgtttatccttttttccctactctcaagtctcaatccacaaatcaaagaaattttatttctcaaatattccattcctagcatttttcaatactactttatcattaataagataagtagtggataactttgtgagacggcgagtagtaataacttttatagtactttatcatctaatagttacaaataaaatctttgtgagacggcgagtagtaataactttgttagttccgtatacctaagggatgaaaacaacgatggaaattcttgatcggccaagtatcatttccataggagtgataatattttttttgaccattttcgattctagctagtatacataggatttcacttctaatttctattattagggttgtcattagatagtatgataaatatgtaaagaaaaatcccgagcaaaccgagaaccgtttcgttagaagtgatataatttccgactaaatctaatctgcctctggcatgtgggcatcgattgctcatcacttcatcagtgtgctgctatctgcttagatgaaagctttgcttgggcttcgttttgattgtttgacatgccattttgaatgggcctttttgggcctccagtatgcacagttaaaaattgggtaatttcctttcatatgggccagccctgccatgcagcttatcacc

SEQ ID NO: 7096 - DNA, 753 bp, Oryza sativa
cgccgtcgccgttcgtcgttgcgcgtgtcggaggagccggcacgagcaaggacgtggaaggggacttcggccgcgccctctccttcctcttccccggcccaaggccggagagatttctcccgcgccgtcggcctctcgtcacagcgcccctcctcacctcggtgatgcctccctccgttcttcctccttgctccatctcccccccttagtttttggtggtagcacgagtagcctccccgtagctagccggcgccgccccaaccgttgccgtcgcccgccgtgtgctcgccgccgtcgccgctcgagctccgtagcacccgctcgtcgccagcctcgctcggcgtagctccgcccaatccaacgctagcatcggattcccgtggccgcgtaggtgctctcaccgccgagaatcggcccctcgtgacctcgtcgctgtttccctcttccctccccgccggttgccgacgccgcgattcgccgccgtcaagcttcctccagcgaatccgagccgttggctcgtctcccctcgtctcgtgcaaccacccggtgtgctcgttttcgccggtatcgccgtggtccgctccgccgctcgccgctgttgtccgccgtccgttccggccggcgtcgtcgtctacctcccgccagcccacgtggcagccacgtagacgccacatcagcgccagctcagccgaggtcgggacgggccgaccccggtcagcccctccagtgcgcgcgttccaccgcgagccgtga

SEQ ID NO: 7097 - DNA, 1385 bp, Oryza sativa
agggtttaactttttcgatttggaattaaaaatcatatctcattggtttaccgaaatccgaaaaaaactagtaaaaaccgatgggttttagtcaacgccgtacgaaaaccgactaatattgacgggttttcataaactaacacctagcgggttcgtgaaaaccccccatggaatcatggaggtagcccatacatggtgatcattggcagtggcccctgcagctgcaggaaatgaatgataactgggacagtttttgttgcgtccgtgcggatcgcagcgtttcttcttcttccacctcctcccatctcccccactgacccacgcaccaatggcgccacaggtccacgtacccaaccactcctctcaaattaatctccaatcatccgagctcgacgcatccatggcttggtcctacatggagtgaatgcgagatgcgcccaagctagccattgaagacgtcgctgagctaagccatatacacttaagaggagcacttcagggattcaggctgaccatggcatgcatgcgtggcgactaatggatgaactgatcattcattcattcattcattcattcattcagcatagcggatagctgagcttgtgctcagcacggcaaaatgaattgtgtttcagattcagcccccagttcatcatcgttcatcacatattcacacgcacgccaccctggcttcacccattactctctgacaggatagtagatcaatcgatttactacaccgatataaaaactgacagactgttaggctattcccaacccaagacactagatatagtttccataaacttcacatcatcaagaaactagtactagacactactcttccaatgcaaacactactatttcatacttaaatttaatgctacttatctcacatgatgtcttggatgttgtgtagaaatcaagtctcatgcaagacatggttttcttctcttttctcatttattcacttgccacatcagtttttatcctaggtggcaacttatttaatgctatggacaccatcctagtcattgggttgggaatggccttagtgcttcattttgtgtcctaaaatctgcatgctttcaatcgtccaatgaaaaaaaaaagatattcagtattactacgtaccaaaatataacaatttaaaacatgatgggagacatcctaatattgctaatctagacagacgaatgtttagatttataatactaaaacgtgtcctgtcaaatcttatattgctatattttataacgaagggaatatatttttaactagacaggaaaattttcactcgattttattggcttgattagcagaacattgacaagcaagatgagattccaagtgcagaaatctcaatcccccaaacactggtaaga

SEQ ID NO: 7098 - DNA, 1229 bp, Oryza sativa
ttttgccgatcgatacaacgacacgagagagacgagtgaaaagaaaacggtaatacacactctattccagaaaaaaaaaataacttttgaaaataattctagataaattcataaattatactaccagtattattaagggtaaattgagataaattagtaatttacttttataattagaagttactttgtcatttaagttttttcacagctaaatcgatcattgatagtctattacactagtatcgctcatatttcatcaaaaaaggcaaaaaaaaaagtttattcactgctaaatgatgattatacccttcgcatctattttttctaacaataatgcccctccatatttctactaccactaactagggttgtagtataaataaatctaaaccctttgattaaataagatgtttaaattaatttttattataacttgagagcacctcagtgaggctcataaataaatgtttgttcggattcatttttaaaagttagtttatttttaaaccaagggagtaagtcggtgtagctactgctgcctcttttccgttccctgcgtgcatgatgattaatttgtttgtttgttcggggtttggtgcagcgtcagtgtcatcctcagatatgacgatgtttttcaggctctctgatcttatgctagctgatcgaatgatgattgtattattaagggagtggttagttgtgcattggtaattatagccttgcacttatttgtgtcagtggcaggtgccggctggatataacaacggccatctaatcccttggctccggtcatgcacctgcaggtttggggtttggacagatcgatcggaatatcggatgcagggagggcataagcatgtgattccaggcttccagctacgatgctgtactgtactgttccgttttttctttcagaaaacaaaattttgctgtactgttctgcatgcagactgtcacaagatctgagctagagctggactgcttcagagttcgattttcctatttgtggtcctctggagagttggacggtccattagtgtatctagaatgggctgggctgtgaagtgatgattcaacagtagagatggccccttcttatgggccaaatttgatcgcccatttttcttttttgtcaaatctttttttttcttttgaaccgaactttgttgttaaatctgacagactgttcattagggaatcatgcattctccatcatgaagttacaagta

SEQ ID NO: 7099 - DNA, 1501 bp, Oryza sativa
ggattcgtagccatcacaaaagatcagcgaaaaggctatcacgcgaggggtcgcgcgcatcgtgcgagcgatcaaccatctttccttcgttttctctttttgagcctgttttatggtttcctttttttccaacgtatgggttgcgcgctcacactttgagtctatctgggtcatctttgggctgaataccgttgttttttttaattgaatctgaaatttttattgttagaaagtggcatgtttcttgtgaaagtttctatatcatcaaaatttaaaagtttaaatatttatagaaattttgtatatagaaagtttatacatgaaaaaattatctacatagaaggtatatatacatataggaaaatatatcgatatagaacaaagtatctacaaagaaagtttgtacatagaaaaaagttgaatgggaagtttgtatattaatgaaaagtttgtacattgatatttgagtacttcgtatatgattttttggacgggctaaagatctgcttgttgggctcatggcctggaaaggaggaattgcttgttgggctcatgcttggaaaggaaagaaagtgcacgtggaaggaagattaggttgggtgggctggcttggcgcgggtggaggtggagcgatcgcgttcgcctccggtgcccgattgatcgcctatcggaaattcggaattgcttattggaaggatatgggatacgtcgttgcgacttgcgagtcgaaattgctaatcggcgcaggcgcagacgcactagataaataagtagcgcgcgtttctgttttggcccatcattagccaggcctaaggcccaaccacacttttgacttttttgtttttctttctgaaagcgccgacgcatgcatgtgcaggaatttttttcttcctgaaagcgccgatgcatgcatgtgctagtatagataggaattaacgcgaaggggcagtcgggcaagtgaggcaaatcaatctacagcttaattaacgctataattcttcattattagttctaatttttgattaggtgtcgtgattaacatgagtactcatatctgaaaactttcaacccgttttttaaaactttaaactcaaatttgaaaattttaactcgaaattttgaaactttcaacctaaattttgaaactttcaactcaaattttcgaaaactttcatctaaaattttaaaactttcaactcaaattttgaaaactttcaacttaaaattgaaaactttcaaatcaattatttaaaactttcaacctaaattttaaaactttcaattcaaattttcaaaaactttcaactaaaaattaaaaactttcatccgaattttcaaaactttcaaatccaaaattgaaaactttcaactccaaattttttttaaaaaaaaatcaattcctattctagaactttcaagtccaaagttcaaaacttttagtttcaaatttcaaaagtttcgactccgaatctaaaatttaaatcttcatgttagctagtac

SEQ ID NO: 7100 - DNA, 1108 bp, Oryza sativa
tgcaggaaggcgtacaggaggttgatatgctgctccactgccggtgaattgggttccaggtcgcaagcagctggccgaggacgacgccagccaagccctgccccgtctgcactgcagcctctctctcccgttttgttgaattgatcaagcaggaacaagtgacgagaccgctcccgatttcacgcaccgatcctcgtggcgcgcccgccgccggcaacaatcccgaacgggggaccactcactcgcaacctccattccttcacgtttacgtttacaccgtagcagcacgtaccgcaaatgccaagcaggccaaccaaagagatggctcggactaaactgtaatgtacttccttcgttcattaaaaaaaaactaacttccacacgtaaaattagatagatactcatccagatttattttcagaaattgattattttcagagtaactacgaatcatcacttgaacaacgtcacgtatggctcgacaattaatgggaggttttagccggattccggggagcaaatcctaccacatgttgaggggcaaatctcgcaaataccgcgcgacggcatgggcgatgatggacgatcgacgccgcagccggccaaaatcatgtcgagcccgagtccgaacccaatgggtcgcactgcacacggtcccccacacgggcgggtgggatggagaccggaggcgaaggggaacgagactgtgggtggggggggggccactagtcagcgacggtgaaatatatcatgaacagcgcggagaggtccatcgcctcgtcacccaacgatgctattccgagctttaacctcgagttaatgacgaccccccaggcgtccacgtcacgtccttgtccgtcattagtacacctttttcatgtcactgtggccaagtggccaacctgatcgatgccaaacaagtatccatccaatccaacagtactaatgttgcaatttgtggtgtctccctccagaaaaatcccacgtaaacctagagacctatccggaagaagccaaacgaaaaataatttataaataaaacttttatatatatatatatatatatatatatatatatatatatatatatatatatatatatatatga

SEQ ID NO: 7101 - DNA, 814 bp, Oryza sativa
atatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataattaggtatatactcacaatttaaaaattttgaaaaatttgagtgattttgtgcattagataccatggtgcccgggcaccatggtgccccatatgagtgtcatatatatatatatatatatatatatatatatatatatatatatatatatatatatatataaaagttttatttataaattatttttcgtttggcttcttccggataggtctctaggtttacgtgggatttttctggagggagacaccacaaattgcaacattagtactgttggattggatggatacttgtttggcatcgatcaggttggccacttggccacagtgacatgaaaaaggtgtactaatgacggacaaggacgtgacgtggacgcctggggggtcgtcattaactcgaggttaaagctcggaatagcatcgttgggtgacgaggcgatggacctctccgcgctgttcatgatatatttcaccgtcgctgactagtggccccccccccacccacagt

SEQ ID NO: 7102 - DNA, 267 bp, Oryza sativa
tgacatggagcttcagccaatcaagcctaagttcgttttctttgttttctggggatagcttttcattttgacatgctatatatatatatatatagagagagagagagaaaaaacatcatttagcagttcgggaaatatgcacataaaaaatgagagaatataagttggaaaatggaactttttttttagaaaaaacaaagctttgtttttttaattttaggacgagagcaatatatacttcatcagtggtatttggttttttataga

SEQ ID NO: 7103 - DNA, 1501 bp, Oryza sativa
aagtaataataataaacggaaccactgttgtaggtgtccaagctccagttgtgatggttagacattgcatcttgccttgtatccttgtagacatatataaatactagtatatatgcgtataaggatatggcagactgtcaaaaaaaaaatgtatatatatatatatttgggtcgtgacagttggagtggtatcagagccaggttccatattagaattagattattatttgacaataatataaattgaaaaaggagataaaattaatgcatattaagacaggagaccttaatgcatgggtagttgtcgtctagttgaactggtacagtaaaatgtgagactctataggttgatagtttctaggtctggtcatatatagccttaggtcaggatgatacatgtcagctttctacggtaaataatataaattgtttgtatgattgtttttccaggtatgacgcagtacattgaggttcctgctaaagtctttttagaagagtttgtacgcatgcttgaccttggtccactgactattactgggaggcatatatatagttccactggactgcatgttgtaggggtgcaggttaaccttggtccggctgatcgtgttccctacctttattatgaggcagctaagaccacagtagctgaagctgagcaaactgcttcactcatggctatacacgccttagcagcagagcgccaaattgagataagggatgtcaattaccctcaggtgcagcatctgcgccatcaggtggcgcgcttgcgtggtagggtggtggaggctgagaagctctgtgcagaactgctgactattgttcgctctagtgagaatgaagttatgtttctggagcgcctcacccatcgcctgtaccaccgcgtccgctacctgagtgaaaccattactgttctacagcgtgggggtgggggtagtgacagctctagtggcagtgtgtgagatgtaggagtggtgtcagtatgggttttgttttcccttggcatgggatgtactccactataataagtcttgtagcgtcagtagcatgtgtggatgggctacgagacaaccaaaggagcttttagaactcagaaccatagtataaaaaaccggaccggcgggtgacccggccgacctctcggttcagcggtccgccggtctgaccggtgacccggacgatcgaaccacgattctcaatatacaagtacactacatatttgctcatgatcacatgctgtcggatagtctgatggctagcgcttggcactttcagctagcggacctgggttcgattcccactaggtgcaccaattcttcatatttttgccaaaataacccccagctgcaccatatgggccgttagacagcccattagtatggctaccggtccaactagtgccggtttaatgtccggttcgcccaaaaaccgcccggttcagccggctcagagcggttcaattgctaattcgtttcaaaataattcaatgtaatctaattct

SEQ ID NO: 7104 - DNA, 268 bp, Oryza sativa
ttacactattgttttataaatgaataatcaaatgttattctaaaagttaacaacattatctattttttttaaaaaaaacggaggtattagtagttagcacctccgttataaataacgacacatcatgcatcacttgcaatctccagccacaaaaaaaaaaaaaaatcgacctcttctcgcaagcacttgcgccaatcacagctcacaagtcgcaagacaaaagccccaaatcatctcactgttgccatggaactctccccaatctcag

SEQ ID NO: 7105 - DNA, 862 bp, Oryza sativa
agagctgtgatgtgggaggcatcttatcgagattgctaaggggcgatcgatcgcccctagcgatcagggttcggtccctcctccctccacctggtttcttttttggtaccgcattactttcctattttagtaaatttgtgcaccaaaagtttgtacacctcaagtttacacatctaaagtttagagacccaaagtttataagtcaaaagtttatatatccgattcaaatttgaatttaaattgaaatatttttatatatagtatttctatacatctaaagtttatagacccaaagtttataagtcaaaagtttacatatctgttttaaatttgaatttaaatttaaatattttctatatatagtatttctatacacctaaagtttatagacccaaagtttataagtcaaaagtttacatacccgattcaaatttgaatttgaattcaaatattagtttatagacccaaagttctataagtccaaaagtgctgcataccctagtttcaaatctatgaatttacaattccaatttttgtatatatagtatttctatacataaatttttccaacttttattttttttaaaaaaaaatttatagtgtactgtaataggaagagaagaagggaaggaggaaggagtgtatagccgtataggggggaggggcgggcgccgcccattagctttacctgcatcttatccccttagagcaggtacaataaccggcggtactgcttccacataagattttgtgatgatctggaggagagaggggaagagagagagagagagagagtgagccgacgactaatttgtcgccggactgcacgtgccggtcgaggagttcgtggggctcgcctaga

SEQ ID NO: 7106 - DNA, 1501 bp, Oryza sativa
aaattcgaatcctccacttcttgcgcaccttagtacctgaacagtacactcatgtaaggtgtatatatatgatatatcgaattagtacaattgatttatctgttaactgcgagcttaagcataatttaagctttttagagatgaacatgctacgtactccatgcaacttaattatcgcgatgtacagtttagaaatacttctactgttctatgactacaagtaaatttttacatgacaaactgcacgcacacatcctatttcgtataatgattcaattttaacacacttatatatatgctcctctaaatatctctaatagtaaatctggcaccccatcatgacaggtaggagcaccgtacttcatccactttcacactaactagtaatcaattaccacgcctaacaacaataatataaatacctaatggataaagcaggaggatgcagagcagatagcagccagaatagcatgggtagattagtgtttgtatggctgtgtgctacgagcaattatactactctgaacttctttgccgttagtagtaaacaataacatgaacagccgcctgaacttctttgccgttagttgtgacacgtttggctaaccgaataattaagtcaccagttcttgtcttgtctacctatatgatgaaatttagtcttattttaccctgcaagctagtagggtccaaatccgtgagacactttgatattgttgaaacctgtcatgatctaaaagataattcctccaagatttgtgttgtactgtctaagccaaaacgacgtccagttggtcctatgtagggcttgaatatgtgttggtatatctgccctcagagtccacctccaataattaggagatagacattatggaaaattttgtttataaataagaaaaagtttatttggcatattatcaagaaaaaggaaaatgatgatatttaccgtagtttcccatgcatgaaaaaaactcaaacaattatataattaacctaatagatcgcaaatgagcaacggaagaagattgataagtcacacccctctcgaattaacatgcctgcataccgatctaaaaaaaattatccctactacaaagtacgaaaatatgtactggaaacgtataaactaccggctatatgataaaaatgaacatatgatatttgtccacctcaccatatgtaaaactttacccctagtaaaactttaattttactcatggtcatgtggacaaattaatctcagacgtgtatttttatcttatggtagtagtttttatgtttctactatataatttccgttgttaaagggtagtatcgttgctctgtactttgtacttggaggggctaaactaatcttggataaaaatattaaagcaagcatacaacaactcgatctgtcatgggattaataacaacttaacctattagccgatggataccgaattgtaattaatatatacttcatcattaattcacaactggtacatcgtaccatttgaat

SEQ ID NO: 7107 - DNA, 1501 bp, Oryza sativa
ataaacaaaattttccataatgtctatctcctaattattggaggtggactctgagggcagatataccaacacatattcaagccctacataggaccaactggacgtcgttttggcttagacagtacaacacaaatcttggaggaattatcttttagatcatgacaggtttcaacaatatcaaagtgtctcacggatttggaccctactagcttgcagggtaaaataagactaaatttcatcatataggtagacaagacaagaactggtgacttaattattcggttagccaaacgtgtcacaactaacggcaaagaagttcaggcggctgttcatgttattgtttactactaacggcaaagaagttcagagtagtataattgctcgtagcacacagccatacaaacactaatctacccatgctattctggctgctatctgctctgcatcctcctgctttatccattaggtatttatattattgttgttaggcgtggtaattgattactagttagtgtgaaagtggatgaagtacggtgctcctacctgtcatgatggggtgccagatttactattagagatatttagaggagcatatatataagtgtgttaaaattgaatcattatacgaaataggatgtgtgcgtgcagtttgtcatgtaaaaatttacttgtagtcatagaacagtagaagtatttctaaactgtacatcgcgataattaagttgcatggagtacgtagcatgttcatctctaaaaagcttaaattatgcttaagctcgcagttaacagataaatcaattgtactaattcgatatatcatatatatacaccttacatgagtgtactgttcaggtactaaggtgcgcaagaagtggaggattcgaatttatttcaaggtaaacggatcagcggtccacttaaagtcttttattgaactaagccaatagatggatggaatggtcagttatgtacatcttgtcgaaacaaaatactccctccgtatatgaaaaaaacgtcgttctagccataacctcgtttgcgatttaaacgacgttctgaaccgcagcaggctatgtggacggaattacccttgtctgttcgatagccgctcccgcaattaatccgcagcacgcccgcgctcgcctcgtttaattccttaagcgtcgcatgcaggcatgcagcacgccgctcaacctcgccgctcacgctcgccgccgccgcttgcgtcgcgctcgccggccctgctcttgtcgctctcgccgccgccgccgccgccgctttcgtcgcgctcgccggccgcactctcgtcacgctcgccgccgctgctctcgtcgcactcgccaccgccgccgcttgcgtcgtgctcgccggccccgctctcgtcgcttacgtcgcgctcaccggccgtgctctctcacgctcgacaccgccgccgccgctcgcattgtgctcaagatgcttgacgagaagcgcgaacgtgagctcactcccaggaaggatg

SEQ ID NO: 7108 - DNA, 1501 bp, Oryza sativa
  unsure (1)..(1501): unsure at all n locations
tttccatccatacaaagaaaaccccaattcagtattaccttcaatgtttaagtagttttgtgattttaccaaatagaattgctaaaagttttttttgtttggattctatctatttctgtgtcatcagatgcacaccgagcgtaaataaaatcacgcatgggggcgggtgattaaactcatgaccatgcctaccaagggagcaaaattacccagatttcataataattacatgcaagttgcatataagttataaaatttagtttaaaatataattacactatatttgcactataacgttatatttaatatatttccacccaaaaagttatcgcagcacttttagagtggtctttactataagtcatcgggatcgagtgacaccaatgttaattgttaattgttagcctgtcaatatagatccacccctaaacataagaccaaacttgccaagaatatatctcgttttaacacactcttaatagccgcgacttatggtatactgacaaacctcacaaaattcttactgaaagcaaatcctccatgtgcgtgtgtacactaggatttaaactagatactgtgtacccaacgccacggctaccccaacgatgttatcccctcactatactaatgttattctgggaccacctaactttctgcaaatatgaataatagacatccaaatttaactcanaattaaatcttcaatatttattttgcaactaaacccttgttcattgaacgcagcaacagagaaatctacggatcttaccattctatttctctgtgaactaattgcccagtacatgtctataaataacatcactcacctgcatgcgtccactcatccagcaactgtttctctgtgtaccgtttctctcgccgattgtgtaccgattcaattcaaaatatcgaaaacaacgcaccatttttcgtaaatcataattagtgctagctaagtcaatcctgcaagcctatatatattcgcttctctgcataattagctgaatcgtcttcgttagcagtgagagtgacagacgacacatagaaggttttcatggagaaagtactggtgctctccttgatatgtatttcactctgccaaggtcagctggtttgtaaattatgttggttttagtcgaattcctgatttaatgttttcaaaatgtgcatggtcttttcctcaaaaaaaatgcgcatggttttcttgttcgtttttgcatttgttttgatcacataatttcatcttgaaatgtcgttgaagattaatgtatctattcttgatgtaggatgggtggtgcaatctttagaatatgatcatacagcaagtattgaggcaagtgattttgtttaattgttctctttgtatatatcgctcttttctcaaacagatgccatatgtgagattattggcaaaatgtgcaaatctctgactttgttaaacgtttttatctccgtctcgtctcacagattttaaattgcaaatcgatagttggtattctcg

SEQ ID NO: 7109 - DNA, 1501 bp, Oryza sativa
atttgaattcaaatattagtttatagacccaaagttctataagtccaaaagtgctgcataccctagtttcaaatctatgaatttacaattccaatttttgtatatatagtatttctatacataaatttttccaacttttattttttttaaaaaaaaatttatagtgtactgtaataggaagagaagaagggaaggaggaaggagtgtatagccgtataggggggaggggcgggcgccgcccattagctttacctgcatcttatccccttagagcaggtacaataaccggcggtactgcttccacataagattttgtgatgatctggaggagagaggggaagagagagagagagagagagtgagccgacgactaatttgtcgccggactgcacgtgccggtcgaggagttcgtggggctcgcctagatgcttgcgctgcctgccttcgtcgccaactcctgcggccactggaccaccgccctcagcctcgccggcgtcgacgcacggccgccgcggtctcccacatccgtcgcacggtccccgtcacccctcgcctgcacggctgacgccatctccgacgcccaccgctctcttccgcctccgccgcgcggcccggccaccgtcgtctccgacgcccaccgcacggccgccgccctcttccgcctccgccgctcggcccagccgccgccgtctccaacgcccgccgcacggccgccgccatctcctgcgtccgccgccgctattttccaccccgccgccatctctgttgctcaagaaccaaacaaagaagagaagacatgaactgatgggagaaagagagagaaagagaatgggaggtagccggtaggagaaggtggtgggtcccatgaaacaataaaatattcgtgttatagtatttttattatagacattagttatattgtttactatatatgacatggctggtttttaaagccaacaacgggctatattattgaccttgctcttagcagattctatcgaggccatagcgacaaacaaagacaaaaggtagtccgtgtgatggggcaaacttgacgccacagtggaatcaagaaaaaaaatcaagttcgctcatctttgtgtgttcgcaaaaaagacaagtccgctcacccttttgcgcattcggaaaaaaaagcaagtccgctcaccgattcggccaaccgagttggacacgttccagattcttgcccactcatcattgatcagcggggaaggcgagaggatgaaccgatgaacaccgagcaccaggggttgtatcagttgctcggccttgtctccagttccaacaccgctccgccacggcatacttttcggctgagacgaagtattcaaatttgctcgatgtgggcgcgccatgggcagcccatcaactcgtgcaaatagcttctcctgcaaatctgcaatcctatatccgacaactcgtgcccatctcatttcgctcggtgcgccaaacacagccgcagaactcacgtgaatcccga

SEQ ID NO: 7110 - DNA, 812 bp, Oryza sativa
accacatctcctctagttatcacccgtgtcgaaacgcggatgatctcgccgagaaggctaatctctgtttgcgaatcgaagaacacaaacaagaataaggtagaatacaaccaaaattgcagatgaatgattaagctcataagttgggttcttacaaaccgatctagcggcgaaaatgttcttgacagaataatctaagcaaaacccaaaccctaagggtgacggcaggtactgatatatagagtttagggtcgtgcaaccaaccattgacgcaaccctaatgggttccaacacgatacacggcccaaaggcccaaatacggtgacgcaacgccaggacagattctagacgtcaacttgcgagaaggctagttagcgatcagtcgcgcgcgcccctccccgcgcgactggacacgtgtcgcgcgcggagaggggacggcggacgcgccgcgctaagaggagagagagagagagagcaagttttccctttttttgttttttccctttttttggtttctgtttggttggtttttccttttttttctggtttctctttttaaggtgtaggaatacaaagtttgtattcgtatgtataccaagtttgtatttgtacgtatataaactttgtatacgcgtatgcaaattttgtatacgttgtgtattttctagttttttattttttaatacgtatgtatataaagtttatattcatcgtatacaaagtttgtacgtcctatataaactttgtatatgtatatatttttcatgcattaaaaatatattcatatatatatatatatatatatatgaata

SEQ ID NO: 7111 - DNA, 1501 bp, Oryza sativa
ggaaaaactacttgtttgtttagacttagactttttgacttataagttgtcttataagcgtaacaaagagggccatagtatactactcctggatcagttttgaccaattcaccatcgtaccattatttcgtggttttggagagactgaaatgaaagataaaattgatcatttttatccatttgatttgttcaaaatacacgaaaaggaaaaaatacatgaataaataactaacttagtcgtgtagtatatgcatgtcttgcaacagagctcaaattagaattatttgcgtcacatggttcgtactaaatattgaaataaaatttcttgtgttttttagatccagaagctactaagttcaatctttcaccgaagaatttatagaatggaaaaaaaatgttatgctagggtgatctgccatccaatgcttattactatttgtagaaagaaaccatgaaaaaaaaattcacaaaagagagaaaaaaaaagcttgcctcgatgcttgccgtatggtcataaggaaccgattggaccatctgacctacaaaaatcatggaggaaaatgatatgtatgtgcataaatatccataatcttttcgtaccattacaaaaaaaaacaaaatgaaatatgccaaatggtgtaactgaaaaaatgaacagagcaaaaggtaagtctgaagataacactacaagcagtgcacctctccatataaaaaaacgaatttcgtctgccccttttcatatgtgaaagtttcctccttccacatactgacatctcccaaaaaaaaatccgaggataaaaaaactaaaccaggaggggcggttggtccgtactctctctacatcatgttgcgaaaaaaactgacctctgaaggagagtagcaaaatgattccgagtttctccatgaaaaccttcatcgtgtgtcctgttaccactaatatttgtttctagctacaaatctggacagaaataaatttggatagaaatgaagtctttttggacagatggagtaagtatatacaactagctggatgccagctatttcctaacttatatgctaggatgtcagaaaaatgcccataaatagcaagacttaacttaatccagacaatcggtgtactgctaaattaccgtttcaaatcaaacggataagtatattattctacggctgtatcttcgacgagtattaattacaactactatctcgttgcctataaattcatttttctcctctggcaaaacggacctcaatcaatctatctattaaatattagtatagagatagtatatatcaatcaatcaatctatcttctatttatatactaaaagtccattaaacatcctataaacgcttccaagctgccacgtggtgctctaataaaatagagaaaatcctagaaattctagaaaaaagaaaaacattcgaccgttgattttcatttaaattggtggacctattattttgcaccattagatttatcttaggaagaaacactttccat

SEQ ID NO: 7112 - DNA, 1501 bp, Oryza sativa
cgtttcaaatcaaacggataagtatattattctacggctgtatcttcgacgagtattaattacaactactatctcgttgcctataaattcatttttctcctctggcaaaacggacctcaatcaatctatctattaaatattagtatagagatagtatatatcaatcaatcaatctatcttctatttatatactaaaagtccattaaacatcctataaacgcttccaagctgccacgtggtgctctaataaaatagagaaaatcctagaaattctagaaaaaagaaaaacattcgaccgttgattttcatttaaattggtggacctattattttgcaccattagatttatcttaggaagaaacactttccatcgttagattagattgatctaacaggactcatggtcaagcgcacctcgcccctttccgtgcgtgagacgcaccgtacacacacctcctctcctctcttttgctgcccctcccctcccctctccataattctcttttctatttgtaagaaatattttttatcaagaaatcaacagtttgatgagttcaaaataattactatagtttttaatatattttgaaagcaaacaatcagatcaagaaaatcctctcatgcacctacccactgctgtgtcaatataagcgatgcaagcaacttccatctctttgtttgatctctcacgccttaccgtgcttgtcactttgattccatgtaatagtaatagtacagaaaggctatctttgatttcacataaatttcttgaagcttatggaaaataaataaattaatttttaggcatttgggttatcaggtggttttcaagcaagggtgccctacctcttcctacgtatgtgcctcccttgcctttacacacttataagtcttaacttatacatttgatttctgatccgtttaaaacatcacattctttacgattaaatcaacaattaaaaactcagttttgaatatattttaaatcataaagatataattttgcatactaaaagtatattaaactccctacaaacgttctcaaactgccacatgacgttctacaaatgcttttaagacgtcatgtggcgctctaataagtttgaaaaaaaattataacaattctgataaaaaagaaaaaaatctaaccattaattattctttaaataggtggacccaataattttaaccattagatcttaaaaaaatcaggttcccccaccgtatgtgaccacacacgtgcgtattccttcacccttctactctcctctaggatcccaatctcctcacctatttaatttctagctaacttttcctattttctagctaatacaaaatatataaaaaataacaatagctaaatgatcatgactctcaagtcatgtgtacttttctcattttatttgattttctatgttattgataattaaatacatactccacgatccatagtgcccatatttactatataaaaattagataacttggttgttctgactac

SEQ ID NO: 7113 - DNA, 405 bp, Oryza sativa
aaccccctgtggaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccccccccgtgtggtgtggcggcatggggatgtcaaaaggaaagggatggagtttttctcgcttttggcgtagcaggcctccctttgggaggcccgtgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagca

SEQ ID NO: 7114 - DNA, 1366 bp, Oryza sativa
cccaccggtcaaacccgcctactaactccccccaccacccacctcttctcagctctcgtcccaggatggtgcagtaacacgacgaccactgtgcagtaacgttgtgtcttacgtgcagtaatggcgttaaaatatagttgaaatatagtcatgacggatctacttttgataagctctttttttctaacatcatggtgcaaacggttttaaaaaaccttacatcacttgggagatattgttcttcaaagcttgacttttttgcaatttgtctctctacaagtagtaatactatactattacttgttattacttgtctgttgtacgttactataatcacatcacgatgttactacactgcgttttactatatttttgggtagtgttactgcataaacacgtggtaacgtgtaccttccgtgcagtaacacttttacttttgtgcagtaacaagtatatggttagcatctgagacttttaacctatatatttttgtttcaattcctaatttactgtaattcaccacaatattactgtcacatcttacacatgcagtaacgctatattggatggaggagaccaattttcttgagaagagggaggaagaacggttcttgaggaggggagtacatagatgcatcttgaagtttaatcctccacatgcagtaacactataacatcatggtggaaacggttttaaaaaataatacatatcttgtgatatattgcttttcaaagattgacattttgaactttagccctccacatgcagtaacagaatgtgtaatttacgtacagtaataggggtatatatatgcagtaacatggttttaccaaatgtataaaattgttcaaaacactcctacatcaatcagacatcgctcaaagccacctacagactttacctatggcccacctatttgatcttcatctcgtaaaaatgacatagtaacactgcatttatcatgcagtaatatagctacttgaaagtggtaacatgcacctattatgtagtaacacttctacttttgtgtagtaacaagtatacggttagcatgtgaggctttaacccatatatttttgtttcaattcctagtttatgtagtaatactattcaagaaatgcaagacactttgttactgcaaagcttattgtctttactagactcttatagtaacgttgtgatagaactgtagtaacgtgtaacgtacagttgcaacaagtaattctattgtattactacttgtggagagtcaaattccaaaaagaaaagcttttaagaacaatatctctgatgtcatgtatggttttttaaaattatttgcaccatgatactagaaaaaaatgcttatcaaaagtagatccatca

SEQ ID NO: 7115 - DNA, 1501 bp, Oryza sativa
gagaagcgtaataccctactcctgtgtttttggtggatctgtgtatgaaggagctacaaagtatgaaccagcctctcccttgttctgggttccgaatctccccccgtcccctctctaagtgggcaaggtcctccttttatatctcaaggggataccacatgcaccctctctctctttccaaactggacttgccttctcttcataaatggacggagatttgtatggttgctgtccgaatgaccttctgatgggacggcacatacctacctccacttccgccggaggcaggcgcgacgtgggaacgtggctgtctgctgacgacatgaccagtgtcagactgatcacaaatcggtcattcttgtccacgatgcgtcagcttaacagtatgcatgttcgcccttcttcacacaacatcttgcctgtaatggttaggatgaagcctggcgtatatctgacggggactaacgtgccatctctgggaggtaacacgctagctctagctggggacgcgtgcctagaagctctcgtcctgacgggatggggcgaggcgtgcgtcagaccgcctgtcgccacctaacccgtgatctgaccggtctgtgactggtcatagaccggatatacgagtgcactgcactgcgttacatgcggcgtgacacgctcagccaaaccgcaataaatgcggttaggtgagccccgctgtgctcacctaacccatacacgcggagcagaacccacgaggggtcggggcgcctcggccctcggggccgaggcgggaatggtccgaccccctcggggagactaagaggagggcgaacacatcaccctcgggcccgacgtcccccgagggtgccaggccacgtgggcgattgtgtctgcctcaagcctctagtcatgatactcccggtcccatgtcgccgacagtagcccccggcgttatgccagggcgatcgccctcttcaaggggagcggtcgggcgtgacgccactcctaaggcctggtgacaggtgggaccggtctccacaattgggcagaaacccaacggtcacaaatttcgcacatcggcaatggtaactcggctgtcaataatgagcggtctcttcaagactgccacattactcgagtagtacacgaatctggatgagccgattcgctttgccaggagatatggtaacgtcgcttcggtcggcgagcgtaattaacgcgcgcacgatatgatttatctcgactgccacaaccgcatatccacctcatgcgccgcaagcgggcgaatgggattagtggaagcgagggcgcgagatacgagggggcgaaatagtgggcacgagaagcgaggagccgggcacagcgttggcaagagtataaaggcactgaggaaaggatctgcttccttcctttcgccatcattccccttgtcttcgccgcttgcaccctaactccttctttcctgtgtcctaccttcgccacacgcgctcgctctcaatcttctcttcctccggcgcca

SEQ ID NO: 7116 - DNA, 1501 bp, Oryza sativa
tcggcgcgggggaaccggatcgggcgctccccctccccccctccccccacgtgctacctactgggcccatcacttctccctcctttttttctataaaagatgttttcacctagtgtatttagaatgtttcactttttataaatttaatgttgcagtgaattaaaatattgttttgcaaaagaaaaacccacatattttggaaactctatattaagggaatttggtttattacttgttccacaaaaaatgtttcacctagtgtactcataatgtttcactatgtctaaatctaatgttgcagtgaactagacattccattgtaaaaaaaaacacatattttggaaacccctattaagggaatttggtttattttccattctaccgaaaaatgtttcacctaatgtactcataatgtttcactatgtatagatctaatattgtagtgaactgaaacattctttctttcgctatttactgaaacattgtttttatataagatgaaacaacacccgatttaaacaaatgaaacattttcgatctacttagtgaaacaattccgatatacctggtggaacatcgtgcaacatttaaaaataattcaataataagcttttttttcatcggaatatatccatgtgtggtcttgttttgaagatttaattgcaatgaatttaatggtgcaatcggataatgatttggataagtaatttaggagaaaaatcagtttaaagtagttttccacgtaaatcgggtgctgacatcaatgcccgattttgttccaatcggatcggttgcctgagccgtaggctcctcctcccatctctctctctctatatgtgtgtgtatatatatatatatatattacagtagttaatgttaatacctaaacatttaaaaaagtttcatactcattcgaattgggtatatactcaatttcaattatggtgcccgggcaccatggaacaccaaacaaatttaatatatatatatatatatatatatatatatatatatatatatatatatatatatatatatattcatattttaaaatactttcatatgatgctaatttcatatttgagggagtactttgtatatatgtatattgtgtatacgtcaatttattttggtatacataaaaaatatatatataaatacacacatatactttgtatatctacgtacaaccattgtagagtatttgtataacgtatgtacgcaactacgcgaggagactataaagagaggtgcgcacgcaacagccaaccccgtcgacttgtactagttcgttccccctaaccccacgccccgaatcccccacgcaccgggcccccgcgccggcgctctccccgccgcctggacgcgcgccggccttccgccgccgcaggtggagcctctctctctctttccgtctccgccccgcgccgccgccaactaggtctagtaacctagtttttccctttttctcccccaattctcagctagctaactgagaaga

SEQ ID NO: 7117 - DNA, 1501 bp, Oryza sativa
tcgtgtccaaaaatccctttcgacctccggtcaaacatctgacgtgacacccaaaacttttattttcgtgaactaaacacgtccgtagctgatgaaaaacggatactccataatgtcaatgtcaaaaaaaaaaaaacggatactcctggactgggaaaacattgccaaaagaggagcgaatgccagcacctgaactggagtacttcgagtcatcctctctagctacagaaatgtagtaaatgaagtttgcctccacaacgaccggcacgaatttgatcaccaaacacaaacagtcaagctcgaatttgatcaccttttgcaagacggattttattttaccttttgcatttatgagattccttccaaaacgcaggtagccatgcaaatgatgatggaagaagcaagtgcctggggagcagcaaacagccctctcttggaagtgaaagtggcagggtgtacaggcgtaggagtagttgctgggccatgccctccggtggagagagtacagccaaatctcgggtattaaatgagctggatctctaatcattcgaacctatgccaatggcctgtgcgctactcctgcaggacatgacagatgctgtgccactgccgagcaccgtataaacgcaatgtatgtatactccgtttcgggagtagtagtacttgggggtatacaaacttgggacgttcgggaaatttgaactttggtgggaaattcgggaaattcatgtttgaaaggcatttctttttccttcaatactgaccaataaaaagacatgaatattaggtaataaactaatatcatataattagaaagagtgactattcaaatccagatgaacgtttctctaataatacccgtacaatgaatagacatcgcatcctattactcctactctattactctcacttgttaccggagtatctttggcttggtcgtgaggccagtgactattgatttgccatcttttatcgtctagcataactcattttctcgcctgaagcgtcctgacgcatgtcaaaaccatggtgcttagtagtactagtatagtaaaatctcatcttttattatggccttgtttagttttaaagttttttttaaacttctagctttctatcacatcaaatctttcatacgcacataatatttcagtcacatcgtctccaattttaaccaaatttcaaactttggatcgaactaaacacagcctatagtaaaatctacaacattcatcccgtaaatctcagattttactgtacgatacttctggtactgtggtacagaagtatttttacgttaagcttctctttgacacaaaacggagcaatactaaaaagactttaaagatggattaatatacttttttaaagaaactttctaaaaaacttaccgcttagtactatgggaacatgtgcatgaaaaatgagaaatcaaagttaggaaggactaaagaaacacttacccctcgaactatcacggtcgactgaatttccccccgaa

SEQ ID NO: 7118 - DNA, 1347 bp, Oryza sativa
aattatcttactaataatgtcgttaagaaatacctacagccgaagcaagaccgcgctacagcgtgacgccgacacgcgttagtggcaagaccaatatgcgagctgaaattttgcttgtagggcgctcgaggcaaattggaatttcaaatgagagatgattcaccaattcatatttgtagtttaatcaagacatattataccaaggcatcataactagagactactaaaaaaatatatcaagattttctcccgtgtatttgtacacaaggttttgacttaaatttctaacagcaaaagaaaaaaacaaccgttatgttgtgagcacttctgtatatgtcccatcaatattttggtcagaatcattatttcttttctttgatatggtattgtgctccgaaagcctcttccgtttctttgaatcattgtcttgttccacaacaaggatttttatgtgtttttcttgcagtggctctagaaagcgcgacgcatagttgactatgagagaatactggttcgggtaggtatatgccgatgtttggtactgtttgcccttgtgccttatttatcgtcatggcaaagttaagccttacaggaaattatttccttttgaattggaatgggaacatttcatcatcagaggggcttagtgggattcgaggcaagaaaacccgtgtaccagaatgttgtcctagcacaatcactgtatcaatggtattctctgaaatcctcgcaccaccaatcttgtgccattgcaaagtccattagctaggtcgatattcctgagcaatatgatgggataattaagtttgagctttagcatgtgaggaggcaacccatttgggttcagaacgataattcgatcaatatcaggaaaattatactatcaaaatttatctataaatagtttaatatagagaaatctataagttataataatttttagtggatcaaatagtgctaaaactaataatgtaaatgaaaaaacaactgaaattagttagtaattgaaagaacttcttttagcccacatatgaaaaatctaattcattaattctgaacgcggccgacaacaacatggttgcgatagagagaaacgacagcggtgaactcttgtggtgaacacaatcgagtgagtacattgtcacaccccaatccggcaccgccgtacaacggcacctgacaggagcgtgtcgtaggaataacgacgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcaga

SEQ ID NO: 7119 - DNA, 571 bp, Oryza sativa
caccaatgccacccgatacaagtccaattcacatccctcatccctttcttttccaagggatttaataaatcttttttccttttgttccataaatcatttcccttggtcctgcacgtcagtgactatcaataatattcttgagaatattatttctataaattccataaaccattcctcgtattccagaaaattccgataaatcatttccttatctaaaaaaatccattgaccttccaaaattcctatcttctcaaccgcttgtccgattgacccccgttccacttccaataattctgtaaaattgagatatatttaatggaactattaattagtctaaatatggtctttcttttggtcttttgtttaggttttgattgtttgcatatagttgcggttaccggattttcgtcgatcgtgggttttctcgaagattcgtgaagcctcgtgaagaccttgagcaaggcaagtcaccctttgaccaattgctcctataattggaaaatcattattatcttgtttgcaacttgcattattagaatcacacacttaatttgcttggcctcggtttgcg

SEQ ID NO: 7120 - DNA, 209 bp, Oryza sativa
cctcccacccctataaataggtaggtacccctttagggtttcttgggttttatttagataaaagtttagccatttctacttccttgcggcgtgcatgtcggctagaccgtccgtcagcttgtattcgaatccccaacttatcgtgtgtattcattcctatttgtaattcagattgcttttatcttgctcttgcttgtttcttcgatttg

SEQ ID NO: 7121 - DNA, 431 bp, Oryza sativa
tcaccgctgcaagtgcaaggcactatggtttcaagttgaattttcatggcctaacaagatgcatgaaacaaaatataaatacagtgaaatccaaaaccacaagcatagtgtctattcgtcaaataaaaataaacatgcaaacgtgttgatctgtctagttcgtcgattgaaatcgcaagacacatataaccaacgtctgacccctctttccaagcaacataagctgctacttgggcttttggaaaggcccaacaagttggaaaatcacatcggagcccaaagagatcacgtcacatacgccggtaacaacacggacgtcgcataagccgtggtcgtacaaagagtcggacggcggggttgtgtgtatagcattttcggcaggcgatgaatatgcaaataattaataccatcggccaccgtgttggacgagg

SEQ ID NO: 7122 - DNA, 1071 bp, Oryza sativa
cgtcggtatcgtggtggccttcttcctggcctccaccttgccatcatcgaacaacttgccctcgacgatggcctcctccaccttggcacggagctcagccaacgccttcctctcgccgtccttgagattatccaggaagttgctctcctccctgaacgacacgttcttggacacaacggtagccagcgtcaccgcctcatccaccgacgccttcgccctcacctcctttgtctctggcgccaccacctccgctgcggcggctgtcgcaccctcagacaacgacagtggtgcgacggcggcagagcccgggcggtggcgaaggtcgggctgtagcggtgcgccggcggcggatcttgcagatgggctggacgatgacgaagacgacgggagcgtggcgttatcctctagagagaagatagagagagaagataagagagataagaaagctgacatgtgggcccaaacgcatttttgacatttcacacgatttctctctcctcttcgaccggaaattattattttaatcggcacgatgttcactggcaaattaccacgtttatggatcgttttccctcaaaagtgagtttgggcagtgttctagggctaaaaccacacataagcagtgtcctgtagcaaaatttgccttttaattttagcgtcgtgtgaaagtcgggaagtggttatatgtgccagtttttaagaaaccaacatctataagacagttcctgtcattggaagatatcacataagctacaaatatttcaaagcatgaattgcaaaacagaaaagatttacacgttccaataaaaaataatttgtagtcatcagaaaattcaatgaacagcgttgtctgcgactgggggagcgcaggttgtataatgccatagaaaattgcacattgacacagcttccctctaagaaaaaaaggtaataaatccatggtgccgcttttcattcactgttcattattgtcaacaggaaacatcccaagcaagaagctaggctctccggccttgtttagttccaaactttttctttaaatttttaacttttctattacatcaaaacttt

SEQ ID NO: 7123 - DNA, 993 bp, Oryza sativa
agttttgcatgtttctcaaaagttttttaataagacgaacggtcaaatatatttaaaaaagttaacggcgttaaatatgtagggacggagggagtatatattattcatctgttcttggttagcggcagatttactatctgttctgtcttctaatgaaacaacggctcaactccatgtgcagtcgctaactgcggcttggtgtccgttccaacgcgcgagctgaggaagacatcggcttggctcaaggaaaacgcttggctgcactaatgtgatgggacacgcgtcaggtgtgtacgcggtgttgtacaggaggcgtggtgcggcactgctgccgcagagaatttttttccgacaatctctgccccttgcaaccacggcggcggcaccgatcatcagtgacagtcctgcagcaggcgcaggcggctctcagcggcgtccggactttgcggaggcaatgcagagagcgaatcgaaggaggcagcggagtagatccggccgtggaggtcgaatcccgggcggggagcgagccggcgacgcatactcgtgcctccaaggtcaaaccctaaactcgcttagtacgtctctcggttgctgcgaaacctctccaatgcgtctcataatctccgtcctgacacctgaccggctcctaggaaatggttgaaatccggcataggtatggaaaatttcagcattccagatttccactctaatcctgtaggatggttctcatttccgaagcagtacaatagaaattttgaaaatgtgcaattctaagctcgctgatgttgaacgagatatagctagttaatcctagtcggggaagatttcaccaatgttattcgtattgtttgtagcagttatccctgcagataactctgttgatggtttgtactgtataagcccctggtttattttccagtacacagtcatgctattgatcttcctttctactgctcctttgatgaatcatgagtatgtttggttgcttccagt

SEQ ID NO: 7124 - DNA, 1501 bp, Oryza sativa
ggaattactaagtaatttcttatatatatatatatatatatatatatatatatatatatatatatttcaacaatcgagcatagggtaagtatgatgttaattattaacaacaaataaaactgatttgtcaatccatatttgaagagaaacaaatttaatagactttgtagaggattatagataatatttatgttgttgaccaagatttgtatcacaataagcggaagagaaggaaaaaagaaataaaaagctaggatttattagtagtaagcatgaaacaaactaaataatatctttgctttgatatggaatatatgaatgaatatacgttgagtattataaaaaatgatggatatatttgttgaaatattatggaaatgatgagagaggttgattggatctatttgcattttgatttgtaggattaaataaattatgtatgatgcatgtttgcatgagctatttgataagtagttattgctagtggatgatgaggtagcatgtttgcatgttgagttttagacttaagtaggatttaacttcatagaaagcatagatagaaaagttgctttaaaaagcatattagtccatttttaatttaaaataactaataattaattaattaatacactaatggcttactgcgttttgcgtatcactcttcttcttcacttttctcttctacttaaacacactctaaaagctgcttagtaagctacacgttcatgacacaacaatacaaagcttagaagcatgggcggatctagcatgagtgttcctatggaaaagaggagagatgggaggggaaagaaggaataagagtagagggagccaaaagatgaagaaaaagatgagcacttctagtttgatgctacgttcctccctgtttagaagcatgtagttttaggtgatttcaaaattaaaaatttttagatgaatgaaatgtagcaaataattaataatgtctatgtttccaaacttctgatgttggttagttcaatgtcaaatagagaaaaaacagagggagaaataaggtagaaacaaatgaatctatatataaggacggaacgtaattttaagcggttgtagaccgagctgatttttgcagttgtgtacctttttactcttttcaactatacgcaccttgtgcctcgcagcagtagaaccccttcatttccagccaatcaaaccgttccccaggcgcctcttgaacggtccacttcgcaaagccaggagagccacgaccacgaccacggccatgctcgctcccaaaactctctaatcgactggtatctcctctccacacgaacaagtcctcgtcaggcttgcctaggtctgacaacttcatggcgccgaagtccttctttcttctccgtcgacggcaacggagactcctctccatcggcaggaaattaacgtggcacgctagctgctaacaccctaaaggctaagtaagggaagaaaaattaaggggccgggtatctgcgctgttatatcgatc

SEQ ID NO: 7125 - DNA, 1501 bp, Oryza sativa
taaccattattttttattataatatgtataaaagtattaataaatatatgaatttattaaaatactttttaaaactaatcaatacatgcatgtagtcactatatttaaaagacaaatgttttaaaaatgattcataatgaaagattcaaaagtttgagctcaactttatctaaaacgacaagtattatcaatccggagggagtataagcgatctatagaagtcaccgtattagatttatgtttagatggagcaagaaaatataagagaagaaaaaacggactatacatttataagtcaactacaacattaattttaataaattatatgagagagaggtagtattaatggattagtatatatctataactaactaactattgcatgtcagaactattagattagtgatacataaatgatggggacatatccattgaaaaccatcgtgagaacccataaaaaccgggactatatgttttgtaaattcacgaaaacatttatatgtatgaaataattctcaccaaatttgaagttcaaactcaattttaattatttgggagttaaaaaagtatttcgggtgaatagtaaccataactattcacttctctgtcaattgaagtttgagtttagacttaacatctagtgcgaatatatcttatgcctatacttatctctagaattttttttactgaatttagagagcttatatgtatattttttatgggtttacacttatttgacgttttcactagttttcacttgagatttgatgtgaatattaaaaagaaaaaagacaagtgatatgtcagtatttagtgagtcctagtagttagggcctgtttagttcacaaattttttttcctaaaaacatcacctcgaatgtttaaacatatgcatggagtattaaatatggacaaaaagaaaaactaattgcacagtccgactataaatcgcgagacgaatcttttgagcctaattagtccatgattagctataagtgctatagtaacccacatgttctaatgatggattaattaggcttaaaagattcgtctcgtggtttccaggcgatttataaagttagttttcttattcgtgtccgaaaaccccttccgacatccggtcaaatgtccgatatgacacccaaaaatttttttatccccaactaaacatgcccttagctataccattgaccttcctcatggctctcacacatgcacacatattaattgccatcagatgacaaatcacgcgctaagatttattgagccccaaaatgggtaataataacaagaagggacaaattttacgatggtcttaagttaattctactcctacttataagtggaattaatttgtatcttttattttgctcttattcagcaaatcatttttatctatactagttatcatctcaactacgggtagtatgatatttcttttattagaactcataagccatgcataatgttatcgatatatgtaatatatagtactaataga

SEQ ID NO: 7126 - DNA, 1501 bp, Oryza sativa
gtcatccgccgtgcgccgccgctcggtcgcgtgccgccatcggccttccacccctttccatccccaaatcgccgccgataccgttcccgcacgccggtgagctcctcgcccaaattctcgccatctgcatcatcttggataagccccgagccattcggttgctcgctcgtccccttaaacatgccgccccgccgttgctctgcttcgccgccgccgcgcccgcctgtgagccgccgtgggccctctcgccaatacctcgcgccaccaccgtccttgagctccctaggacctccccaaaccattccctagcgccgtcgccgcccggcacagcctcgccgccattgtcgtccgctcccgaaggccgctgctcgtcgccagccctcctcagtgattctccgccccatccgacaccggaaacggattccttgaaccccggagatgctccaccccctttgaatcgaaccctcatcgtctcgtcgtgattcccccctttgctcgccagcgattgccgccgccacaatccgccggattccggccatcctccggcgaatccgagccgtcggctcgcttcgtctcgtctctccccttcccccggtgtgcttcctttttccattgaggtcgcgccttgctcctgcgaacgccgccgccgtccgccgtccatcccggccggcctcgtcttcgtccttccgccgacccgcgtggctgccgccacgtcggcgccacctcggcacgaccgagtcaacagacccggtcggcccctcccttccgtttccccctccgtgcgcgcggaccacggtgtgccatgcggctgcacgtgggcccgccgcgcctcgatccatccggtgcacccaaaaccctagcgcccgccccgcgtgcgccgcttccaccgtgcaccgtctcgccgacatatgggccccacccgggaccccgcgtggtgggctcggtccaccggaccgccccctctccctcccgcgcgccctaatgggccgcctgcttgcgcccgcgtcggcccaatggcttggccgagcctccttcgacccttgggccgcgccaatgccaccgaaacaagtctagtttacatccctccttcaattctctttccagaaaggggtttaataaattattaaatcctttctcctttgattagaaaatccttaaaccttagaaaatccatatcttcccaaccgctcatccgattgactccgctcaacctccagtaatcccgtaaaattgagatctatttaatggcactactaattagtctaaataggatctttcttttggtcctttgtttaggttttcgattgtttgcgtatagttgtggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 7127 - DNA, 1142 bp, Oryza sativa
atattgtattttgtatacgtgatatttattaattatttaaaattctaactttagttaattctaaattctattcctatatagactataaacttatcttctaatatttcttatattttccgaagtcatgttatttacaaatttatttcaatatggactctaaacccttctttccatattccttattttaatatctcgaatttcagttacttctaaattgtgtttctatataaactctactctccttttttaatatttcttatttttaattcctaatttctcttatttataaattgtatttttattatatggactctaaactcatctttcgatatttctttctttttaattttgaatttcagttatttccgaattgtatttatatatggactttagactctttttctaatattttttatttttaaatttcgaattttagttttttctaagttgtatttctatatggattctaaattctacttttaatttttcttattttttaattccgaatttcaattatatgtaaattttatatgtatttctatatgtactctaaacttaactttcaatattccttatctttaatttcgaatttccattatttctaaattgtattcgtatatggactatgttttctttttttattccaaattttagttagctttaaattgtattcctatatagactctagtctcctcttccaatattccttattttctaattccgatttcgaatttccattatttctaaattgtattcatgtatagactatgttttcctttttttattctgaattttaattagctttatattgtattcctatatggcctcagtctcttttttaatatttcttattttctaattccgaatttaaactatttttaaattgtatttctatatggactctattttttctttttctccgattaatgtgagaatttctaggctatgagagcgaacgtggagggttctttttctattcctttgataagttaatagatagattaacttcatttctgattatgaaactaaacaaacttttgtccatcctaaaatgtactagcaacatagtatttaattagatatcacctagtgctataaatctcaactaacgaaataagtattaacatcaagctaagtaccag

SEQ ID NO: 7128 - DNA, 498 bp, Oryza sativa
cataatgttcgttgcaaggaagaatacgcgagaagaaggaagaagacggaaaaaggaatgagttgatggaaaatgtgacggcaatggcacggttctaattttgtaaaatttcaatggtatagctataaatagacaaattgtaatggcatttttctgataggcaaatttgcaatggcatgatccaattaaccctatattttttgtgctcttggaattgtaatgccaccgggcatgacagtgttgaccccggtaaagaaatcacaactacacaactacataattgattttcgtggacgaggccaacctccagcctctaggctgaccataacatcatccacttgcgataatatcgatcccgaaggaaaacaagatccacatgcaaaaaatcaattttctcatgcgagccaacttaataggccctccagcgaaaataacttatttcacaagcgggcctgttaagtggcatgcctatgccactagcccaccaggccgacgact

SEQ ID NO: 7129 - DNA, 1501 bp, Oryza sativa
agctctctactatataattagccaagccatcatggagagagatcaaaatctctgccaaatttatttcttccttcccaaatgaggggtgcagtccaccccccctccaccccatgtggtacaatgtgcagtggcagtcccccatcaaggcaagcaagcaaccatagtgatcaatatgctagctgcacatatacctctctctctctctctctctctctctctctctcttagctagctagcaacaaacaagggagctagggttttcttggctctgttgccataagcagcaagtgtaccctgtccctggagagctcctcatggccatggccaacctaacaaacctagctgccaagatcggcaaggaggaggaaaccgggtgggcccacactgtcagagggtggttacaagtccacacacatgttgctttccatggtgccttgtgaggggcatgcagagagttgctatagctacatacaccttcctcgcaattgcatgtagtgttcatgattttataccatgcccatgtatatatagctgcactgtgctctgatgagtaatactgttgcattatattgcatgagctacatacactgatatctctgaacttttgtgtgcgtgatatatgcactgttgcagtgtgtgttttgtgtcacaagctaggctcgtgtatttgtgcagagatcgaccagagagtatatgctagtgcatcatcattgcatgctgcaagtacacacatggatatgcacactgatctgatcatcatcatcatgaagtcatgcttatgtctgcatccgtttcttgctttgactcactatctgatcctaattacacactgatgcaggggtaaatgtaaaactagactagctagcatattagttacagttaaaaatgtagtttgttgctttctggatatttactactccctccatctacttttgatttgatttggagtagtacactgatttgatttgcaggagtagtagtgtgagagtgtgtgacagagagaaagcattgtgtgttgcacattactacaagctctctctcctatatatgtctctccttctgcacctcctgccttagcctttgaagcaagcttagcacttcacaaggtatgtacatagcacattactactcctgccctatctatctaccctgttcatgagtaattcaagaaaaaaaaaaggacaccttttctagctagttcttcatcctttcgcagcaaagagtttttacatctctagctactagttgttctcttctctacatgaaattttttctacttctgattgcaccctttacatagctgtggggggaaatccaatttgagcacccatgccttatgttgattttaacaaaattcgtccatgtatcgatatgttcataacttggccatttctgttcttcttcttcttctcttcttcttcagtttcctcttgtgcagaagaaggagaaacaaaagaacacagaaattaaattaaactcgatcaggaaggtatagcaggca

SEQ ID NO: 7130 - DNA, 1501 bp, Oryza sativa
aaaccgttgtctgcctggaaatttcttgaaaaactttacgcagttttatttctctctcaaaaaaggggaaaaacaaaaaaacaaaaacggtttgcgagatgggatcagatgcgtgggtgggcacggtgaggctgccacggcggtgcgtgatggggggatctcatcgcatcggtggcgcggcgcgacaagcagcggcccatgacgactgtggcgtccgccgtggctgcatgcgccgcttgtgcgtggacacagtaaattcctaactagtgaaactcaacgtcatgtatcttatcgttagagttttttttaaaaaaaaaaaacggaaggagaaggtcctgactgctgaggctcaccatccatcatgggtccacgtgtcagttactcatttttctccgaagcatgagcggcactaatccatggtattgctgttggaccacacgctgcccaccgttttcgacttttctggaaccaagaaaccaatctgcatggagtttccagcgtttagcaacgtactacggacgatgacctgcttaccattactccgagttactgctacctagtgccccagtccaggcataaacccacatagtttgtgtgctgaatttgtttcaatttagggcctgtttagttcccaaaaagttttttccaaaaacatcacatcgaatctttagacacatatatgaaacattaaatatagaatttttttaaaaagctaattacacagttaggacggaaatcgcgagacgaatcttttgagtctaattagtccatgattagccataagtgttacagtaatccacatgcgctaatgacggattaattagggtcaaaaaattcgtctcgcggtttccaggtgagttatgaaattagtttttttattcgtgtccaaaaaccccttttaacattcggtcaaacgtccaatgtggcaccctaaaattttcttttcgcgaactaaacagcccttacaaatagaaccaaatttggcacttgttcaaactagtggagtactaggacaccagtatctttggacatctttgaaatcatgatttgtaattttgtatggttttaatatggtcacagtctcacagacacacattttatttgacttaaccttggacctataaataaacacatctcacctcacctcacctcacctaccaagaaagccagccagcacacactctcactctctcactactccactctgccaccgctcagcggcaagccggcaatggcggatgggcgaggtggcgtcggcggccagccgccgtcgtcggtggcggcggcggcggtggtggcgcggcggtgcggctgcggtctgggcaggctggtgcggcgcctccggcgtcaggcggcgctgtgcgcggagcgtccggcgccggcgtcgagccggctccgcggtggccggtgccagtacgacccgctcagctacgcgcgcaacttcgaccgcggcggagtctacgtcgccggcgggctggacgacgactccgacgccgcgcag

SEQ ID NO: 7131 - DNA, 1051 bp, Oryza sativa
tacagtagttcatgcaaaaaaagttttttttctaataaaagggtagtatatttttttgctgctggtatggataatgcctatgctgcatgaatcttaatttgcgtacgcgtgtggcattatcttaagggcctgtttggcatagctccagctccagctccacccctcctggagctggagctcagccaaacagtttcagctccaccaaaactaggagtgaagttgggtggagctctctcacaaaatgtactagagttgtggagctgggtttcggcaactccataactccactccagactcaactcctggagttatatttaggagttggagctgtaccaaacaggccctaagattcatgcgagcttaatttcactttcgatcttaattattttacctggttcatttgatgatttgcttactgaatgtctcgggtatttagttccaagagaacatctcagttctattggtaaccttcaagtaaactgatatgctcttttccaccattttgcaggttaaggatagaccgcatgaggctcaaagggcacgccagatagatatttttcagttttgtcctcttgcaactcctgcacctctctactcactatagtagcagtgaccacacaagcttacctgagcttgagagctcagcattatcttctcagtcttgttctcccttcacagtttcagatttatgctctttggctgtcaagactcgagcagtctgttgccttcaccttgtgcttatgtgagttagtttctgtcttctctcaattattactagtacttgattcttcagaggtcatgtgggtttgaccaattagcacattgcagttttctgtttgatgtccatggtgaatttgtggatacaccttatggttttcaaactagtgttttggaaacaacttacatgctacgcattgaaatgtttgctttctgaatatcttgggtagaagttctcaaagaacatacaccagctctattgataaccttccagtatgctgacattccttctcccaccattttgcaggttgaggatagaggctctgttgtatta

SEQ ID NO: 7132 - DNA, 1501 bp, Oryza sativa
ttagcaccaagctcaacccaaagtgaatgagaatgaaatgggttgggtaaccctagaaaagggttaggtggggggtatttatagaccccccaaaaatgtggccgttggaggggaatctttcagcccacgtcggatagtccgatacaagatcggatagtccgatattttaaacctccaaggcaacgagaaatagagaacgaagttccatgaaatttcggacttttcgagacatcggactatctgatgttaaatcggagtatctgatattttagaagcaaaaactttgtcctcaaacagagactcaagttctatgaaatttcggagtctctgtatcatcggactatctgatccgacatcggatactccgatacttagaaaaactcactcgataggatttttttcaaatcaagatagagagtgaagttctgtgaaaaatcggatagtccgatacatcggatagtctgatttcaaatcggatagtctgatgttgctaaagtaaaactgcaataactttttactccgaactccgatttcgaagatcttggactctatggaaagctagtttcgtgggctatcaaacccaacataaaacatggtccaaaaccttcaagagatgttgaaaaacttgcaaagaaacccggtgtaagtgttgtgacaagtgaaacaactcgggattgaaattttgacttaggtttttcaactcacacaaagatgaagcattttgagcactagtattctaccaataatatgcatgtggtatccctcttaatagtacgacattcctacgacacaatgtaaggtaaaagatacaatataccatttgatcattgccgcattgcatcgtgatgtcgcattcatggggtatgcatctcattacaacatgttgaggacataacaaccttcacatttgcttgaataaaagtgttagtcctctctaatcgcattgtaatcaatcatcaaaatcattagggtcctagatgcactttcaggatttgatctgcaggggtgactatttgtaagaaatcagccactgattggaaatggatggcattgatgatttgataaaaatcttgatcaagatgtataagtggataaggggtaagtattaaccctgtgtctaataatggtattttttttaataatgaatagaaatatgatctctatatccacacagctaactaataatggcatttaggattgtgttaatatcttagtgtcttgctaactgcaggatgatccagcttatttgagacttggcatgcattccctgattaggctatgtgtgactttgttccattttacttcatcgaggtcctctgaagcagaaattgctttcgttcaggttcagctgctccttggtatctaattaacaaaagttatctacaaaaaatctaagtaagaaaaaaaaatagcaccagagcttttcaacggcgtggaaggaacacaaggcacgtttcttcgagaacgaggttaggaagttcaggactctgtcgcaagaaga

SEQ ID NO: 7133 - DNA, 338 bp, Oryza sativa
tagctttgcttaattgtgccgctatagatctagtcgctgtttgtgctttactcttgtttgtgtgatagatctacttgttgtgcttcattggtggatcggacagtctgatccaacatcagactatctgatattttcggatagtctgactgtggatcagactttccgaccttatttcagttttagcttctgcataaaattttaaattagcctattcacccccctctaggcctaattgaccctttcaaatccaaccaaatccaataactccatcccctaaaaaaaatccaataactccagagatttcagctttcaggcttttagccatggcttattgcagc

SEQ ID NO: 7134 - DNA, 437 bp, Oryza sativa
aaacagacttgacttactagcaggtcttagcttattggagaaggaaaaaatctattgaccaatacaatgcttactagctaaggaagaactactactagtactgattcagagattatatggtaacactccatgccattttacctaacctattttcaccatgtgtgcacccccctcaattcaaattcagacacccacattagcttaaacttagcagagtaaattaaacaagtggcacccccctccatctcattctagctccgcccctgggaagaagcgacatcagaggcgacgctgtgataggagagacgcacctgatgcgggtgttacgcttgtttctttgaccttgggctagtatgaaggttattgggcttttgtgggatggcctactaggctaattttcttcctctcccttttctaatcgctgctaatcatgaagg

SEQ ID NO: 7135 - DNA, 1501 bp, Oryza sativa
aaacctttcgttttttgcaaaaattttctataggaaagttactttaaaaaatcatattaatccatttttgaagtttaaaatagttaatactcaattaatcacacgctaagggctcacctcgttttacgtatcttcccaatcttctctatctcattctcctcaaacatagccttagtcatcctaacaatcgaaatacactaaaagtaggtgaagcacatatagtatggtgataaaacgtgggtgcatgactctatccatcgagatttaaatccttatgtccacagttagtgtgtgcgctctcaatagaattttagtaagaacagggatatgctaccggtctctgtctttttagcgtgtattagacggctcactcatgagtgtgagtgtggcatgcgtgcatgtgtaatagtaaaaaagaaaataaaatacgctggggagtaggaaaaaaatgggccagtgtcaagcccagatgcggtggtggcccatcattagcccatccagcccaattactcttgctgtccccctggcccctccatctccatggcacaaaacctccgcctctccatggcttcccggatcaatcccctttttcctcccgaggcgagggttttggcgaggagatcgagcagaggatctctttagcctcccgttcggcccaatccaccgtagcccaggcccatttagttgtccgtccagccgcgcgccgccgtgcctttttattggttgctgcggttccaagaaacccccgccatggcctccgatggtagtttcttccgatacggtggttagtcagtgcccttcttgcgtgtgcggttcttggaatttcttgttttctttgtctctcctagcgattgtttgttggagggataattttttgcttcttgtcaatggcggtcgccggatggatcagtggctcgttcgctccgtgtttcttgtaggttcggtggttgcagatgtcttaaggtgcaattcttgttcggttttgttaatgatagttagttcttggtcggagaggcagcaatctgtagatgaataattaggttgccactcaatcgacacaggaaaatgttgcggaagttcatgaccatatatatatgcttcttgatgagtttctctactgtcgatggcggataattctgcagctccttgttaatggaggttgctggatcggtggatatgaccattttatgcttcttgaatgttcaggttgcagatatctaggtttaattcatgttcgatttagttgatactagttagtttttgctcggagaggcagcagtctgtagacaaatagtcaggtctccaccttaattaatatttcagttgacataaaaatattgggaagttcatgaccgtatatatgcttcttgaagaatgtcttgtctatactgtatttcgatcacctttgatatgcatccttctgatccgattaatttcggtccagagcgccagatagcagctaaacctgaagattgcccagcaatgtcatcaatgttgtcat

SEQ ID NO: 7136 - DNA, 1501 bp, Oryza sativa
ttaagcctaattaatacgtcattagcaaatgtttactgtagaaccatattgtcaaatcatggcgcaattaagcttaaaagatttgtctcgcaatttacatgtaatctgtgtaattggtttttttcacatttaatactctatgcatgtgtccaaacattcgatgtgacagtgtggaaatttttttgttttggaaactaaatagggccttacaggagaagaaaaaatgcgcgccgccacttggttagttacgggagaggagaaaatgcgcgtcggcgtgtgcgcgtgcggggatccggtggggaaaagaaaacaaagggcctgtttagttcacgaaaagaaaatttttgggtatcacatcgatgtttgtctggatgtcagaaggggttctcggatacgaatgaaacaactaattttataactcgccttgaaacaacgagacgaatcttgagcctaattaagccgttattagcacatgtgggttactgtagcacttatggctaaccatggactatttaggctcaaaagatttatctcacgatttttctttctaattgtgcaattagtttttttaatctatatttaatatatttaatgctctatgtatgtgtcaaaagatttaatgtaatgtttttagaaaaaaaatttagtagcaactaaaccaggccaaaaaaaaagaggaaaagtgaaaacgcgtggatccaaaacgcgcgtgatttcggctgtgttcgtttggacgttttcccgtcgcgctacagtgttttgcccccgcgcacgctttttaaactactacacggtgtatttttttgcaaaaagtttctatacaaaagttgcttaaaaaaatcaaattaatccatttttgaaaaaaaattagctaatacttaattaatcacgtgttaatgaaccgttccgttttccgtgttactgtagcgcgctggggaaaacgtccaaacgaacacagccttcgtttgcttgcgcgtagcaattagcgaatcccagcgactttgaccatacatttgttttctacttaattgaccatactccagtcctactccggtgcgtgcgttctcgtgtccggcacagtaaggtcaaagttggtccctggacaggcatctgcgcggcacgctcggccacggaacgtcggtcctctcgagctgaacgttggtagacagactcgaagtgggtctcctatctgtggatctggcgtgcttaaaagttaaagtccaagtcaaagccatacgacgtgccgtcactcagtccaagtccacacctaccgtgctcttgcgtttacacttggcgtgccgttactgggtccaaccgtccaagcacacactaccgaccaccgctgctgttttacatctcctgagcacatgactgagcggcatactgcttgcttcttctttttaatataaatacataggagtagtgccatgaactaaacgggggctctcgcacactgaagataatacactcccacaaacactacgcacgccttgctattcct

SEQ ID NO: 7137 - DNA, 1501 bp, Oryza sativa
ttagaaataattttaaaaagtcttgaagagaagatctaagtttaattaataaattccaatataaaattgggccagataaaatttcattaaatactttgcttaattctataattcctagatttttctggaatttttttgagctaaggaagtatttttaataatggaattgcatttaagaaataatttaaattgaaaaggttttaaaaagtcttcttttggctttgggccgaaagtcggcccaaaaccgttctctctctcctcggcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctctgggatctcctctaccttttctcctttggaatctttggttaaatcgctttgtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctattttttaatcttacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctatcctcggcccattctcccttctttcggctggccttatccctcctccaaagtcttctttgtgtccctttttcaatcgggccaagaagtagaagcccagccaaaagtctagttggcctccctgctacagtgtcttcttcaatctccagccggctggagacagagcccgagccagccgcacagtacctgtatagccgcggttttcccctccaaatccggccttttatctcgtgtatttccaaaattagttgaggggaaatattcctcttatcctcctctatctttacccccaggaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgc

SEQ ID NO: 7138 - DNA, 1501 bp, Oryza sativa
ttcttccgatctccccccttgctcgtgtctggggggtttccgtcaatgaggacaaagaggttctcgggcttccccgccttgttctccccaccggggccgaacgtgagtttttgcttttgctccgtgtcgtatacttctttttgcggaaatatacttcggcctaattcatcgttttccttttcctctctttttcagttcacaccttagaggacgccaaaacggaggcatcgaaaatggttggcgtcctaaccacagccaaattcgcccgcctgcttcagcgtcagaccgatggccgggtgaaccgagtttatgttggcgaactgccaggttgatcaatcccctctagggccggcgacgaggatgtcggtacgtcgaagaagtgcaaacgagcggttgcaaagggtggccaggtgcgaactcgtcgcgccgctaaggacgcggccgaaagcgatggtggggaggaggaagaagacgatagggaggccggatctgaggatgatggatcgcatggttatactcctagcccagctagggtgaaatctggggtgggctctcatgtttcgcccgtgcgcccgcaagacattgctggagcgaatgcccttctggcgatttctagctctgcggcgaagccgggagctgttgccaggaagaagaagaagaaggggaaggttgtgcaagttggctgtggcttttcggacagtgaggggtccgatgggatgcccacttcgccgattctgcggcgcattcctcctcgggggagactgtcacgtcctgataaattcatcccgaattaaaaatcattcgctaaaaggaataatagagttaattaaaattcgaaaagaatttggcaaacactaaaatacgtacaagaaaaattcgaatgtggcccggagaatttttgttaaattatccttggtctaaaaggagccctcaaattttacttgaattttcagagcaccggaaataattattaagcaacaaaaacaattatcaaagtttatttaaaaagaaaaacctaaaaataaccctccttcctcctttgggccaagtctggcccaaagtcctccctctctcccctcggcccgcggccgaagtctccctctcctccctctctttctctccctctccttctctccctcctcctcttgggcctcctcccctcccggcccagctccctcccctcccctctctctcccgggcctcctctccctcctctcctcctgggtcgcctcggcttcgcccggcccaagccgagccgcgcctcccgcccgtgccgcgcgcgtgcgcgcgctgacgccgccgcctgaccgcgtggggcccacgcgccaggccggtcgtccccttccaaccgcccggccccttcctctctctccctcccgtgcgaaccctagcgccattcctccctcaaatccgcgcgattcaagcatgggattcccaaattgattagggggaattaatcccctttccctcctctctctttcccccttaatttccccttgaa

SEQ ID NO: 7139 - DNA, 1501 bp, Oryza sativa
taggagatggaaaaaatcgatgatcctatctgacccaagcctcgatcaatttgatctcgcttcgagaaaaaaaaggcccaagcaagacttgttttagatccacacatcagaacattccaggaacgctttggaaaaaccaaaccgatgaggtagatgatacaaaagattaaattctttttcatggaattggatgtttttttcctgaaaccgatgaggtagataaggtagatgttttttttcacattgcacagtgctaaaccggatttttttttataaacatgaggtttttaatgcattgggttagacagttttttccgagcgattttttttataaacgatgattttttctcgtatggagttggatggttttttttatctttttttcgcgtggattcggacggttttttcaatccatttttttatacacaatggattttatctcatgttgagttggacgtttttttgaacctgtatttttataaaagacttcttttcctcgtgttgagtcgacagattttttcgaacaggtttttttataaatggcgttttcttgcttttgagttaggttttttctctttttttacagacaacggaaacttggcttttttttctcaattgaaaagatgcccgtgcattgcaatgggaaaaggtgtttttttccattggtacaacagctattaggagttgaggaataaattgaaaaagcgttacctcctacctagggttgtcaacggggcgggtcaggggcgggttgggctggaacgcccccgcacccgctccccgacttctccccccaaccccggccccgcacaggtgatcgggtgggaaatatccccccgtccccgcccctgcaggggacccgtgggtgagcggggctccgtaccaccgacggcaaacgcgagatgaggaggaatgcagccgccgccacggtgcatgtgccgcccttgacgtcgatggcgacgccgacgcggttggccgcacccctggccgtcaacaccgctgccgctgcaagctccatggccgttgatgccgacgcagatggctgcgcttggcagccgccgccgccgcccgcgccttaaccgtcgacgccgtcgcccaccccttggccgccaccgctgcaagctccaaggccgtcgacaccgacgcggatggcggcgcttagcagtcgacgtggatggcggcgcttggcagccgacgccgccatggcccgcgcctggccaccgccgccgcctgcgccttggccgccaacgccatcgctctccttgtgatgggagaggatattcccaataggcaatatgacactgaaagagatgggttgttaattttgaccatgattcagttattagatttaacacgagtgctcacacttacagttaattagacacctgaggagacttcatcaatctcaagttatgccggtaaagagtttcaaatgtgttaatagaagtaggatgtgtgtatatacatacacaggggtatgtgcacgcactgtatccttttc

SEQ ID NO: 7140 - DNA, 1501 bp, Oryza sativa
gcgacgcatgagcattttgggaaaaaagggcacatagttgaccacggaagcgatgcgcacagtggcaccgggagatgcgctcacacgtgacgccctcctgccttgtctgatccccttttcccttcttcctctcggtttcttcacgaggctctgtccatctgcctacaagcccaggcgccacgtccagatgcaaatatactcatgtcgtattaatcatttatttcttttacccaaactgaactacagttctaaccatcccttatttaattgaaatacatataggacctgttctgctatgtttagcagctgcgcagttgcagctagctaaaaaaaatactctagatgttggctgcaacacagtaaaaatgagtgcagtcgaatctatatagactatttgccctctctactaatttatgttttatgtgctaaaaatatactaaaagagtaaatgatttcaacgctatctaaaactaaccagagtagattggactgatgaaaaaatgaattcgaaagatggagtagggttggagccattccgcaactctccttgagacttcgctagttagattcaagtgtttgagttattggtggaaaatatttttcgttttactttgtgaagctctcgtcgaaattttcataggagtacgttttctcggggaactccaaacaaacggggctgaacacttgttcgacagatccaatgagcagtttgtagatttatttgtagggaggtgtcattactgattgagcattcccatgcttatcaagcaattctctaattcctcgggtatttccaaagtttgccgattttcaaggcgagtgctcagcctaggcttcacatggcatcgtggggcatcccgcatcccattagccaaatggagcggccatcaaactattttaactccacggtcggagtaacacatgttgcgtggcacgcttggtgaatactacgtccatctcgtatctaccacacgggttagaaaaatgtattgtaccggctcatgtctaacaagttaaaataagtaactctactcattctttttcaagtaaaattatgtgtaaaaagctctaacattggtcgctaattttagtaatacacttttatattttttttaactatcgtggtaaagaaaaaattacgaatacataaaacataataatacttccttacacacccacaattatttatatttttaaaatagagagagtatatgacatggagtaaattttgaagttatgactggttttatataaggcaaattttgctataggacactcaaaatttgtttattttgatggtagagatcgtaaaaatatgctagagatcgtaaaaatatgcgacggctgaaagatactctagaaaattggtaatttgctgaaggacacttctagctcaatcggagagacaaattcttcaaaaagacgggaatgacatttgggtctaaagctttttgagcccagactatagtgaaaatgaaacatgatgtatgctaatgatgta

SEQ ID NO: 7141 - DNA, 1501 bp, Oryza sativa
actttaagcacaacttttcattttttatatttataaattttttttaataagacgagtggtcaaacgttgcaatcaaaaactcaaaatcccttatattgtgagacggagggagtagttcagttagctaccagctccaaaagctccattggttgctttaataaacaaaagaaaaagtcaaaattcaaaattgcaaacttgtttttaaagttaatttaagatattttcaacatgatttcttttttatattgattgttaagttgctacgaacacatgtatattttacctactaactaatttttattccttaataagttgatttggcttattaaaaaatatgggccaacaaaaaggacctaattaaattatctatacatattttaatactcaatttatataatagttgcctataaatatatactacactcatcaataccacaatacctagtcatacctttaacacacaaaacgttttataatcagtactgcaaccgactataaagttgtagtccatctctgttttcttttctcttttaattatctttttttacatgtgtttacagccgatttataagatactatatattgtacttgctctttaagttccttttctggctagacaaagcttatgattaattacttattgttaactccatccatctaggcagtttattctaccgatacatcagtaagagagtttccagactggtttagggttgaatgatccactaacaacgctaccaattttgttattctcctagatgatcaagtgggttgttaattaacaggtgaaaataaactgtaccttagataatttcgtctcactgataaatggtccaccccatgccagtcttgcatcatagtaagagtatatcatacgaacaatgagctgtttattttccttgctcaccccaaggtgccttggagtccgtgtaggtgcgtttcgcgttccccacaaacatgcctcccatcatactttgtttaatgttaggcctatcaatctgcatatctgcacacacactcacacaacaaacattccatttactggtaaaacactaaacttgtcccatcctgtccccacatttatattaggccgggtgaatcttagtactctatatgcacggtatataattgctcaagcaatgccaaagctcacaaagaaagacaccaaaattaattgctgtgaattcaattctacaaaaaatactaccagtcccacataatgagtgctataaaatgaatatgtctccgcgtatggaccaagctaagacaagaccataatgcacataacatgaccatgtaggcatatatgtactgtgcaatggtacaatacaatgaattctttgcggttgctcggaaaggtgtacacactttgtcaggctcttctgtagctgtagcaattttaccccttctctctttaagcccctttctttctctctcccttgtagccatgtgagtatataaacacatcgccctagcttttctctattgtcttcttcttcta

SEQ ID NO: 7142 - DNA, 1501 bp, Oryza sativa
acttacacatataataaaagtaatttacaaatataaatattttttcattgtaatataatcgtgtaagatcttattgtgaagatttaattgtaacgaagacaatagtgtaattggattgtagatcggataggtaatttgagataaaactttataaaaaggaagaaaaagacatgcatgtctaagaggaaaaacagcatatacgctaacacgtgtagcagtactttttctcataattgtttcgtcgctggttagcactaaatcgagagactactcggtttagattttgctgaaaacaaaaggcaaagaagactgggatgaacatgggcctttttacgctttgacttcaaaggtagcccaggagaagcccgataatagtcaggcgaactgccgattgccgaagggtctctcacactctcacagcagcatcgcacggtcgcgcagaatgggcagaagagaagatgtcgtcgaagtcgaagccaaccaaaactgtgccgccggctgctcggctgcgtacgtgcacggcgcacctgcgaatgatctggccaccgccaccgagcggcgcgcggtttgacccttgacagcctcagcccgcgtctcggctctcgagcctcgcgaggagaaagcgaccggccgcgtgccgccgtgcaggagctgcatcgagaggctccctgcactccgcgcccaatcctgaaaaatcccctccgcccgccccgcctccaccccacgtcctcctcctccccagcagtcccacccgcgcacgcacgtcgatccgggagagagagagagagcgcgatgacgccgctccacgccgccccgcaccatgccgcggccgcggccgcggtcgtctcctcgccctcatccgcgccgctcctcctccgcgccaagccttaccaccccaaggcggcggcttgctccttcaccgtgaccgccaccactccgtcgaggaaaggttagcaactcagacatcattagaaaaaaaaaaaaccatctaatatctgcgtgcgtgcgtacgacgagaggtcacggcggcgcactgtggcaaccaactaggagtactttggctcgtctgcgctggtctgtgccgctgtgcgcgcactgtttctcttctcttgtttattgcttgcttggccttttccgtgctcgcgtaagcggataagggtcgtgtgccatggtgttttgcaagcgtacacctgcccctgcgtctgactcgacgagccgtttctttatcctttttttttttagctgcagagagcaatgtttgatcatccatataaaactctcgcgcatccgtttttctctctcttgctggggtcaagaggtcaatacacagttcggtccttcaaagatttggtcctttttgctatagtttagatcgtcgatttctcaggttcttgacaccgcatggatggtaggatcaagaaaggcatcgccgcgcaagtcacgattcctctcgccattttaactgatcgccctgtttctttctttgcgccagctttcctgt

SEQ ID NO: 7143 - DNA, 1501 bp, Oryza sativa
ttgcagcttaattactcccgcaatcatgtttagtttatgctgactagatataactataacgatttatcagcaataaaaaaataatttgtaacaaaccttttatacatgtgttctaagaaataaaaaaaaagcaaatgttaaaaaataaactgcaataggaaaaccaaattaacttcaatatcaacttttaaaatttaaattttacttgtagcttataagatgaagagtaaatgatgggattcctttttttcccttgttacgtcccctaaacttttggatatataaccctccaaactttacaataccatctacataataacaccctctaaagtggttttggttggtgctttttgtatattttgatgtttaaactagttgttttggctaattaaaatgatatattttcattgcgtcgatgctcagtccttaagctattgtgatatcatactaacatgcatgccatgttgatctatattggtctgattaattatcagtgagagaaaggtaataaaagagatacattcaagtgaagattttgacatatatcttcaatatgcatgccatgttgcaaaaattttccattgtacctgcaaaattagacactactttaggggcttatatgaacgatattgtatatttaaggtgttggatgtctggttccaaatttcagggaatagtgttatatggacaggggggaaccacaaaaaattaagttaggtttcgacgtggaacaagagcaaattttgaggcaactttcaaatggttcttgatatattcaaatttaaattagtaaatttgagcgaaatttagtcaaaatttgctaaaaactattatgccaccgggggtcaagatcccacggtccatcgtaaaagctaacatagatagactttcagtcaaagcttaagggagtatgtatatacggacttcttcctctcctttttttcccattagataatcagagaaataatgagcagcatataatatatgtgcactatggcctggtttatttcctaactttttcttcaaacttcaaacttttccattacatcaaaactttcctgcacacataaactttcaacttttccgttacatcgttccaatttcaatcaaactttcaattttagcgtgaactaaacacaccctacgtgccatgtttaaaaatgctaggataataaccacttaatttgttgcttgtcttactaagccgatttagaattagaaaccgcttgataaaccgactaaatatgaaaggattttttgttttaaaaaactgtccaaataaaaaattactggttttcgttgttaaccgtggttatgaatgaaacctagggagctcgtgtttagtaaccttgtcacatttgaaatagaaaagttttttttctttttttctttgtggggcacctgagtgctagaaacagtataactgtagtctattaattcagagcagagagttaatctgccctgtcggaagagcaatatatacagtacttgctactctcta

SEQ ID NO: 7144 - DNA, 1501 bp, Oryza sativa
acacttatgatgataggcagcagagaagcagaagccgtcatgcctcacagtttttcttctctttttccttcttctcccatcgtttttttttttggttttacgtcgtccgatccgtccattgctccattgctgacgacgagcgaacctccatccaaacgctgttcgcaaccgatcccagagatcaaggtccccatacatccaccaccaccaccaccaccatcctcttcctcttccctctcttgcctcctccttttattactctactcatttagcttttggttggttggttcccttcttgagaccccaaaacccaactaggaaggacaaggacacatccctctccctcttccaccaagagagatagagccaagaaccggacgaggtagaagagattgagccgccacggcagtgggagcgcgcgcgcgagttccccgagatccgcgagatctccgtcgccggctcatgccactggtcggttcttggggcggcggcggcggcggcggggggtggtgagtctgtggccgtttcttgcggcgtggtgaggtgaggggagggagaaagagaggctgcacatgtccgtcatggcgcggccccgcttcgaggaggatgacgaggatgagttctttgactcgagggaggtcatgtcgccggcgtccgtctcttctccggcgagctccgggcgctacgacgggcccatgctcgaggtgtgggccaccgacccgtgcagcgtccatgagcgccgtcagaggttcatcaagtccttgggcctctcggattcgagcccctccgccggcggcggcggcgaccggcccgacgaggagccgtgctcgaggtccagtgccgcagaagagatcctcccgtgcagccccaccgtcgagctggtctcagccgtccccagttttgcgtgcagaggcgaggagccgggagcgtcaggcggcggcggcggcgcggaggtgttggattgtgtattcaagaacttggacgatggtacagtgtttgtcgtcgacgagatgggaaaagatgggagtttcaggagcctcagggacaggcgatccaaccggacagttactgcagcggaattcgaacggacctacggctcgtccccattcatctgtgagctgatgcggcgggtggatgattcggatgagtcctctgctgtggagaaggctctggtcaggggaaggagaaggaggaggagatttggatggctgcgcaggctcggcatccgtggctgcgtcgtcgatgtggaggaggacgatgagacgaattcaacatcctcgagttcttgtcggagttgctctgggaaggttgatagggtcaaggtgaggcattacaagaagaggtcaaaggaattgtccgcggtgtacaggggccaagacatcaaggcgcacgaaggcgcaattgtgaccatgaagtttagctctgatggacagtatctggccactggaggtgaggatggggttgtgcgtgtgtggcgggtggtggagggggagaggcccaa

SEQ ID NO: 7145 - DNA, 1501 bp, Oryza sativa
ggcgaccacgtgctacgtggcggcccacccgaggctggccggcgtgtccggccgctacttcgccgactgcaacgaggccctgccgtcgccggccgccaccaaccgccacgaggccgagcggctgtggcaaatctccgagtccatgctgctctgcacgaacagacacagcaaagatgcctccgctccctgacacagctgactggctaatctttaccgtattttactactacccatcctaaaatataataacttttatctataaatttgaacaattaaaaatacttatattttaggatggaggaagtagtgcatcactgtcttttctcttgttccacattacatatatacagcttcatgcaatatgtaacctgcaaatattatagtagtatgagcaccagtgtataaatatatagtagtatatctgtagcattatagcagtagcagccaattatattagtgattgtatttccgagatatataatactagtatacagtacgctgtaatttgtcctcgagtaccagacattgccagtgagatttgcactcggtgtcgtatgtgtgcctttggctttgctgttcaccatgtcaggagaaagcagacgtgtcgagatgcggcacgcacgcattggaaacatgtactggtactggtactaaccttgttgcgtgcaagtacaatgtgcatggttgattggtgggagtttttgcatgggtggatgcatctatgaattgtcttgttcgattggatagctggttgtgatcccccatccaaatgattgcgcccgtggctggccgctgccgatgtggatgctgcagaaaccgaagcctccttttgcgactcagaaaccgaaaccttttgtttttgtgcgacttggcatggcaaacgactgtgtcttggtgagtgaccactcgaaaaattcgagtttcccttttctccttgagaatcacatgccaccgaaaatggggcagtgcgttccctatgggacaagaactaggtgatgtgtttccatccaaggaggtacagtgataacatcaattgttatcccttttgcagtgtaatcagattagagtgcagtgtgggtcataagatgtcctagctcaatgacaatgacaaaactctacagcatcatcagcacaaggcttccccagaaagttattattacagagcctccaaccagggagtagcttaaaaccttttgttattttcagattgagacttgagtctacaagtgcagcctagaagtaaccttagagcaaggtcaacagtgcagccagctgtttacttcaattttaatccatctcacctccatctcacctataggtaacattgtagctagtaaacacaataatcaagctatactactatgacccacactatacaagaaattttattttaatctcccttctatccccactctctctctctcctaatcccttgttctcgccggcgattgcttctcacgaactaggcatccaagctcatccatggctaaaaagatgaaca

SEQ ID NO: 7146 - DNA, 1501 bp, Oryza sativa
cggccctagcgacgcctgattgtggaaaattcagctacagtgccggtggccgaaagtcttcaagctttgaggtcgctggccatagtttgcggtggatctggatggcttcaaccgatttccgcgacctctttgtccatctaatccttggcgctgtgcccttcctcagcgatgcactcagccgcgtcgtgtccggtgagggtgggctcacacatgcccagatcgtcgtcatatttggtgggcttggaggtgcagagttagctgagctgttggagcagttcgtgcttgctgattcctctcatgcgagcatcccgaacattgtctcgacagacaacacctccatcaatttgctgctgtgcctaaatcaattatgcctaaatcaattatccaagcagcagcacaagtcatgggccagcaaggagcacgccatgaatcccctgcatcatacaggcaaccaacaagctacacaacaaggcaaagctggtccagcaattctgtgcatgccggcaacgaagtctccttctcaatcctcacccatgggatacatcttaagttcgtaagactttatcatcgccaccatctagcttctctaaagcttaaggtcagctgggttttggatgcatcttttatttcattcctttgcagcagtatccatgttgaggttatcgttcgggttgagcaccgactatctgttagactttggtcggcagggatattgttagtgttcctcagatttaacgatgacttccatggcaatcattggttgagtccggtgaagccaccaacatatctacgactcaactccaaagctcaattagtgccaaatccgtggaggcagccggagggatcgctggcaggtcaaatgggaagcacgtttgaagaggcccttgggtgcaatcgtcgcggcaatgccgcggatctccgacgattgtattcactactactgctgtatcagatgatctggaagtttgcttccatcattcaatcattacctttcaggaagatggtccttaacgtttgttgttatcaatttcttgcaaggtgatgtttcagggaatgttgttcccttccaatgtactatgtttaatatgcaataaaactttatgagtttcaaaaaaaaaacaacgtgaaaaatcttcagtgcagtgttattacagcgctcgtagaagcagaagcagaggcggagagaggtcgcacagttatggtcacatattccgcaaatggactagtagtaataattccatctccatctgcggcgtacttgccacttttcttcgatcggcaccaccaccttgtcccgtgccgtcctcatgcggcgcgagctttctataaatgcggcctccgctcctccccgagctttcacttcctcctcctcccactgttcttcgccctcagctctcgccgcgccgcgcccgcgcgtgagcggactacagtgtcagcttgctagctcacaggcgtcgctggccgccgcccgccgcgcgcgcgatcggtggcgaggcggaga

SEQ ID NO: 7147 - DNA, 1501 bp, Oryza sativa
ccgcagctgtcgccaccaatttcgtctgcctcggccacggctgccaccgtcatgcagttgccctcgccctcgtcggtcgatgttgcggctctcgtccaccgtggccatggagggcaagtaggagagagagaccaagagagcacaaaagcttggattgagttttgaggccttgtgcttatgaatcggctttgatggtttgcccgattgcttaacttctatcttccaccgttccgcgtgcagaaggccagctcaacgccggtcgccagacgatgagctcagctccggtgacccgttcgctctatccccagctacacgggcagcgtgagcctgcacgatgagctgtttctattttctgatggagaaaatagaataacatctttctctagaaaaatcagatagcttaagcgaagtaatagcatacgtatgtgtatatattgttctgtaccgattccttccatgtagatgagcagatgtatagtacaaaacggatgtgtatatagccataaatttgttcatctttttagccatggatgagcttggatgcctagttcgtgagaagcaatcgccggcgagaacaagggattaggagagagagagagtggggatagaagggagattaaaataaaatttcttgtatagtgtgggtcatagtagtatagcttgattattgtgtttactagctacaatgttacctataggtgagatggaggtgagatggattaaaattgaagtaaacagctggctgcactgttgaccttgctctaaggttacttctaggctgcacttgtagactcaagtctcaatctgaaaataacaaaaggttttaagctactccctggttggaggctctgtaataataactttctggggaagccttgtgctgatgatgctgtagagttttgtcattgtcattgagctaggacatcttatgacccacactgcactctaatctgattacactgcaaaagggataacaattgatgttatcactgtacctccttggatggaaacacatcacctagttcttgtcccatagggaacgcactgccccattttcggtggcatgtgattctcaaggagaaaagggaaactcgaatttttcgagtggtcactcaccaagacacagtcgtttgccatgccaagtcgcacaaaaacaaaaggtttcggtttctgagtcgcaaaaggaggcttcggtttctgcagcatccacatcggcagcggccagccacgggcgcaatcatttggatgggggatcacaaccagctatccaatcgaacaagacaattcatagatgcatccacccatgcaaaaactcccaccaatcaaccatgcacattgtacttgcacgcaacaaggttagtaccagtaccagtacatgtttccaatgcgtgcgtgccgcatctcgacacgtctgctttctcctgacatggtgaacagcaaagccaaaggcacacatacgacaccgagtgcaaatctcactggcaatgtctggtactcgagg

SEQ ID NO: 7148 - DNA, 1501 bp, Oryza sativa
tcggccccctcgagagctcgctcccgctcagtgagcgcgtcctcgcggaggcggagcgtgaactcttcttcggcgcaggtagcctcgtgcgccgccagcgttgcttcccggatggtgacggcggcctcgcggtccgccagatccctctccacgacgcaggcgcgctcttccagcgccatggcgcgcgcctcaagggcctcttcacgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgtcggcggtgagccttacggcccacctccaccatggcctccaccgagcgtcgcccctcttcgacacgcgcccacgcggcgtcgagctccgcccgctctgcctgtaggacctctacctgggcacttaacccatccaacaccgtggtgtttgcggcggccaaggcctgcagaaggggctctgcgttcagtggggcgatagaaggcgtggggaagagccgccttggagaggatgccacgcggctcgggccgccgatggaagtgccggactcggggatgtcccccggacccgtttggtcctgagcgtcgcccgagggagtgggcccaagcgacgcgcccgcagcctcgtcgccagctgccccggaagttgtcgcctgagcgtcgcccgagggagtgggcccaagcgacgcgcccgcggcctcgtcacgagttgcctcggaagtcgccatcgcctcgtcctggcgaaatccggcctcctcccgagcggcttccccggcctggcgggcccgggcggcctcctcccgagcggtttcctcggcctggcgagcccgggcggcctcctgggcggcctccttggcttcccgtaggcgatccacggcctctcgccggtcagattcccgcctgagggcctctgcggccgccggatcctcggcctcagactggccggacttggaatggcgggagggacgcgacgggatctcgctgaaacaaaagaaaaaaaaccagaagacgaacaaggtgggtgagtgaaaactcgcgttgagagaatgaatacagccacgatgggtgagagatgaacctgcgaggaggtcggttaaacgaccactttggaggggaaatgaggtttccccgagatggttctgtctcccccatcttacggggccgcttcttcttgcgctccccctcgggctgcgatgttggcgcggccccctccgggcgcctgctgctggcacgcgccgccccgccccctcggggaggagatgggggaggtgttcctccctgcttcctcttcccccgggcgtcggcagggcggctgctccccgggcccctgtcgcgg

SEQ ID NO: 7149 - DNA, 1501 bp, Oryza sativa
tcatcagagtcttcagcaaattcaacatcatattgctcaacacttgcctcctcgtcaacatcatctctattgacttctactgagacagaatcgtgaccaccactcaattcgacatcaaagtaatcatctgtattcatatattggcctgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttccccctccaagtcttctcgtaccaactcagtcttacttgcaccccctccacgacgagaataatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgactttagttcatctagagttgggtgggtgggaaacaaaatggtcttcaatgacatatcctcaaactcacatgtgcaccaacataaggttccaccactctaccaccgtagtaaacacgaacaagtctatccatctacaccaaaaaatcaaatgtaactttgcaacaaaattaaatcttcattcctaaacgtagtccaaaccgacatattataaccaatgcacaacttaaattgtcccaaagctactactccaaaaaaatatttaatccacctacaactatcaataagtttactagtgcattacacatcgaaatattacaaatactccgtcatacaacccaaacctccgtcatgcctcaaccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcataaatttgggtaaaaaaggggttctagggttacccaccgatctacaaattcaaccaataaaaacgaaaaaaaaagaggggggaatgaaggagtctacctttctcttcgatttccacaaaaaatcccgcgaaaaacggctttaaattgagtggatttgaggtggagaggtgagggggagagagaggggaagaactcctgcgctgctgctcgggctgggacttggcgaaaatgggagtggggaggagaaaggtggtggggcccacggggtttaagggtcggcccacagaggaggggcgcgccagccgtgctggcgccgtggtatgag

SEQ ID NO: 7150 - DNA, 1501 bp, Oryza sativa
ccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcataaatttgggtaaaaaaggggttctagggttacccaccgatctacaaattcaaccaataaaaacgaaaaaaaaagaggggggaatgaaggagtctacctttctcttcgatttccacaaaaaatcccgcgaaaaacggctttaaattgagtggatttgaggtggagaggtgagggggagagagaggggaagaactcctgcgctgctgctcgggctgggacttggcgaaaatgggagtggggaggagaaaggtggtggggcccacggggtttaagggtcggcccacagaggaggggcgcgccagccgtgctggcgccgtggtatgaggggcggcgccagtgtggctggcgcccccattctgcccagtcagcacctccacgacagccctagtgccacggtggcacgggcacggcgccagtgtggctggcgccgccatgttggggtacggcgccagccactctggcaccccaaaaaggaccatttccggtttaagttttcccaggagtctatttgtaaaataagttttcaaaaaggaccaaattgtaaaaattttagattccaacacagcaatgtaaaagtccaagcattggcttttattctagatgagaaaacgaatggcgtgttaagagatgttttgtcttgataacaactcctgttaatgttgtcgacatatttagtcaatcgatggcttagtttcctattcgtagaggtcgcagttgtaattggcgctttcatgactagaaacaggccggcgccgcgacgaaggttctaatttgatttctgacccttttttttctgatcgaaacgccgttgatcgatcactttgctttatctgaccacgcgcacgacctgcacggcaaagctcctgcctatagctgtttattattccctgtgtgtcgagttccagtccaaacacgcgagcgagaaaattcccttgctctgactcgtggcaaggaattcacgagtgtcgatgatcatttcgttgtcacggcgtacgttaatctggaagagaataccgtaactctgtaagagacgagagtacatgctacgggagtgtttgagagcagaggaaaaggtgagatcgagaaagatatgtaaaacgagctaatctattagcatatgaataatagagtattagtgtataattaatagagtagtttgaaaagcgtgcacgtgaaaaacgacttactaccgaacgcagccccggcaggtactccaaagtatcagtagcatgtatacatcgcctgaccgaccaccgccgtgtaatgactactgtaatgaattgaggcacagttagcaaaagagctcaatatatacatcgggtatggacggagacgtggtacgtactgtatacaa

SEQ ID NO: 7151 - DNA, 1501 bp, Oryza sativa
acagtagacccatctaaatcatccaaaagagatcaattaaatgacaatctcttagagcaccacctgagtcactcccagtgaccgccatcgacggcgacctcacagtctcgcaggtcctctcaattgttcatatatactaacagctcgcagctgatcgagtttggttcttgatgaggctagcagggaaggttcaatgaatcctagacattggttggtaattggatggtctagatagactccttaattcttcatctttacttgttatatactctctctgtcccataatacaagagataatgagtggatgtggcacattttagtataataaaactggacaaacaagttttgttctaaaactattttcgctttataagacactccccaacaaatgccttaaaacagatccaaactcgcaaaggtagtacttagtaaccattatgagtgatcctgattgaaaagaatagtatcacgggatcacggtgatgcggaatcagatacatcaatccgcaaacgaacacctatcctataaagcattttacgccatttcgtcatgggaaacagctagctcgtcacactactcccaactctcttcgttttaaaaaataaaaacaatctacaattggatttgacataatctacaacaaaattagatagattgtccagattcattgcgttagattgtgttgtctagattcattgtattatattgtctagaattagagtatttttttaatgaaacggagggcgtatgaactaggaatagtacagtaaagcaaagcgcaaagcgcccccgaattaaccacgggaaggatcagttcttgtgtttgctgtagcattccaaaaccacacaggaatcccactgcatctatctggagattcccccacagtgtgggccccacctccagtgactcatcatcgccccctcctcctccccttcctctctcccctgtatataacgcgcacctcgcggcatccgaaaccaacacaaacacctcgttgcaatcgctggtcgccgccgccgccgcagccgtcgacggcgaaggggagatcagagccaaaggattgatccgtggctgctccgtggggggcgatggcgatgccgcggtcgccgggcgcgggctcgctccggtttcttggcctcctgaagcagccggagtcggggcccgacggcgcggcgccgccgttcgagctcgacgagagcgacgtggtgtggccggccggcggtgtcggggacgacggttactgctgcccggcgccgccacacccggagggcccaccgcgcgcgccccgccgcgcccacacggtgccgcagagcttcgggctgtcgtcgctgctcgccaacggggggcgcggcggcggcagcgacgacgggcgtcaggatggagtggccgtgcccgtgagggccgcggcggcgccgggtggaggcgccgcggcaccgaggcggtcggcaccggtgagggtcccgatgtggccgggcaagggcgccgccgccaacaacgtc

SEQ ID NO: 7152 - DNA, 1501 bp, Oryza sativa
  unsure (1)..(1501): unsure at all n locations
acatgacgataaatttctatcattcagtccctgagagcacggcgaaagaggtgtgccagatgttacttaatttctctaggcctgaaatatgcatgaaaatttatttttaccacagatggcgtaaggttttgtatgttccagaggactaatgcgccgcaccagacttgacgcttgactattagactcattttgctttctagttttgtacttggtttgaactgcgttgcatgtaaacatcaaaatgctctcagatattagacaaaatgcaggtcagccatctatcttacaagaacatgtgagccgtgcaaattcatgtagtgtaactgctgcacaaaattggttagaacttaaagttaatggctgcaaaactttggcatatcttccatcacatgagtgttagagcaggcagggctcatatgtgatgcagtaatgtttcattccatcatttaattttgagcagctgatagaaagttagaacatggaggatgtgcaggatttatctcgttatctttgtatgtttcaattgtgtaaggtacaagttaacagagatggaagtcacgcttccttggcatatgctgtaaatctttagaacagaacctcttctccagtgggccttggcaatgtggactaggctgagacctgagagtttgtttttgaaagattaatgtgttcactaaattggttgatgaacaatgggaggctagacatacataaggatctaagggaaatgttaggagtaacatcctagattaataatggtggcaaagggcacatggagagcttctggcatatgcggctacttccaaatttttaaattatcagaattctcaccagctaaatcagtagtaaaaatgaataaggcttatttgttttggaggaattccaaaggacatggatttctaaagattaattcctataaatgtcattcgattcagaagaatatagatataaaataccaaaggaaatttttctctcctactagttgtagggagaaaaatataagaaattctccgtccaatcaaacctcttgaaaaattactattcttattcctctatttgtcctatttctatgtattacaaaattctttcaaaacgaatagaccctacaaagtacaggttcataccctttagggtttagttaataagggaaatttacatagttacccttatgatagagacattagtgtgggtatacaatgtcttttgtattcatgggccctacggcgattttcttgggccagcccattagtggcgaaaggcctccatgggccacagagcctcctaagcccttagccgaaggcatcttctacttcgggcgatggcctctttgcttcgtcttatggcctttgcccttagtgatgattcaggcggatggtgagcttgatagcgaaccctttggtcttcgtcattannnnnnnnnnnnnnnnnnnnnnnnnnnnnntcgccttaggcctggtttagtttctcaaatttttttcccaaaaacatcacatcgaatctt

SEQ ID NO: 7153 - DNA, 1501 bp, Oryza sativa
acggctcacgcgggcacgcatgacggaggtagggatgtgggggattatgacggcgtttatgggcatgggaggagggtggcaacaggagatggggtggacggcgatgacgaggggcgcgagcaaggctgaggaggaggagtcctggagcggcggtggcgctaggaggaggcgcgtgaggggagtagcgccagtgacgggttggggatgaggtaggtagacaagaggagatatgtttgggaggttattttgcaaaaatatccttattctggttcggattacagcgccatccttaaaaaccgaattttctcttcttcgtgttatatttcttagaagtatatggttattttcataaaagttataacgagaaaaatatgatggaagggttgcttcttactttctcaaattatcaggggcttttatgacaaatatgtagggtggtgcgtggcctccatgcaagccctcaccgcccataaccagtgaagcacaccggacacgaggggaccgcttgctttattcaaactgtgggatgactgttggaatagagtgttgtcagtctcccttacccaattgaggagcactgcttcgaataaaacagcgtggcagcattccaaggagcccaaaaaaaacaaaaaacatgagaaaaagggtatgggtaggggtgttattaactgatgatttgatcatcacgattatatatactgtagagctagcgccaaacaatttttcaagttttaaaatccattggataaatgaaacaagaaacatggtccatcaatttgaaatgcagcctactggattcaaatgggggtatgcacacttattacagtagacttgctagttactaatccagtgtgagagccctctttaaacagtgcagtctttataatatcgtttactcacctttccaattccatcagttttgcgtcaggttgcaaattaactttggtggagaggagcctcttgtgctctgaccacttcataccctgtagaggacaggtaattgctgcactccctgcagtgagaacttcagtcgatatcaaagggtcctttgaggctatatatagtcggtgccatggagttgtttgaatacgtttggaccctcttctacttgagcaagctgagtgcttgcccaagagccccaagagctaattgaatatccttttaggaatttagggagagtttatccttgagagtgagttcttgcacatttataagaaggctagagcttgtgtgcttgttagggagtggatttgggagtaatttggagttggtatgcttcaagttgaagaacttgagccattgtaagaggagaaggagaatcctgcaggcaaccaagtggagtgtggtatgcccaagagaagtttgtgaaggttgataccttgcctctccaagggaagaggaaatagtggaagctgggctacatctcggtgggtgcttggtagagaaagcttcattggagggaaattgtgtggcgtttgagctttggaccaagtggatcgct

SEQ ID NO: 7154 - DNA, 1501 bp, Oryza sativa
acgaatacattattttaatgggcgcggtatctgctggtaaataaccacgtttagagagtgtttttccttaaaagtgagttcgtcttgttgttctacagctaaaaccacaaagtcgcgatgtcctgtagcaaaatttacctagaatgaaagaatggtgacatatcataaatctatatatagaaagatacggagaccaagttgattatacaataattaacaaattagaatatacgaattgaagaaattttaaaataaagtgccagtgtcctcagttcctcactacctgatcaacaagcatgaggagagacttcaacgaaaatttgctactgcaaatgcggaagaaaaggtcgatccaatcatctaatcatcgcaacattctaactaaatggatatgctgacaagcaatagaaagacataattactgctactcctggtgatatggagtattggtgtcttcactcttcaggtgatatggagtattcctgctactccagtttgcagccaacacattcctgctacttcagtgtgaactcaacgtttggtaggcagaattctaagtgctcagtcataaagtagcaagcataatctgaagtagtagcattacttgtttatgaaaaacagaaatgtaattattgttccaaattatgcacacttactatgctaagtgcagtactaaactactaaaccacaacccgtgcaaaagactcatacaaaatactaacaagcgcaatccatggacaaatcttaatgcatgtcaaaactacaccaaacatataaagcaggacctctctagccacacaaacttttgagtctaaactttacctaaccagaacacacaaagcaaagcgagcaaaagacattttttagataatggaagcttttattgaacctagtcaattacatcaagatgatataattaatctgagaacacttctggcctttgcataattaagatgcacacagccaaacatacaaaaccacactcaaatggaaaaaagaatgacatggagtattgaagaccatcaatccaggggcgtagctacggggggtgcctgagggggccaacatccccctatccaaccccctccctgttgtactaactagcgcattagcatgttaattagtccattatcaataaacatgatatagaaaattaattaataagaaagagacaaagagacaacgcaaatcaactcctcgtcttcattgcttcggcttcacatgtctctccgtactcccattgcgtctcgctgtcgagcatggtgtctcaagtctcaaactgttaaacattgaatgatacaactaaagagctaaattcaagcttttttatagcagaacacatgatattttgttttatcgtcggtattgcttactctgacttacgacttgtttgtcctgcccacacccccctaacgataaatcctggcttcgcccctgcatcaatccaaagactaaattgccaccaatgaacaactctttggccatctcctccaaaagcata

SEQ ID NO: 7155 - DNA, 1395 bp, Oryza sativa
ctccggccgccctctctcgccccggccctatttaaactggccccgcgcctcccccgcccgtttccgccccttgccgcaccgtctctccgccggaatcgagctcgcgccgtcgccctctctctcctccgtcgccgacgaccaccggccggccttctccgctcgccgggaccgtctcccgccccggcgtcgcctcctccggcttcgccgcaccgccatcgaccccgtccaccccctcgccgggtccgccgaccgccggaacgccgtcgaccccgtcgacccgagccgcgccgccgccttcctccgctctggctgcctttttcgtcgttgccgtcgacctagggtgagccgtggaccgccgcctcttttcccccttcccttcccctctctcggccgccgctccgccgtgcctatggccgtcgccggcgaccataggggcgcgggcgccgcctcccgccggccgcgccgagtggccgccgtcgggcgcgccgagtggctgccgcgtggggtccagccgtcagccgcccgcgccctcgggtgtggctgacacgtggggcccacggcgccggccggtgcgagcccgggtgcgcccggtccaccgtggaccatgaggctgccgcgtgggccctactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttctgttggtcgtgtagacgctgcagcttcggaagatccgctcttggtggaggttgaagccgacgtttgggaaagcgagcaaggcaagttacatcatccttgaacatattgaaacccagtttataaaattattttcatttaaattattgcattatcgctttacttaaattcccgcgttatcactgttttatctagccatgcctatgtacctttgttatgaccttattattattgttattgatattattaccttgttcaccctagattaaacagaaccccaactagtggacactctactcatggtaccactagtatgattttaggtaaatgcttcgctggttaattaggcaacattaggtggttttacaactctagactttgggaatattctcatcacctggacactacggaatggatggattattttggaattggattcacacctccccctctattcaaaaccctcaaaatggtttttggctgggctcggggtgcatggttttgatagtagcac

SEQ ID NO: 7156 - DNA, 1501 bp, Oryza sativa
gcgcagccgcgtttggatgtccggccgccgcactaggttcgccgtcggagagcttccgccgccgccgcccgccgccttctggaaggtggagaagacgcgggcgcgggggaggaagcggagggaactcctgctgcacggcgcgcatggcgccgacgagctcgccgtccacgccgtcgccgaaccacgtggccaagttgagcgcgaacagtgcggcgtacaggcagcacgacgagcagagcggcgccaagaaggcggcgtgggtggtgtcgcccaacggccaagtgaagcgagaaaaggcggtggaagcggcgcgcggcgagggagctgcagccggagccggagaagaagaagaaaagcggatcgacttggccgtgctccgttgccctatctgcctccttcctagctgttcatccaatccatctgacattcttcttcttgttgttgttctttcattcgattcgtgagggctcggctagtggcaatttcttggcgtgcagtccgcggcggggcacttggcgtgcagcagctgccatggcgacgtcccggcaagcagtgccacgcgtgcggcggcgccgccaagatcctgtgccccaacgacctgttcggctgctggagctacgtcgcctattacgacgtcgccggccaccagcgcgcctgcccgcacgcgccctgctcctgctcggagtcgcgctgcgacttcctcggctcgccgccgatgctcctcgcccacctcgtcgccgacatgtggttggtgtcgatttggaatggggtgaaatggactggaaaagtgaactgaatccatatagatgaaatgggttgggttgatttgggttgaaatatgatatgggttggattggtttggattctaagagaagacaaatgaattagagtggtttggacttgtgtagcttactgctttggtttgggctggttgtggattggatttcaaaccattggcaggcttccacgcatgcatgtctctcttgtttggtttccctccatgtactttgatcgcaggagtactaatttgtggttgataataactttgatagtgtgtccgctcttgccgcgttgaaaccaaagagttagagaaatcctatatatttatataaagttcatttctacagtggttattaatgctatttatatcttttcttattaagccacatcatctaaattgtttctttatccctatgatagttgagataggtatattgttcaaattatctctcacgttttcttttgttattaagccgtatcacctttgttttatatttaagatgatgtacttagccacatcactattgttgtgattttaaatggccaatctagtttaaattattataaataacatcctaattgtatatagttttttttctgcagtcgataaagatgaaattatataatgttatgcctactgattatatgttatttctattattactgtataaaacttacgcagcaacccgtgagtttcatgaagtctgatttcactattgcg

SEQ ID NO: 7157 - DNA, 1159 bp, Oryza sativa
ataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttgaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaactttcattcctcttacgttccttttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatattatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatga

SEQ ID NO: 7158 - DNA, 989 bp, Oryza sativa
ttacatgagtaaaattctttacattttggtggtatgtacttttaatttataatttactctcgccattctaaaacataagacacaataactgcttaaagagaaaaataaaattattatcacattctagtttagatcatcgtaataaatacaatgtatatacccaataagattatggattttgagagtggaggatttaagaaaacaatttttaaaaaaaaatgttcgaaaagccaaattgtggtccttattgtgtgactaggcatgacactaaaaatatcatttccaaaatatagcaacattaaactcttaggaatttattttaaaatataataatttctccacctacattattttcccaaccaatcacaaccctttaccatttacttttttcaccaatcatatcctctccacatttaatcctacctactttcttaataattatgtccaactttaaaaatttttatatacttacgaacatcatttgtaactttttactcatttgtaaaaatgtgctctcatttgttgcgtatggttgcagtgaactcatcagaggggggaataaatggctgaaaaaatgtgttgtcacatcgctttaaaagagatgagcagctgcaaggggcgtctcgggcgaagggtgcaaggcgaagactatctgccgaaggaagacgacttcgccatagcaagttcgcccccgcaagggccaaggaagcctttccagcccatcaagcctaagggccggcgatcgctagacggcccattaggggcccatgagaccctataacattatgtacccctgtaaatgtccctttcataagggtaattatataaattcccctgtacaacctagatcctagtagaaagagcctgcaatagggctataaatagccccctagggctatgtaacgggggatcccaagtgaaattaaaaatttagtacacttcattttcccaaccactgttgagtaaccacgtccttcgacgtatacagt

SEQ ID NO: 7159 - DNA, 890 bp, Oryza sativa
cgcgagggacccgagccagggagggatgggtcatgaagggagagcgagagggggccgtctggaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatcatggtagctccgcccatgtgagtggtgaccactacggcatcgagtggtaaccaccacggcatctagcagagatgctctgatgctcatatgtgtcatgtactgtaatgtatagaaattgaagggcaagtccaaacattataccaacacattgttcactttgtttctttttctttaccagttctgtaaggcaagctgcaagcctgcaactgcagaagtccctacacaggtcaagagaattttggggttgtcattgtagaaagagacttcactcaaataccatttcacaagctccatcaaattactactccctccgttttaggttataagatgtcttaactttggttaaagtcaaactgtttcaagtttgataaagtttatgaaaaaaatagtaatattttcggcacaagataaatttattataaaatatatttaattattaatttaataaaattaatttggtaatataaatattactctatttgtctataaacttagtcaaacttaaagtagcttgactttgatcaaagtcagtattataaagaggtggctccataaggaagtcttttatactctgactatatagatatgtgcttttttaga

SEQ ID NO: 7160 - DNA, 1501 bp, Oryza sativa
ccgtgtacttgggccgattaatctgtgacgacgcagtgggcggcgagatccaccacagtagcttagtggagatcaccatgaaggaggcgctcgattgccaagtcatgttcgtgtgtgttgtgccgtaggggcatacgaggaccacataggacaacctcatggccatcatcataaggctgctttgtcgttgcctcaactcaccatcgacgtctcctgccacgctgccacatagggaacatggtcatggggttcggataatgctttagtagtgcaaaggatcctgatgataccgcgtgcgatgctggggatgagatcccatccgttagcattcccataaattagaaagaagatcatgaaattctggccattcatatagttgttttttttttttggaaaaaaggagtgtgttcggtagacatctttgtggcagcactgaggttgcgatgcatgttgtgcatggctgtgctacttgctattgtagttgactacactgccagccgaacagggccaaagacacatggtcaaatttaatctacaagtgtatttatccacgttcttccttggtaggggtgaaaacagtcacggaaattctcgatcgaccgagcgccgttttcaggggcactgtttttggctatttataaattttgttttttctattttttttgcattgtattaatgttgacacgatatactttaaatgattaatatggttaattaccggtcgatcgaccgtcgtttccgaagatatgctaccgattccgaccattttcacctctattctcgggtgatgatcacctgtgcagctgtgctccctttgttactcaacactacaaagtcaaagtcctgagacgtgactacaccgctacaccaacgcgacagccaccatgcatacacgatgccccttgtgcccttctgtgtgctgtgttcctaaatttttcaccttttggttcttttgaaaagcttattatacaaatagatcctaaaaaacttatgctaggattgatccctttttgctgtgccaacatcatcggcgccgtggtccgatatgacggcaccatacccccttgcctcctgtgaaagctaagtcaacaatgtgagggggacggcgacaatatcgtttgcgccgaggacatatttgttagaaaataaaaaaaactatttgtagcgaaaatggacctatttgaaaataaaactatttataaataggtcctcaatgtcaactacgttgatgatgaggatttatttgtaaatattttttttattacaaatgggttttttaatatatatatatatatatatatatatagactctcagtgccaacgacattggcatcgttccccttcacattagtggcttagctttaactaggggttagggggacgatgccaacgctattggcgccatcatgttggaccatggcatcagtaacgttggtatcgcgaaaatagttattcttagaataagttttttaggaatctatttgtagagttaattttctaa

SEQ ID NO: 7161 - DNA, 1501 bp, Oryza sativa
tttactaaaataggaaaataatgcggtgtcaaaaaaggaaacgtggagggagggagaggggaggggtggcgattagcgatcgatcgcgcattagagtttccggaacggcaacctatgttgggctgaagcagattattggccattgactgggctatgctgtttatggtccagtttggcactacgtagtctagtttaggtaataagtctaattagcatcccacatctttgctcccaattgaattgcctccctgaactataaaaccggatatgacgtctcttccaactacgaaacccgatgcaaatcgactccttcagtggtttgagaagtggtttttactaacatggcaagtttactcgctgagtcaacaagggaacccacatgtaagcaattctcctctcttcccttctctcttagggatcacttatacatttgtcgacaaatttccttttaaaaatttgacaaatgtaattatggtacaatcgggatgtaattatactaacttgcgtgtaactacaatataacttgtatgtgactttcaaaaatctctccgtaacatgctattttggtgaaacggaggttgtggaaatgaattctcttacatgtgtgcgtgatgtgacattttctccttcctcacttgcacaaatcttgaaataaatctaacgattcaaaattatgtgaaagttacatacaagttacattgcggttgcatgcaagttacagtgtaattacactacgattatactataattacatctatgaaatttttaggagcaaatttgtcgacaaatatatagcaaaattgtctctcttaaagacagttttagtaggtgggatccactcgctaagttactaaggccagttttagttgacgtatcacctatgtaaaagtggcactggaagaaaataaaaaaagaacaaaaaaacataaatgagacccacctgtcatgtaaaaataaaacaaatatgatgggcttaagaaatctgatattgtgtcattgtcacaagtgggttttgttgaaatgtcacttcataaaaatatcattcttaagccatggctggattatgtttcttatgccactcatggatcctcacgcgtactagtattatctacatgctttaattaggcccaactcatttatgtgccaaaacgtccattgctggctattctagttcttctcaagaaaaaaataatgaaaaaaaaatcacatatgaaaattacactgagagaataaaatatacaatctttatatggagggaaaaatgtacagacacgaaagcatatagaaatcataaatatcttaataagaaagttgatgtacaacattggtagttgtttcaaaaacttttaaatataactacttcctccgttttatttatattataagataccttaacttttttctggatcaaactttctaagtttgattgtatttataaaaaaaattagtaactctataacaccaaatcaatttcattaaacctaacatttaatttattttg

SEQ ID NO: 7162 - DNA, 573 bp, Oryza sativa
agaaggaaagagaggaggaggaagaagggaaggagagggatgatgacatgtgggtcccatatgtcagtgggtcccataatcctttttttaatgacatatgggtcccacatattttttaattttttattctaatgccacgtaggacaccgccacgtaggcgccatgtcagctaaaactatctccaaaaccaccgagggatattgtttactccggtattgataattggaggatacccggttttgtggttggaggacatgaatcatactcggacaatagttgagggagtgaaaagtatactttttccataccagtatgactagtggtccaatagacatcggtctttatgggctcaaattaactgggctttgctgtaatgtgtactcctacttgtttgggactttggttcctttagtcagatcgagaacaaactccatgttgtagtgtgagctgcgaatgacagaatcaaacacatgtactgtaactctctgagacattattgggagcaacaggagcttgagaataccttttacttttgtagcagtttgcatttcgcagttactgctttaagcacaa

SEQ ID NO: 7163 - DNA, 180 bp, Oryza sativa
ggcgcctcgccaggctcgcggcggtggagaccgaggtcgcggagcgcgaggcgtactgctacgcgcgggggaggggcggcgtggcgggtgcgccgctgtggacggtgcccgaggtggcttcgccgcgggaggacgaagaggaggaggaggaggaggaggccgcggcggtggagttggaaa

SEQ ID NO: 7164 - DNA, 1501 bp, Oryza sativa
aagctgagacggacgagagaaattactcttttctctggtagtgcgtgattgcgacattgttgccgcgtgaaaataactttcggcgtggactatttggatcaaattagttgcgcgccacgggattgcgggttccaaaacactaccgcgtgacggggagagggcggtgctgcacaacgggcatgtggtagcaggaccgcctcggttttgtgcaatggggacacgggactgtatcagtgctgctcttctgagccgtgggacttggcgctgctcgggtgtcattcttaaccggcccgcccgcctgtcccgcacgtccacgccgtaattatgttgctctcccgcgtctccattatgtgttagaggtatatttgtgctaaatctttccattaaggtatataaactcaaattattaaaaaaaagggggtatattcccaaaaaataaattccacaaagcaactcaacccaattgatagttctccccctctttcatctaaacttgtaatattctgtgaaatctatactccgtcccagtatagcggtcgttttaccccgtagcagatgtcccagaaagcttgacgcatccaagttccagcagcgataagtacttgaaaaaaagaagtcccagcagcgagaagtactctagaaaaaagaagtgggcccatctagtaccgtgggtggcgtgggatttttctcctccacatgagatttttctgattgtgtgtcaattctctgcatgttgaaatgactacatgcagctgccagctaatgatttgggggtgttttggtcattttctcctaaagcaaatttgtgtcagtgattctcggacgaccactatactgggactgagggagtactagctaatgtcatgtcggatattgcctgtccgcatgcttgactcctgagaatgtaggaagacaaggtcaacatagcagccggaacagtagctacactgtgatgagcaattggaatactgacgcaatcagttagcatgtagctcgtcagggaagggaggagccaatcgctttcctaacactaagcggccattagcgttcagcatgaggcagtaatcttgggcttttcaaacgtgtgggacgatattaaagatcgaactgggcaatattaatttggtcactggggtgttttgcgctgacaaatgatgcatgccatcatccaaaataaactagaggaagattggtccatatgtatgtatgcacttttattttatgttccaaaattttgatgcaaaagaagcagtttttgaaacctggaagtggttttaacaacttgaacactcttccaatacacgacaagacggtcacacgtgctgcacggtggccgtccaaatcaggtctaagaaaacagaggtgagacgaaagtgccatcaaaatcaaaccacattcccattcaccagacgccgtaaattgttttctacggccgtaaattggtttctacttgctccttgcgagggtcaccgtccagccatccatccaactgacagaacag

SEQ ID NO: 7165 - DNA, 1501 bp, Oryza sativa
tctcggaaggctttttgcacttcaagcagaccattccgggtttcaggtgtgcctccactctgcaagtatagacaaacataaaatttgcaaaagaagcagggagaagagagggtgaataaggaaaaacaagcgtgatatcaaccttagaaataacaattacaagagtagatgcaagctctggtcctagttgagcaatttgatggtcgattccagcaggatcagtgttgtcaataaatcgtatctgagacatcaaacagaacaaaaggtgaggttatagctacatgagaaacaccaaaatctacaaaggggcaaatgagatcgaagcacattgcatggatataaaagtaggggcgcaccttcaatggagggttatcaggtgcaagtgcctctgaaacaaattgaggccccaaagctgatcctccaattcctattgagagtatttgagtaaatcggccagctggagatgacggaggtttaatctacatttgcaccaaatcactttgttaatagtgtttctcaagatcaaaaaagaagtagcaagagcctgcataagcaaaactcgactggcgtctatctattgaacaatgcacattccccagtacccatttcatggtaatcaccaaaacataggtggctccttttcttcacccttgagcacacagcttactaagcttaaaaccgcactaattttaccacaatatgctaatagggtttcgtttgcttatttgctattagccgccagaaattaagctttttttatagtagcagtagcagaactagagatatcaaattagtaacacgtgaaaatcatctaatttcagcgagtccagactcctaacagcaacaatttttagcatctcgagcaaatggaaacttctgcaatcaccttgccggagacgacgtcttgggagaaggcgaggatgcggtcgagggtggtctcgatcttggtgcggaggaaggagttgggggcgaggcctgggtcgcggagccagtaatggccaaccatgcggccctcgtcggggttggcgatggcccccttctcgagctcccgcatcgccgcgaaggcgcgctgcatccgcggctccatccggcggaggaactcctccgtgaaccccatccggctcacgtccacgaacaggccgagctccttgtgctggtacagccactccacgtacctctcccacagcttgatcgggtccttctccaccgcgccgcgggtgctgccgttctgccccggcctggaggcgagcggcgccgccggggtagaggagggctgctgctccgacgaggacgaggaggagcgggagaggtccgcgatggagtggggggcgcggaggcggaggtgggaggggcggaggaggagctgccgccgcagccgcagcctgcacgccgccgacgaggacggaggcgccgccgcgccggagatggacgccatcgcggccgccgccgccgccggagtctcacccggtagtgctcgctcccgctctcctacacgagctca

SEQ ID NO: 7166 - DNA, 1501 bp, Oryza sativa
ctgctgcatgtagcattaggaacacccacacacccaccagtaatatctgaagcacatataaaaccaaacgaaaaaaaatactttctccgtcctataataattatatttatagggtttaatttatcataaaatagttattacaatatagtactaattgttatattaatcacttctcatttaaatttctctccattctatcctcaaccatcctcacttttatctatacgtcatttaataagaaacatcatattctttattctcaaactttaatataggtcaaataatctagaattaaaattattttggaacagaggtagtatgataatataaaaagtttacacttacagcccctatattagacacgtacaccactgcacatgcacgacacactctgcacaagtacacatcatgttcgtccggataaaacaaagaaaaaacaggatgagatagttactgtaatattcattgggatatttcataaatttcattaaagagaatatgaagagcataataaagaaaattttaagaaattttcttctaggcaaaatcatgttgcttcttccttgatacctgctgtcgaaagacaactgcgtcacatcgaaagatatggttcactcactgagttgagtggaatagtaaaagtaatatattaattggtaagaaatttttgggatcccccattacatagccctatggtgctatttatagccttagtacacactgacactttatagggtttaatttatacagtggaatttacatggtacccttatgatagggactttagtgagggcatacagtatcctttgtattcataagcttataagtgaactcctaggctggcccattactgacgaaaggcctccatgggccacggtgttttccaagccctctgccgtaaccgcttctaaccagagcaaaaccttcctgcttcgctctacggtcttcgcccgtagtgaaggcttgttaggatgatgggcttggtggcgaacccctcggtcttcatcatctagcttcgccagctgcttcgcctcatggactcagccaacacctcacggttcttgtggtttcggcaggcccaggcgaaggccctcgtgacatgcctccaacaataccaccttgcaaaattgacgtttttaggcctttgaaaaggtagtaaaaagcagcgaaggaaatatattccaggttcaacacaacattcagtgtaacaccgcattcagagtgaaacattcgcgtgacatatgcctccaacaataccaccttgcgaaattgacgttttgaggcctttgagaaggtagtaaaaagcaacgaaggaaatatattccaggttcaacacaaacattcagtgtaacacagcattcagagtgaaacattcgctgcgaaatgcacagaaacagtacatttctagcaatcacaattcgatcagggattcaccgcaaaaggagaaattggctgtatagatacgtctagctgtataaaggactggaaggtctacacagat

SEQ ID NO: 7167 - DNA, 325 bp, Oryza sativa
cttttagcattcaaaattgtcccaaaatataacttctcccgctgcattctcttctctaccaatcacaaccttccaccattcaaattctccgcctatcgcctcctcttctcaaccaatcacaaccttccccatttatttccacctactttcttaatacccgtgactaactccaaaaatccttatattctgggacagaagtagtaattattttagtttccatagcaaacatgcagcaaatttgtcgctttcttgcttaactgagaataactagagactcactttattggtcaggccctttttggaggaaatgcttgtgctgaaaagc

SEQ ID NO: 7168 - DNA, 1501 bp, Oryza sativa
catcatctctccgaagcttctcatctcctctccactcctcctcctcctcctccccctcgccacctcccacgcgctgccacgccggcgacacgaccactgcctccccccgcgcgggcgcgccaagcgccgggatcccgctgctgcgttccagttcgcggccggggcgtagtaaccacaggtgaggtttccttttgggcggttgcggctgcgttttttttttctctctgagaattgtggtgcgcccccgccctacgcgggggatcggtgaattggatgcgctttgtcttcctgatggccgctgcgagggaaaagtgggatctttttgttgttgttctactgatttgatttttgcggggggggggggggggggggcgttctgtcctgtttgcgtagtgagtagagttcacgctgatggtggtggggaaggggaatggaacggatgagttgccagaattttgggaatcggggggcggttggcattggtctagttgggttagttttacttgcttcgttagctggattgttaaagctccaaacttttcatggctcttctgctcagtttgagcctgtatggtgtagttcaggaggtgtgttttgccgtgggttggttagagaatttgatgagcctggaatcgacgtaatgaatattggtctctcttgctccagaagaactccgaatctgttgccttgatggcacgtgaattttcagttgataaagttggagtttcatcatggatttgtgtggtaacttgcgggataaagtaagtttcagttcgttttagaagttgaatttctctatcctactttatgagagattctaagagttttctcgttttgctctgaatttatctgtatatgaggacttttaggggggggggggggatgaccaatttcttgaaaaacctattgtttaattggagctgttcatttctagttcccaattttcagtaaatgcgttcttagcaagtgattgcttgataccacgatgataccccgcaaatgcatcctctccgtaattcaggatcatatgatgttaaattgttaatcactagttctttcccagtatgtgagttcctttttttgttcttctctgtaaatttagcccttgtttgtgtcacagtctctcagagttctagaattcacactactgataccgaatcttgagcacagtcagtttgactgtttgagcattacgtatgaatctgtttctacaacgatgtatgtaatgataatgatgattgtaatttgtaattgatgcagtatatatagactaacatacagagctgctgatgaaacattagcttatctttcttgccagcttaatcaactctttgataccatctaatagcaaactccctttatataaaatacagacacaaagttacacagttgaccattatttcataccaaaatagcttccccaaatactatcttttatctgcagtgcatgcccgtaactttttgtttcttgtgaatttcagcagtgcaatacaccttaaaa

SEQ ID NO: 7169 - DNA, 1501 bp, Oryza sativa
tacttttgataataaaacaagtcacaaataaaataaataataattctatttttttaataaaacgaatgatcaaacattaaaaaaaaactcaaagcgacaaataatatggaacggaggtagtagctgtttaatttgtggtccttcatccttgtgtgctaaggctaatacaccatgcatgcaactaacatcaaggacatgtatggtagtcctgtggtgaggagaattgcagttattttgcaatgttagatttttttgcttgttctaatctgccacctattattgattaataggtagtaggtatcttcactaattgtgcgtctctctgtcctagcttaggttcacaaaggtagatgggagtaggtgctatgacttatgaggagtaggttcaaggtttgtcttcccaactgagcatttgtaccaattgaactttgccaaatgatgcacctctatctctatggctaccgttattttactgggttttgctttcgggaaatattggagttggaaacaaaaccatataggtagttccaatgtctctgtgaaacatgacaaaaaaaatcgatagaagtcatcttttgtttatcttgatttcccaaatgctgatattttcccttcctatgtaaattgagacttggaactataaataagcacaacaatgaacctaatgtagaactttttagataatggattgaaaagcattattgttgttgaagtatactgtacaagtccaagctttggatgaaactagcttatacacttgtaacaaaatatggcatcagggttagaggtataccccgctcaattcctggccagtgaaatcaaataaaggaaagaaaaatctaggagttaattttcaaaactaggtgtagatattttaagcgataactggttttactaggaggataatgcatggatatactttcattttctcattaattctcggtgctaattaaaagtaacttcattgtgattcgattcctaggaagtcgtcataccaattttcaagcttcctcttagctacaaatgttataaaaccggctctgaaattcacaccggaaaacgtcataggagatccaaacatgatgatgacaccgaagcacgatatttggtaacggagttcagccgtagcctacatatcagggacactgaaacaaattcgttgtaagggtgcacctaagaaatttctagagcttggacgaaactttgggtaaatgtagtatcctttctgaacgcagctcctccctcttttccaccatgcatcagttatcccactcagatgcctagagtcactagtctttcggcctcatcttttagcttatgtttatgcttataagccaaaatttaaatttttaactttaaatttggagttgattttagggttttttttttcatcgtagtttattttcagcctttgcttttatatcgctaagaacacgtatataaaagttttatttataaatcattttccatttataaatatgttgtttctcttattccatca

SEQ ID NO: 7170 - DNA, 1501 bp, Oryza sativa
actttacacccctaatctaaacaccccttagttttgtttgtgccgagaaaccatatgcttcatcccaattacatctttttatgtatgataataattgctactccctccgtcccagaatataaagagttttagagttggacacgattattataaaagtaggaagaattaaataggaaggggttgtgattggttgagaagtgaaggtaggtaagaaaagtgaatggtggagggttgtgattggttgagaaatgaatgttgatgaagaaattgttatattttgagacaaattctaggtgttaaaagttattatattttagacagaggtattactttactttcgatgatagccaatggattaacgttcaaacctcaaaccaaacaacttgaagcaactcctcgacatataatcagagagatataagtccctaacaggtgagatgtccacccctacagtatggccccatgcgtcagagagcataggcctacttcttctgtcccacaaaaaataaatctaaaccaggatgtgacatattctattacaacaaatctggatagagatatgtttagattcgtagtactaggatgtatcacatccagttctagattggttttttatgggacggagggagtacatcctaatcataggtattcaagtgaatacccacatatatttcttaaaagtttagctatactactgacttgctgaacttgtagttgttgttgcccggttagttaacccgtgaatcttagctagtggtgaagccttagttcctgtttgggaagcttgttctagctgcagcttttcccaaaaactgcttatgttagaagctaccctaaacagtccatagtttctgagaatctatagttacagattttgaaaaatgaaataagaagccagaagctgggtttcagagtttttctagattctcagaagctggctattaaacagctgcttctcagaatttaaaactccctaaacaggcccttagattctcagcaacgccttgcttttttttacagtgattgttttctcctattttcctttttcttttgcaagacaatttttttttgaaaaatacatctatcatgtcttaaaatcatggtaagctaacaagataattcatcttctactatatttttctgtactttattatctacctaattaaaaaaaacacacatatttccgttagtaacacaagcgtttattgtttcaatttcatagtgtaaatcttgaatacccacactctcaaaatcctgcgtccaccaatattattagagggacaagttcatgtgatgtacaaacccgtcgacaacttactgtgccgatttcttcttcgtccactcgagtgatgaatgcaggttactatcaaacttaacattgcaggattagctgatataagacaaaaccctgtaaaactacaatacaaactaagcggccggccgaatgaccccacagctctctaatgcgtggattagctgctcgatcaactcaaatgacagt

SEQ ID NO: 7171 - DNA, 328 bp, Oryza sativa
agggaacattgtcttgtctacaagtggttactcatctccagctactcgatctgtcggcatcagataaaatctcgcacaccaatcgtcactcatcaacacaaagcaggagaagtgaagatcactctctctcgtttacaattagccatatagcatcctcttgcatatagctaatagttgcatcgatccagacgaagatatatatagatggagctaagctatagcatggcaatggcatgttgctttgttctcaagacagcatcactgacaggtccctctagtaaaaccctagctgcgcctgactacgaggcgcatgggcgggaggcattaa

SEQ ID NO: 7172 - DNA, 1108 bp, Oryza sativa
tattttttgccttgcttaggaaaaggggatattaatttgcaacaaatcatctttttaggatggaatctcaaagggtgatatttgcagcaggtttttacaaatttcccctaaaaaactggaagcgtaataagaggtttagacaatacatacttagatgtgtcagcgcacttaattatacccttatttacaaattattactccctccgtcttagaataagttaatttagtactggatatgatacatcctgctcctgtacagattattctcagatggagttagtagtttataaggatgtttgcatcttttaagaaacatagtacaactgtatttgctcatatatacgcatgcacacttatccctagggatacacacatatacaccttgcaaaatagtacaaacatatttattaacatatatgtgtggatacttatccctataaatacacacacatacatgcatacctatccctataaatacacaacatacacccctacccctatgaaaatcttcgagagattggaccggcacatcttgatatattttgagattaattaagtcaccataaatatctctgtcaacgagtaaacctaccactgataaaataattagccgtaaaatacgagatcacccatgttgcgtttaaaacttgaattcagctaaacagtgacagagctggacagaaaatcaaaggggggccagccggcttttgacagttcaaaaaattagcattttctctttttttttcatgcattggcaatacataaaagccaatagtttgcaaactcgacgacaaagatcagcaacagatgtcagattttaaaatttaggattggtgggtacatcaagttcatagtgacgtaattgacatctcaaattggcttcctcttgttctaaaaaatcagcaggatagaactttgaagctagagagcacactttatcaatgttgaatgaactgaatgaatcacttggatcaaagatatacacaaagtgaaaagctctgttgtttgttcactgaatctcctatgatatatggggataataaaaaattttgtttttattgggaggggccatggcccctgccagccccctcagttccgccactgcagc

SEQ ID NO: 7173 - DNA, 1463 bp, Oryza sativa
cctgcaccccctcccctctttttaacaacgacgattggaagtggagaatgtctccttggaaaccaagcatatttttgttcgaaaaagatttatggaatcaaattacatcaattacaagttattatgcctggttggaaccccaccaaaaagttctagtaaggtcaaagatctattcgcaaacatatgtatagtgtggagggggattctcttacataatactctctccatttcgaaatgtttgacactgttgactttttagcacatgtttgaccgttcgtcttattcaaaaacttttgtgagatatgtaaaattatatgcctatataaaaatatatttaacaataaatcaaatgataggaaaagaattaataattacttaaattttttgaataagacgaacggtcaaatatgtgataaaaagtcaacggcgtcaaacatttggaaacggtgggagtaacttttatcagtctcaatcccagtgcctattctagaggtatttttaggatggtcctttgatcatcatccattttggcataggagtatcccatctttcaaatcctccgaagatttttgataaaatagatgcaattttgatattacgcaatttcaaagtatgagatagaaccacgcaacgaaaattcctggagctgccactacccaatccatatagtgtgtgtgcatcttccttgtaattggaaaaaataacttggggaagacataagcccctaagagtgctaatctcttcgtccaagtgtaacatatgtaattgttcaaatgctcattcccaactaatccagaattactgccatacaactatccccactcttataactggcattaacatgggggcaaagcacaatctcatggaaatccttcatgcaactctccaaatccatgtacctccctattatgcacacgagcaacccaagtgaacaattcctgtaacattgaatttcatgcacgcatcatgcataccacaaatcatgtgtttttcttgtttcaaatggaccttcgagttagaatctacggaaacaaatagaaaaccgatagtcacctaaatccttccaagttccaacagagcatgtgaccatgtggagaccattacaccataccaacagggggaaaaaaagaaggaaaaacgtgcaaacaaagaattatcagaactattaatgagagctattcatatgtccatcacatgggattacttacttacacggcactgggacagcgaaggcccccaccagcgaaaaagagaagcacatcaaagcctgtctaatcaatgagattttgtgtgcttataaattatctatcgttaatataggagcatcatttcgtccaactggcagatacacgatattttgatgaaagcattaattgctgaagcagcatggatgagcacaaatgtctcagaacatttggagcaatggaataagacaattagttgagttgcatggcataactcca

SEQ ID NO: 7174 - DNA, 1501 bp, Oryza sativa
tgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcctgttgggtgatttccggtcgtgacatgagaggagcttgtggtgtcctggtcgaccgaaccctgggccccatctcctggcttctcctttggcagggtcactgactggtgagccatggtgacggttatggcagttatgacccgttccatggtggtttcacctgacttgtgggcccttcaatccgtgtacttgcgtctgattgaccggaagtgtgtttcctcgcatgataggtgtgttttatccttaaaatacctgcatacacatatttcaccaacactagtggaattgattagtaataatccctaccactaagttggataccatgttttatttcattatatgcaggtattgacggtcaaatattatgatttaaggaccatcaacaaccaccccatttatttctctctctctctttatctcctctcctcttctctctctttgttctctcctctcttctcgctgacagcgggaatgggtgcatggcgatggcgtcggcgggcggcgagggcagcggatccggcagcgctgtcctcgggagggctggattcgtcgccctagggaggagttcggcgctcgacggcggacggcgggcacggcgatagcctgcggcggcggatccggcgacgccgtcctcgggagggccggatccgccgccctagggaggagctcggtgctaggcggcgggcggcgggcacggcaacgccttgcggcagcggatcaggcggcggtgtcctcgagagggccggatctgccgccctacggtggagctctgcgctcggcggcgggcacggcgacgtggcggtggatcgggcagcgccatcctcgagagggccggatctgccgccctacggtggagctcggcgctcggcgctcggcggcggatctgggggcggcggtggcagcggcggtctcgggcgatagcggcggcgacggtgacgatgggagcggaagcggcggctgagacgagctcgggcggggggcggcactaggttttttttcgtttttttatttttggaatttattgtttattgcgattttttctctttgcatacggtcggcttaaacgcctgcatgtgaaaattggattttcgcatgcgggtgccctggccacatgcaaagatttacattttcgcagacgatttggcgcatgcgagaatcgctctggcccgtttgcaaaaaggtttctgtagtagtgtcaactcggcagcgcta

SEQ ID NO: 7175 - DNA, 1501 bp, Oryza sativa
tgaagcttctccggcacgagcaatctacggtggggcctgctatccgcgcgtatgctccttggccaatcaccacacgtacttggtcgtcgttgatccacgtctttgccgctcgccgaatacccgttcaccacgcgtctctgggaggcgcgctccacctatgcgaccttatgcgcttgtgcggcgagtatgagacaaccgcatgtcccgtacggctttcgcctccatgccctcgctgcgtcttgcatctagccaggcctcatctgcaactatcgtcttggaccatcacctggaccagcatggttcggcctccctgccaacaaggctgctagccggacgccttaccgcctccgtcttgggtcaacaagcaagagcctaattggcttgacctcctccaagccaagtcgatcagactcatgcacaagtgcatggcattgggccacgtgcacatatgcgcaacccaatcacttgcttgcatgagtacagtacacatacgctgtccaagtgcatgtatcgtctagcattgtacattactcttcgcgaatctcagacacttgcacacttgaccttgtgaatctcgttgcgaagtactactgacacggtgttcgttcatcgggcaccgccttgtactcaaccgtgtcaactggcatcctttactcttctggacctcaactcttccatgagtttagtcccgatctgccgttgacctagagagacctccaaggatcctgacgtcagtcccaccttgtcacatggcctcttgactgcgtcggacctccgttcctccctgagcatagtcccggtcctcgccattgaccaaggttgacttcgatcacctgcacacacacgtaaacaaaacgcccgttgttcgggcatagatatcacaaccttactcgtgttagtcagcacacatttcttgcacttccgacactcgccaattttccatcacaataaatcaaaaccacaatttgtttcacaatctcccccttgatggaaacattggcaacttcaagcaaaattttgaaaatttgattttgctccacaaagcaaataatattgcaagtcaaacttggttatttgaagagattgaaaaatcaagaccaagtgacagataaggatgcaaatgcaagcaagtgcgtgcggtgattggccgaggaggcgttcgcgcgaatcacgggttcaccctggagtgcgtgcgcatgagaagcttcggctcgtttggacatctgagatatttcctttgaggagaaggaacaacggatggcctagatttcatctgagctatgggttttgccccaagggcaattttgacattatcttagggggatttcatccatcttgggctataaatagagaggtggatgttagggtgagtaggctccctttggagccctttggagtagtcccttagagtcactttgccggcccatttgcccatgggtgtgtacctctttatgagagatgtccttttgggcttttgaagtttaaattcaaaaccacaagt

SEQ ID NO: 7176 - DNA, 1501 bp, Oryza sativa
atctcgcatatatcatagtaccaacgatccccatactacacaaataccggaatcgcgacatcaaacgtcgatattttgcaagtagtctatgtttaatactccaaattaatgttcaaacattcgatgtgacagggagtaaagtttagtctctggatccaaacaccacctaaacaccccctgaacagtaaacagtaaacaccggctaaaaaactatgatggtgcgctaaaatttattcactccaggaaccgctaatcccatccacaatttccccgtctcccttccttgcggcggcgtccaacgaaacgaagcccaataaccgtgttgttctcaagcctcgcgtagcaagcaaagcatgcgaccgccggcaaggcaaggccatcctttgcttgtgtcgtctccccatctcgccggtgccagccttacggcacggggcaacacacaaactatacaagctacgccttgcccttgcttgcatccttcctgcctctcccatatctgaacccatccatgatgcagtagcgatcagatcacctgcctcgctcgcttcgtcgcttccagcttcacgcagtcgcaaccaaccaaccaacaaccactccatcaaactaactctacttcgagacttgcgtcaggttaggccagggtaattaattaaatcgatgcattattagcataaatattgcttttttcctccatgatcttagctcttaagattgttagattattattagcattttatagtacagccagttgttgttgagctttcagtcttagtacattcaattattgctggagttctagttttttttttactgcaaagtggagtactacaaaataatcttgtctttgcttacactttctcctccatcatgcgctcatggccatccattttcttcttcttctttttttttttgcatcaaattgtttcgtttacttagcgactaatcatcgctctcaggtcaggaggaaggaaagaagcagcgacgccgacgcgctagcacgcgagaggcgagacgcggagagttgacacggtgtcatttattgcgaccccagataggcggaaaattgattaaagtttgatgaaatagtcgctcacgtggcacgcgtgcacgcccatcccaaattaaaaataaatactccttagaaattttggcacaaaattccaaaaaaaaaacagaggcagaaaattaagggcgaaggaaaccaagtcaaacccagcacaggaaattccggaaatgcagggaaattgagttactgtaaagggaaaaaaaagaacagttcaaaatcaaatcaaatcaaatttgaatcaaaatctagccaagatttgtatatatagcgaggcgatgaggaggtggaagaggaagctgggccgcactctcacccgcttcctctccaagccccctttcaagcccaagcccaccaacccctcgccgccgccgcccccgccgccgccggggatccagcctcctccaccggcgctgcccggcatgccgcacggacgcc

SEQ ID NO: 7177 - DNA, 1501 bp, Oryza sativa
aaggtcaacggcgtaatatttagggacggagggagttaattctttttctatcatttgattcattgttaaatatacttttatgtatatatatatagttttacatatattacaaaagttttttaataagacgaacgtttaaaaagatcaacggcgtaatatttaggaacggaggagtatgaaccatcaaatcccaaatgtgcccggcccatacagacccatcaaaagcccaacaccttcccacccaaagtccatccaggcccacaaaagacccaccacctccctctccctctcccgagtcgtccccttcctcgtctccggctcctccccctatccaatccccccctctcgccatccacgccgccctcctcctcctcccgccgccgccggagatgcaggcgacggccgcgctcttcctcgtccgcccgctcccgcgtccccactaccggtgagcgcgcccacgtgcccctcgaaacccttttccgcccctcctcccccggctcgcgtctctcctcctccgcgactgacgacgagctccccctgccggcccctctgtgggggttctccggtgcgcgcgttttccccattgtgtgcaggtgcttgcatgggttgcggggaggcgtctcgctggccccgccgcggcggcggctggtggcgcggggcccgcggtgctccatgagcctctccatcggcggcggcgcgggcgcgggcgccggcggggaccgcgggttcagctacggtaaggaagggggagggagatgcccgaaccctagcgatgctctctcgatgtctcagctgatttgtgttgttctgcgtggtctctgggttgcagagtgataatgcctgtttagctgctgcgatgaactgatcgtattggctgtgtggtgatcccatttattggattaccgatttcataatttgtgccatgaacacaatggagatgcttggtagcacaggctgagcatgcctggttcatgcctagtggagaaatatacaggattagctagggaattaacgtgtctattaccatactttatgcttagaaatttctagtgaaatgatttcaggaaggagagatgcatatgccttatggtgatatagcggcatttctagaattatgatggcgcagatgctggcatggtgatttggtactaatgctaaatcttgtttgttgggttctctaagctgaaagagggaatgctcttctatgggtttggttagacaagatatcaagtggtgccaattagttttcttgtgtaaatctgaagttctgaaccgatgatatccattgtattgatgtttatcaacagtgtctcataaattacgatattatttttatgattatttaatcaatgtcaaacttgttctgtgcatgagtttcttgtccttgcactaggaataaaaggtaatagaaagataactttcgttcatttatcttgataacccatataggtttgcatctaggtttcccacttcccacagattatttgcttgctacttgggg

SEQ ID NO: 7178 - DNA, 965 bp, Oryza sativa
ccgcaccgggcgaccggccaacagcattatcgtattattatcaacacaagtgtatcaaattttagtaattctgaaacttcctactctcaatacttccaaaaaaatatggtaagttattaaactaaacatcagccatccatatcctatcttaccaaaaatttattttgtattatctggcaggaatttttttggggtaattaagtaaacaagtcctaaatataaaggatggagtaaactttggactcaattctctatctctatccctatccctatccctactattataaaaattaaagatgtttttatcgatacttcgatacgtcattcttgtatgagtatgtttttaaattcgtttgcatttataaatacatatatgcatttagttggtttttaagctcattcgcttttgaaaatacataaggagttatataagaaattttctttaaaaaaactcacgtgctaacttgagacgataactacagctcatgatttttttaaaagaaaatatccaaaatttcaccttaactaaaccaataccttcagttgcaacgggcattttttagtctttttataaacccgattattgggaaatcaaattttagagttacgagaaaatacttcagttgcaacgggcattttttagtctttttataaatccgattattgggaaatcaaattttagagttacgagaaactctctccgagtacacgtggaacacgtgtaccccaaaactgcaccgtgtcaatgcagttgttgtccgttccggaacagaaaagcgaaacgcgaagccgataccgagttaaacagagttttgccggtatacgtatcccctatttaagggctcctatcgtaacgtgatacactcaaccgaatcttaacgagctttttccccgtagagataacccgagattttagtttgcgactccggaatcgtctcgtcgtcgatagttgagcaaacaaacca

SEQ ID NO: 7179 - DNA, 1501 bp, Oryza sativa
tatagttttacacatttcacaaaagttttttaataagacaaacggtcaaacatgtttaaaaaagtcaacggcgtcaaacatttagggaaggagggagtacaaaccaaaccaatatactactagtacaagccctattcttcttcttgcatagtgagtgacattggcaggtggggtccctgttgctgttcaagtgtaccaccattcacagtgcaggtacgtggctttagcttcgttgggacacgtaggagaaaatctggcgtgtttgtgcgagccggaacgcccttcaggaggatgcgcacggcccacctgcgtttgaggtcagacgacacgagacacgcatcccgcattggcgggtcatcccctctccacttcgtcatctcgcctcgcacgcgctccctcgtcccaaaattgctttggctcagcctgcactatgtgagttgtggcttggcacctagagaaactcaatagtgttgcttgcactgctattgcctttatgtgtgttgtggtagtattctggaggggggcatatgcttttcatgcaatgctgaaaagtttttggaggttaattgctgataagtcctattggagaagatactaacacattggacatctccaaagaatattcaggaagcagccggtgaaatgtggtcaatgtaccttcaatactctttaacaacttccaccacactttgtaggctcctccagttagcatacaccctggactcaaaatttttagccctattttagttgcaaaactatccttttaccattatgaagttgtggatgtatatatataccttcgtaaatagggttcaaattataatatccataattaaataacatatatatacacacacacattacggttgatatagaggtcggaagaaacttctgttacgtagaaaacaatatggcttgtgaggatcggcggagggtaggatgtcgccgcccgctgccgcagccgtggcccgcgagacgggaagaggaggagagggcaggggggctgctgctgccgccacccaccgccgccgccgcggcccgcaagaggggaaggggaggaggccaggagagccgctgccactgccgacgccagccgctcgccaccgcggcccgcgagaggggaaggggaggagggcaggggggccgctgccactgccgacgcccgccgccgccactgcgggacaccggctgctaccgccgcggcccgcgatagggaaaggggaggaggggatcagaggagagggaggaggagtggaggaggagggtgtgaggagatagagataagggagatagagtgtgggaggcgtgcggcagcggtttccgaggagataacggtgagtgggaggtgagcggcagcgttttttttttaaattttggtcctgatttgttacacttacacttagatctttagtctcggttggtattacaaaccaggaatcccctcccccgccccccgcgacaatctttagtcccattggagttttaaaccaaactaaaaaaa

SEQ ID NO: 7180 - DNA, 634 bp, Oryza sativa
cttgctagctagggggtgtttagatggggctaaatttttagtccatgtcacatcggatgtttggacgctaatttggagtattatacatagactaataaaaaaactaatttcataaatgagagtaatctgcgagacgaattttttaagcctaattaatccataattatgaaaagtttattgtagcatcacattgtcaaatcatggcgtaattagactcaaaagtctcgtgaattagtccaaggttatggaatgagttttgtaattagtgtatgtttaatatttcaaattagtatccaaacatctgatgtgacaagaacttggaataagtccctccttcccaaacagaccccgcccgtacacattttcaactactcgtacaatagagtactattgtgacaacgaaaattcatgtcatctcagacaatacctcaactttcttcgaggatggtctatttatgtgttaatttttttttgcaagggtttatgtttcaaaacaagttttatatgaggactaaaatgttaataatttggtatttctctcgttcacaattaagttggcactgctgaaatgccaatcttaaatcgagcactccaaatattgtgtgattatcataccgagacacgttacgcaaca

SEQ ID NO: 7181 - DNA, 1501 bp, Oryza sativa
attagtctatgattagccataaatgctacaataacccacatgtgctaatgacagattaattaggctcaaaagattcgtctcgcggtttccaggcgagttaagaaattagttttttttattagtgtccggaaaccccttccgacatccggtcaaacatccgatgtgatacccaaaaaattttcttttcacaaattaaacaagccctaaagtcactaaagtgctcactttggttggcgagctgtggagtgatagcaagtgctataatagatatgatcagtatctctaaatttatcaatgtcactcactcataaattaagaggcaacgtatagaaatattgcacctctaatacacaaataccaacaccttttaaacactcacactcactttttggagtttatgtgaaagttgcctcttgatttatgagtgactcatcatctctccttctctactctatctcatcactcaatcatatttggtatttttagaggcatcacatgaatcattatgacacttgctatgacaagagtaggatgagaagaatgatactaaaattcatcttttatgtattctaggtggtgtttttatagatgaagataaagtcggtgcatgtaaaacaagaaagtcattaatgtataattaatttagtttaattattattgatttggaaaaatatatttatttaatattttaaagcaaaacccgtatagaaaattttctatacgagaaaatagtagtacggagtacatcttaagggcccctttgaatcacaggaatgaaaaaacagaggaataggaaaaacataggattctgacaggaatgcaagtgtaaaacaggtgattccaaaacacaggaaaaatataggaatgaccgtttgattggacaacaggaaaaacacatgaatttgagaagagataaagacaaatgatttcttccatgaggttctacctcttgttaaaattcctccaaaacttgtatgggaagaggcatcccataggaatttcataggattccatatagttcatttctttgattcaaagggctttataggaaaaattcctatagaaataaaattctctaaaatttgtataaatttcctttgaatcaaatgggccaggaaaggattgggctaaattataggcggaatggaccgagaagctaaattactagcgagtcaggcactcaggctaggctggataggaaagagatgggaatcctagtcaacgcaaagatcctgaaactctgtctacaaccatgcaaacaaagaacggatacgtaggagcaatagccgtctatatagcgtagaagtagccacaacatcgcagctttgcctcccttcctacccaacacgaggcagagaggagaagctccccccgctcaactcaccaaaaccctcctcccctcgaaatccttcccaagacgccgcacgcttctccatttcatataagattcccgagagacgccgccgcccgagaggcgtgggccgcgcgcgccgaaacatat

SEQ ID NO: 7182 - DNA, 1071 bp, Oryza sativa
aaccgggaaaaaagatgcctactatctttagtcccggtgttaccaaccgggactaaagatctatttttagtcccggttggtaataccaatcggaacaaaagatcgtggcggagagtacgaggcatctgccatctgcgagatcgaggaggaggagacgggcagccttatctcttcacctcttcctccactgaccttatctcttcatcccatatcttcctcttcctcctcctcctctcctctaactcctctccttccctcccccatcatcccttcctcttcctcctctctaacttctcctctaactcctctccttccctccccatcatcccatcgggcggtgggcggcctcgcggcggggcggaggcccgggcggtggcctcgcggcggtgggcggcgctgtggcgcggcggcggaccgcggggccttgcggcgggcggcgcgctggcggccggcgcggcagcggccaacagcctgtgttttttttctttttttttttaagaatttgtgatttggatctatgtatttgatttgtgtgtgatgtttgtgaatatgtgatgtatttgtgatgaattttgtagaagttgtgatgtaattttgttttaagattttgtgatctatttgaatatggccgatttggggatttgaggattggggataatttatttgggattttgggatgggtatagagtaaaatcaatatattaaaaacacaatgaagaaaagaaaataataatagagcaatcggatatagctagctaggctagctctatctttagtcccgattggtgttaccaaccaggactaaaaaggctctatctttagtcccggttggtaacaccaaccgggactaaagatgtatttttactcccggtttttttacccgggactaaagatagtgatctttagtcccggattggtagtcccggtttgaaaaccgggactacaggggggttacgaaccgggagtaaagcccctttctccaccagtggaaggcgaggttgggtcacatcagatcagctgcctgcatcctgctgcgtacgtactcgatcgggatcgtgtccgtttcagaga

SEQ ID NO: 7183 - DNA, 1501 bp, Oryza sativa
catgtcattcttcccatgtgcagcctaagtagtttttctatgttgtactaccagaatatattgctgtaacaatctaccgctgaaactgataatactcatttacggtatgcctcgattccactagagccagcttttaattgccaagtaatgtcatcctcatttccaaaaggaaatcccatattagattgcttccttccctccttttatggagtacaactgcttatcatcatttcgaatgttttatataggatgagttgaagatcactaaccaaaagcataggcgatactcggattgtactcgttgcgcaccatgttgtcgccgttggcgtaccacgccacctcgtcccccttgttgatctctctaggactacaccacgaaacacggagacaccgtgacgaccaaaaacccaacaaagcccaggggactcccatacccacagagcgatcgaaccagcagcagcagcgcacctgaggggccggaagcggacggtgaccatgatgttctccttggcattggccgcgtccaccgccgcgacgggcggcgccctcccggccgccctcgaggaggccgacgagggcgtcgtcggcctcccggaggacggggtggtggaccgcgcgaacgccgcggagggggtggtgggccggccaccggcggacgacgacgacggggtagtgggccggccaccgccggcggcggaggaggaggaggaaggcgtcgagggtcgcccccccgacgacgtcctcgccggaggaggatgcgccgccgccgccacccccgccccgccccccgccgccgacgtgcggcgggatcggaacggggagatgctggcccgccccggcctcgacgacgacgacattgcggcggcggagccccggggtaggtaggtgcggggcggcggctagggtttgggcgagcacgaggttggtttgccgcgagctcgtgggcttctcgctttggctaggcaggcagccgtcgtcgtcttcctcggaggggcgcctgggtcaccgtggcgtcttttgtcgatttgggtttgtgccgcctttttggtgctttggtctaaaaagcgctcaagttttctgtgggggtttgggggggtttgaccaccggaggtgcgcttaccgccgtctttatcgggatcgcaacgtctaacgagcagcctcgttgttttcattttttctaaaaaaaaaaagatattcgtagtagcaacgtgttcagggaccacaggtagagtcatccacatcgttgagcttggagaacgagtagcatttgttagtgactgatatttatctacatgtgttgaaaataaaaatgcagtgaaaacataggcggctcgttcaccacatataattatcacttatttgaattagtgaaaaatagaaaatggagtgaggggttattttatattctgctggttaggttttatgggtgggtgacgagttcactgtcagggttacagataaggcatatcctctacccttagatatacgctatacagcaata

SEQ ID NO: 7184 - DNA, 1501 bp, Oryza sativa
tctacttagtgaaacaattccgatatacctagcggaacatcgtgtaatctattatatactaaaagtccattaaactttctacaaacgctcctaaaccgctacatggctcctagaaacactcccataccatcacgtggcgctctaacaaattatagaaattccaagaaaaaaacaaacatccgatcattgattttcacttcacatggtggacccatcgttttacaacattagatctatcttatatattaaaaatatattcaaaaaacccatccatatcccctccgtcatgtacatacctaggtactcctctctcctttcttccatttataggaagcaaagttttttatattaaaatatcaatctattattatatagtaaaaatccattacacttcctataaatattcttaaatcacgtggtgttcctataaatactcgtacgccgtcacatgatattgtttaatctcacggtcgattttcatttaaattgatagatccgttattttagatcactagattagatgtattatttaaaaaagtaataattccctcgtgtatattgtgggccggaatataagaaaccaaacaaaatactccgtgtacgtacgtacgtacgactggaaaataaaagatgaagcttacctactgttcctagaagaaagaaatcatacgtacggacttacgataaaaacgataaaataaaaaaaaaacatacgtaacatacgtacgtactgccattgaaaaaaaacaatggtctataacataggattttctactatttaaaaaataaaatataatactctataaacttgcgcaaatatatgtagttaaaatagatcttcaacaataaaaaaatatcctatcattaaacatcatttaaattattttaaaattatatatctaatgtgtgatcaagtcggattcctataattaaataaatattgatgtatatatacctaaatacatcataacacatgagaccgacatataataaataatgttatcataatattttaaaggaaaaaggacaaagtacccccgaattattatggtcgaccgaattacccccataaacccgaaagctacacatctttcaccctcaactattaataccgaacgaattactagttgtcttaacccggggtggttttgatcctacgtggcagtccagtcagtattttctaaaaaaaattggtgggacccacctatcatatctccccctcccctcttccccctctctcactttcttatccctccacgtttgtcaatcgacaaggctggggacgacgagcggcggggcgaaggagtatgagtggtgagtggcggacgcggctaggggcgacgagcagtggaggcggctcctcctcagcctccgctggtgcgcacctccttgacgaccgcgtggcttctccacggcctccaccggcacgcgaagaggacaacaacggcggggcggaggagcttgagtggtggaggcagcgagcggtggaggcggctcctcc

SEQ ID NO: 7185 - DNA, 1501 bp, Oryza sativa
aagcagagccgttcattcacgagggcccgtgaacaactttgctagtgcgttagttttgtccatactgtgtgctgtgctagggacgctaattggcagctattgaagctgaaatttactactcctaccagtaagaaaccttggatcaactgattattaccaggttgtactgatcttcttttgaaagaaaatggcaggaggttactaaccagtaagaaaacggtaggattaccaggctgtagtgatcgtgtttgttgataggattaccaggttgtagtgatcttttttttttttgtagaaagaaaatggcaggaggttactaaccagtaagaaaatggtatatgattaccaggttgtagtgatcttttttgttgataggattaccaggttgtaatgatcttttttgttgaaagaaaatggtaggagattactaaccagtaagaaaatggtaggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctccagtggcatcaaccacttcacacgcgcgcgccgcccgccgggaaggaagccaacgccgacgccgaca

SEQ ID NO: 7186 - DNA, 1501 bp, Oryza sativa
ctcctccgatgccccgaccgcctgcatgatggtcaggatgttggcacgatctggatcgctgcagagggggaggactccttgggggatgagggatgcctccacggagctgagattcagcacccgttggaccaccatcttgaagtcctcaggggcccagtcccatctgcccccctggtgggtcctcatgtaatcctcggacccagtgtactcccaggcgccccgggcgcgccgctggagcggcgcaatccggcgacgaaggtagtcgccgtacaccatggcccccgtgagcccctgggatcgcagacccgccaggcggtcaagaacggcgtcgtagccgtctcccagatctaccggtgcccgccagttggaggcctgcgccgggggctggctcggaagtcggaggcgcgcttcgtcagcgagggtggtgtagcaccagtcgctcttccagtcgtcccatttcttgcggaggacgcagggaatgtagcggctcagcaccggcccccgcggctgaaagtatgtcacatcctgatttttgtttcaggatttataaattatttaataaattattaatagaatttatattaaatgttcattaatttacaagtgaagttaaatgtgggaaataaaatttcttaaatataaagcatggatggatttaatttttattaaattctccatggttaattatactctctggaattttctcggatttttcggagctcaattattaatttttatcttacaaagagcagttcagcaattatttaaatattaaattaatcattaaatggtctaattataattttgttaagtactttgagtgtccaagtattttcaggatttttcttgaaattatttgagcattggaagtatttttaacaattgaaagatcatttaagtgattattttaattggaaaaagtttttaaatccttccctaagtcgttgggccgattttggcccaactctttctctctccgcgcggccgaaccggcccaatcggcccagctgcagccgagccgccctcttctctctctctgtcaaagtctgtttgtggtccctccttcaatcgggcctagcataggaaaccacacagaaaagtctagtttgcctccctgctacagtgtcgtccctaacctccagccggctgcctagctgagcccgagccgcgcgccgcgtcgcctttccgcctccaaatccgctccaatccgaccccgtttcttccggatttttgaggggttttgatcctctcatcctcctctatcttttcccccaagaatcggagcaaatcgttgggtattttatccgaattaaactcgttttcgagtttatctccaaaaccgagttttgattttcccggatcgatttcttgcgggaggagtccgatctcttcaatccaaggctataaataggaccccctagtcctcctctttcatttgccccctctcccgtcctctcccgtgacccgtagagccgtcgccaccgtgcaagccgccgccgcc

SEQ ID NO: 7187 - DNA, 1501 bp, Oryza sativa
ccaggcaatgccatgtcttgggagatgatccaatgggaaggaacacatcaaggttaaaggtgcaaaggaatacgttgaaggctaaatgatgacaacatggagaggatagtggaaagtaaactgaacataaagaaagtgaatccgagttgcttgttcgtgagagctattcccagttatgaatcaagtgatatgttcgaagataacctacagaggtcaggttaaaatcacatctaacaacgaagcctcagatttggcaggataatgattagacaataacaaatccagcagtaaagccagttgggaagacgtcaaagtatatccagtgggataagttggttctcttgggaagcataacttatagttagagtggttgaccctcgcatcgaatagcagaagtacctagcaccggagaccaggaaagctaatatgagacagttaatggcaagttgtcaatcatggtatccttagtaagcgggatatcatagtctaaagcatatggtggtaagctggaaggaaacgccaagcatggtattctcatgatgacaagcaggttacgacacatgacatgaagttgataacttgtgtgaggttgacgccgaagatatgaatcgtgagaagttccggaacggaagcatcattaaactaccgcaacctagtctgcgtcagctgaaaggtgcaccctggttcgagtcaggtgaaaagaagattccacctgcaacaggagatcgagccaagcagtccagagtggagaagttttgttaggcaagtttgttatagaagacggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggagccctcaaattttagtggaattttcagagcacaaataataattattaagaaataaacaaagttaaaatgattttgtaaaaagaaaaaccctaaaaagtcttttccccccccctccccctcttgggccggctcggcccatctccttccctctctctcctcctccccgggcccactcggcctctccccgcgcgcgcgccgctgacgggcgggcccgcccgccaccctcgctgacgggtagggcccacctgccatccctatcctcccccgctcccgccgccccgcccgcgccctagcgccgccgccgccgtgaatcccgccgcctcccgccgtccccgcgcgcattagggtggggggaattattccccgtgatcccctctctctttccccccgtttctctctctctcccgcgttcaaacgggcggatttgcccccgcaaatctcgccggcgccattga

SEQ ID NO: 7188 - DNA, 1501 bp, Oryza sativa
tattactaggttttggtatactggatgtgtttaatttaaagccttatcaaaatttggtagaattttttaagtagaaactaatagaattactaaagtttaataaggtaatgttggtaagcatacgtttggtttatcttatcaaaatttaatactccatccgttaaaaaaaaatcaacttctagagtttgaattttgtcccaaaaaaccaacttctaccctcctacctactttcagcacgtaaaacgataagttttatcccttcaataccctttatctacctatcatttttactgtttttttcaatgattaagagcattttagtcattcaccatctccactaattccaccttgggatgctagtaatgcaatttttttggacggagggagtataagattcgaagtgagaatacaatgaaggagcctaacaagcatgatggcttgatatataagatccatccaacgcatgcgcgttttatccgataatatagggtctgttcactttgatgctattttcaaccatactattttttttaagctgtcaaaaaaatatctacgtttactttattgccaaatttggtaaatacataagaaatcctggtaaaattttggcaattttaccattttgcaaaaattttggcaatggcaaaattcgataaggtttattttagctacaatctgaacatgtccattgtactataatggtatgttagcttttatgttagcttttataacatgcatgtaaattgacacgataactgatagatagtactcttttttaagtattagagtggtcttatttctcagtctcttggtcaacacaacatccacctgtttctatcccaaccattcttaccaacaactaatggaacgtttacctcgcgataaacgtatccaaaatggtcaggaagctcaatttttttttacacggcatgaaattcacttgactgaccggactagagagagatccaaagagtagatcggggcgtggagaaaaaagaagtccagatagaccccggaccccacgagtccagtcaatcgcaaacagcgcccacccacgaccacgacgaacacaaacagtaagaaccaccaacgaaaccgatctaacccaagcgaactccccactccacccgcaagcaagggtagtagactagtagtaggcgaaagaaaaaaaaaatccccccaaacgagagaagcggcagcgacgacgacgacgacggcgacagcagcagcggcggcagaagcagcagaagcaaccccctcctccgccgctccgccccatcggatcgaggccgccctagggtttcccccaggctccgcccctccgcttcccccctctccgccgcgcgcgcgcggggagccaccaaaccctaggacggcaaacccggcgcgatcgcccacggtggaggcctcgtcggcgccgagaggagccgctccgggctcgggtcggggttccggtacctcaccggcgccgcctccgggtggtgggaccggtggatggtca

SEQ ID NO: 7189 - DNA, 1501 bp, Oryza sativa
gagtattcacttacaacttctgaattctaatcatgcctccctttgcagctcacatttgaggtgctgaccttcagaagcatgatgatgactcccgagtgcaatccccaagtcggattgaatcaatgatcttgcggccttaggcatctgaccatcctgttgtacgaaacgacaatcgttaactgcgttgtatctgcaatactgttacgacacgggttatggcatctgaccatcctggtgttcataacatactatcactacctgtgatgtatctggaatatcgatacgacagacaacgattctcctgcgcgtacagcatcaactgaaaatgccagtgttagttttgctatttctaacgatttgcggaaggattttaatacattgatattccattgccggcggagtggacaggcaacggaaaacagtagcaaacttggtccgaggacaaagcatctagttttaatttgagcaattttaccatacaacatttggtatctcgaggtatcacattttacatacaaaattttgatacctcgagctggttggtaaaattgtttttttttttcagtttatcagtggctttttatggcttgcgcatgaaggtcctctcggacatgaatttgggccgagtgaatacaaatatctcaataaagtgcgtgtcactggattcaaagggtccagaggacaacttgagtttcttttgcatctcatggaaaatgcacctggactagaagtcataactgtggatacagctgaaagaatatggaaggatgaatatcataagaacgaatatctctgttctctgcaagactgcaactttgctcgtcagaccgccaaacaacatccttcgtgaagcacttccaccggccgcaaagatttccgtcctttagcatggatttgtgtaattgtttagtagtgagttcatgtgatctctctatatatatagtgttacatacctatcgatgatttgaagtttgagcaatagatgaatgctcgatttaaaatactctttggctggtgcaagtgtcatgcattttattcactagtacgaggactaaagggaagtcgtcgttgactcctctatagttggtactagctgttaactccttccgttatacggagtactagtaaaaattaacaaagatgagatacatgttaatactataaatgaaatgtgagataagtatgtccatattcatatttatagtacgcaatgtttagattcgtaatacaataatacatcttattctatattagattactaattttttttcgggaatacacaaaaggattgcgtacttttgtattaagagaagtaaagaattacagctagattactatattttgatttagattcgtagtacgaagatgtatactttctcgtattagattacttatttactttacccacgagctgctcctcgtggtctacactctggcagtggcaagcattcgcgaccttgtagggggtgtgtgacagcggacaggatagcaggaagcgcca

SEQ ID NO: 7190 - DNA, 1501 bp, Oryza sativa
atgtgttggtgcttttgacatatccttgttagcttccgtgttaagcaacataatgaaactcgatcaaattcgattggaataagattctagctagagctagagctatcaagcgatcggtcgatcactagcaacggtgaaaataacaggtactcaggctcagctggcaagcatcgtagcctctcaaggacagcctagctagtttttggaggcttggagctctccatgacaaaacaatttcttttttttaaaaaaaatctgtgatcttaaaaaaattgctaatgaatatgtccaagattatttttgacctgtacaatattttagctaaatcttgctttatcttgtagacaatatatatggtgtggattttttaaagctaagtcaaatttgattcccagatatgtactatgtagtgactctgataatacaatattccttgcatcagactctgtatcaaatggaactattaataagaacaaacaattgagcaccttatccaccaagtcagcgatgacatctacatcatatataactagagagcaatttttccaactaacaaaaggccaactgaaaggataagtttattctctatatatcttgataaaactttaggcggcgctactaaatttaggaggatggagatgtttctagctaggagcgaaaatggttttaaatagaaattgatttcaatccaaatatctacggtattcaatataagggctcctttcgacctttcggaaggataaaattttacataaatttcacaagaagcagttcaatttacgcaaaaattcctataaatcctctatatcaaatgagttctaaagctgcctgtggcgcgaaggaaaacgtagaactgtgtgcccatctctgacaaaagaattctgggtttatttttcgcgaacgcgacagaagaattctgggtaacctagtatctaccttttgatcgaccaatcaaacaacagaagtattcgatacctacactacatggccgagtttagttccaaaatttttcttcaaactttcaacttttccatcacatcgttttaattttaaccaaacttttaattttggtgtgaactaaacccacccatatgtagcgcccgttccgtcgtgacgcctagcgggaaaactatctcttaaaaatcctaattgcgaaatctgtttctttgcttgttgtctagtgtccgtgccatctcagatctcaaatcctcgatctatcatcgagttcatcccgaatccaaatccttcccaaatcaaatccctccacaaaagtctatttcgcctccctcgggttcaatgggccgaatccttcttggcccatctccccctccctccccggctctctctctctctctctctccctctcccccgctctgcccgtgcgctgcgcacgcgtgcgcgtgagccgcgccgagccgagcgccctccgccctcgctgccgtttcccgccgacgccgcccaaatcgctgcgccgcccgttgcttcccgcgcgcgcgcgcca

SEQ ID NO: 7191 - DNA, 1501 bp, Oryza sativa
attagtttttgattttatctatatttaatgctccatacatgtgtccaaagattcgatgtgatgtttttgagaaaaaaatttagtaactaaaccaggcctatgttgtatggatttcttttgaccgacaagatacaaattattagagttatcattgtagcatatattgctattcaaatatgatgtgatggctttacatgatatttatatacaactatacaagaaatgtcatacatgctacagtgaagaaagaaaaagaaaacataaaagaaaagcaccaaaatgcttagctgcgttttctgacttcgaacagaaggcgtatggtcgagatgcttgcaagttccaagagcttattatgcttactgtgtcggtgaccctttacatttttccttctttaaaatccaatcttggaagttcatgcagtacggccgtaccctgtgctgtgcatgcgcaattgcgcatacacagatacactacgttagagcatcgctaggttcaacgtttttcccattatgttggaggtaataactatggaaatatccaacccaaattccaaaataatcacacctccttttttttggtctggacaagactactgatcatgcaaaagttgcacgctgttcggctttttgcaatgccattattccgcccaaaattattttcttcctcaaatcaagaatcaagatgctctgatccatggcacaagttgcaagctgcacccttccagagtttcggtgatctgatcacacataaagcgtccctctccgtgtctcttcacgatgtgtgcatgcaggacaaatgcccgattagcgcgcagaacagggcgaggagagggcccaaccgcccaaatgctacagcaccatacgcggattagcatctttcccggtcccgtcccagttcccacacggccacacgcagcgcgacgccaattgcgatcgatcccccggcgaacgcgtgaccgcaatgcatgcatggcgcctatatcctcgatgacgagctactagcgtttgtgctgtgcatccgcgggttcgacggcggcaggtccgtggcgtgcctcgccgagacgacgacacgtcggcgcgccgcgagtgacacagatgggacgggagtcacggacaacgaggacacaaacttaggacagggagtttggtggggggtgtggtcgcgctggcacggctaaaagcgccaccagcccaccactgcgcgctctgaggcctgcggcgctgcttaaaattttccggtctctgccgatcggattgcacgtacacgcgcccggcccgggcgctcggctcgggtcccgacatctcgcgcccacagccgcgcaggggaatcgtgtcccgcatcgcgcgacgtgcctcgccccggtgccgctcgtccatgcgcgcgcgcgccacacgacggcccgcccagccgggcagccgtcgcgcggtgctctgctcggtccttcgtagctcaaaatttttcacatttcgactgattgatagctcgtgttcgttcgacacat

SEQ ID NO: 7192 - DNA, 756 bp, Oryza sativa
aaggaggccgggtgaacttcgggagtaggagggaggagcgggccggcgcgggaggaaatgggccgggcccaagaaaaagaaaaaaggagggaaaagaaaagataaaaggaaaaaggattttcccagggatttaatattgcactttgcttattttaattggttaaaattatttccaaggctctgaaaattccactaaaaatcctgttagcatattttgacatgtagaatccaagagaaattctacatgtcgattccgattattatttgcatttattaattagggattcatctctaggttaaattaaacaatttcttcgaacgatttattttatgaatttagagcaagggaggggaacttcagggcgtgacaccaaccgaccccgccccggcgttcccaactattggcatgcgaggtttccctgaaccgactagttacttagacagggtgtcccattccaccttgtggttgcactttgattatgttcgatgagtttcccacaggaatcggtccttatatgcgaatacgggacagtgccacataggcacaacccccgcatcgcgagttttcacaattcattttgttttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacgga

SEQ ID NO: 7193 - DNA, 1501 bp, Oryza sativa
aatactttcttgaatatgggttcctggattgtgaataatggggaacaaactagattttgggaagataaatggatatgtaacgtggcttttaaagataagtatccgtctctatatgccattgttcgaaggaagaattcttcaattgctaatgttatgagatctgttccgctgaatgttttttttaggagagctttggttggtcagaatttagcaaattggcataacttgtgtgcttctattgtgcatattcagttgagtcaactgaatgatcgttttagatggaattatcatcaaaatgatcaatttactgttcggacaatgtatttagccttaataaacaataattatattgagagaaacaagattatttggaaacttaggatgcctcttaagatgaagatctttatgtggtacttgcttaaaggggttgtattaactaaagataatttggcaaggaggaattggaatggtagcttgagacgttgtttctgtatgaaaaatgaaactactcaacatctttttgtagagtgtcattatgcaaagtttttatggagagcagttcaattttcttttggtctttaccttcctcatggtatatctcatatttttgataattggcttctgggggtggaaaaaaaaagaagaaaacttgttctcataggagcatctgctatatgttaggctctatggttgagtaggaatgatgtcatttttgacaagtcaccatctatttcatatatgcaagtagttttcaggacaacacattggctccggttttgggcacaactacaaaagtgtgaggaagatagtgagcttttaaaggctgcatgccgtattcttgagacaacggttatgtaactttttgtcaattttggatggaggttcacaaatagaattcaataattatgtactctttatcttgggttggcagtctttaggttgtttcttattgatggttggtttcatcttttaagtttctttgaacttcactcattttgagtgtgagattgtaataattgactgtagctctttgagcaaaggccgggatgctctattccattatatataaaaaaaagacatactaggccgatgagatacagcttaccggctatatagcccatcatggatcagaggggcagttacctcatactcctgacctcagaacgcccaatccaactgacgaagcttctctcttgaactctatctaaaataaaggtatgcagaactatccaaactaggccgctcaaaattaattcaggctggccactgattctatcaagaaactatcctcttcacttttgagccccctactaactggaatatatatatatataccctctgcaaaacgaactttttttagagaataaaacctgcaaaaaggagctgtggagaccgatccggagatctggaacttcattttagccttcacagttcacgcacattgctcttccaatttccgcaaaggaagcccagaggcggcaaaaggaactacgcagtgggc

SEQ ID NO: 7194 - DNA, 650 bp, Oryza sativa
catgacgggcccgtacttgtgcgctagagacaccaggtcggcgtgcggggccgggcaaacgagcggcagcgcgccgaggacggggacgctcgggggtcccgggggaggctgcggccaccgccgggggagggcgggcagtaggagcggagggagaggtggaggaggaggcagaggaaggcggcggagagcacgacggggtcggtgcagagcgcggcgagctccatggcacctggagcgacgaggcggggcggcaacggcgccgtggggagggacgggcgaggacgtcgacgactcgcggggggagagaaagagaggcggcgagggggactccgctccgggctgggtgaactctagccgggatggggttggaggaggcgccggccaccgctgctccggcccccgtccaccgctgccgccgacgatctggaccctgcttcggccttcgcccgcccaccctcccaccgctggccctcatcccacgctcgcgaacaaaaagagagagaaagagagggggaggttgaagaaggtagataagagaggatgacatgtgggttccacaatatattttattctgtgtgaatgacagatgggtcccacatatattttttaatttgaatgccacgtaagcgccacgtgagacgaatactagg

SEQ ID NO: 7195 - DNA, 1501 bp, Oryza sativa
ggtcgccacggtttcccgggcttttgtttatcgcttcgaaggcgttgaatgtttgctgccgccattaatgaggtcacgtgaggtggaaccgtggccaccccggccgcattggctgccctgatcgatccatcggtcagctgagaccgcgtaaggtcagctgcgctgatggattgatctctcgctgttggatctgtagtccctgcttgctctggcctcggtgttcttctcgagagatcattttcttttggcaaaattggatctatagcatcgaaagtttctgttttaggttttgtaacaccgaaagttcaccgcttactttattagcatccaaaatctctctctgttcccataccaagcaattccgtccatctcatcccgtttcccgttttctttgactggattgaccaatctcaccacgaacagaactggaacgaactcttccgtgcttggtggcagcgacggccttgccgcatttgtccatccttggatgtcatcatcgtccccattaccggtggcaacacggactcagcccaacagtccgtgcatgtttaattgcttgatgcgctgctcgccgtcaattaactgaaaaagcttttcacttgcatcaatttactactaaaagagctgtccactgaaattgattggagatcgatgtgatggtcaaggttgttaccgcaggacgggctgccagcgatggacaagcaaggtggagtgggagctgctgcatagccactgatgatggatgtgcaacgttggtggtagtctggtagaagtctgacggcgaggtggggaagcagctgagcaggagcggacgaacaaaaagctgccgctggtgatgtacggcggcgccggtgatggtacgtagaagatgggtcacgcagctaaggtcgcaggagaagatacagcaaggggaaggccactgccggtgggagctagacgaacctgaacttgatctgtgctcccagtgggatgcccagtatggttggcgagttgacatggctaccggagtcaatccagtcaaagaaaacagaaaataggatgaaatggacggaattgcttggtatgggaacggagagagattttggatgctaataaagtaaacagtgaactttcggtgttacaaaaccaaaaacggaaacttttgatgctataaatacaattttgccttttctttttcatcatacggcctatagagcacagtgccacagactggccaatggccacgagcacgacgacgaagattaacgggcccatggccgaggacggaggcccatcaggcctagcctataacgtttcagcccaacatgtaaaaggccggcacgtccgtggttccgcccatgcgtgatgggcccacatgaccgtggtcatgggtatccagttccggttctgggctaagtcactggttcgtcttaaggctcgggtggcccacggcccaccaggccgggcactcttcctccccgacacggcaccaccgcaccacgggacgcggcggcgtagagat

SEQ ID NO: 7196 - DNA, 1203 bp, Oryza sativa
ctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacctccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgattctaacaatgcaagttgcaaacaaaataataatgatttttcaattataggggcaattggtcaaagggtgacttgccttgctcaaggtcttcacgaagcttcacgaatcttcgagaaaacccgcgatcgacgaaaatccgataaccgcaactatacgcaacaatcgaaaacctaaacaaggaccaaaagaaagatcctatttagactaattagtagtgccattaaatagatctcaattttacggaattactggaagtggaacggagtcaatcagagttgcgaattgagtgatatgaattttgaaagttttaattggagtttctagaataggagagatgatttatggaatttatagaaataatattctcaagaatattattgacagtcactgatgcgcgggaccaaaggaaatgatttgtggaattttgggaataaggaattgatttatgggacaaaggaaaaaggatttattaatcctttggataagaaatggaaggagggatgggatttagacttctttgggcggctcgggtacggccaagcacggcgcggccgagccaatgggccgggcgcgggcgcgaggaggcggcccatggccggacaaggcgcggcccaagcgggcggggcgcgcgggaggagagagggggatgggtccgggtggaccgtatccaccttgcggggtcccgggtggggcccgcttgtcagtggcgcggctcacag

SEQ ID NO: 7197 - DNA, 1501 bp, Oryza sativa
cgagaccgaggtgatcccgcctgtgccgtcggacacccttcccggcgatctcctgacgcggtagcctccgttctccctcctcactcttccttcccccctagcttgcgcgattgctagcctagaccttcctaaacgcgcgtggacgctgccccgagccccgccgccgcccggcatggcctcgccgccaatgccgtccgctcccggaggccgccgctcgtcgccagctgtcctcggtgctcctccgtcccatccggcgccggaaacggattccttgaaccccggatatgctcccaccccttttaatcgaacccccgttgctccggtgaagtttcccccttttctcgccgccggcgtacgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccgtccgccgtccatctcggccgccccttcttcctcctcccgccggcccgcgtggctgccacgtaggcgccacgtcggcgccacctcggctttgaccgagccgagccggtcagccgcctccttcctcccccctctcgcgcgcggtccacggtgcaccaaccggctgcgcgtgggcccgccgcatccctggtccatccggtgcacgcgcgtgaaccgcgctcacccgaaaccctagcgccgccctcatgcgccgctcccactgtgagccgcgccactgacaagcgggccccacccgggaccccgcaaggtggatacggtccacccggacccatccccctctctcctcccgcgcgccccgcccgcttgggccgcgccttgtccggccatgggccgcctcctcgcgcccgcgcccggcccattggctcggccgcgccgtgcttggccgtacccgagccgcccaaagaagtctaaatcccatccctccttccatttcttatccaaaggattaataaatcctttttcctttgtcccataaatcaattccttattcccaaaattccacaaatcatttcctttggtcccgcgcatcagtgactgtcaataatattcttgagaatattatttctataaattccataaatcatctctcctattctagaaactccaattaaaactttcaaaattcatatcactcaattcgcaactctgattgactccgttccacttccagtaattccgtaaaattgagatctatttaatggcactactaattagtctaaataggatctttcttttggtccttgtttaggttttcgattgttgcgtatagttgcggttatcggattttcgtcgatcgcgggttttctcgaagattcgtgaagcttcgtgaagaccttgagcaaggcaagtcaccctttgaccaattgcccctataattgaaaaatcattattattttgtttgcaacttgcattgttagaatcacacttaacttgcttggcctcggtttgcg

SEQ ID NO: 7198 - DNA, 408 bp, Oryza sativa
atatgggcctaattcattactcattatagagtccgagtcacaccgtcactcgtaggttgcgggcccgtcaatgaacgctcgccgcgccgccccggaccactccatccaacctcccggccacggaccttgaaaatcgactccagatccggagtagctgctgccgcgatgctgagcgcgcgaggaacggggttaaagttcagttttctctctatttttttttaagaagggtattttttaccggcctctatatataaccggatatatgcggtcatttaaattaggaacttagctccgcaaccaatctaatctaaaattcgttactatggagatttaaactcataatcttggttactaattatctctctactaggacccatatggatctttaattatgctctccattgcagc

SEQ ID NO: 7199 - DNA, 1501 bp, Oryza sativa
ctccatacgccccatggcatacgcgctgtacatcactagccaccctttccccacgaacgtgccgtccggcaggaagtcgtcctccttgcagctgtgcgtgtcgatggccacgggtgggtatagcctcatggactcggtgatggcggcatggaggtagtgcttctcgcgcagctcgtcgaagctgaacgtcgcgtccgtgctcccgctcgacgcgcgcaccgcgcggatctcgcgcacgaccctgtcctcgacgtccggccggccggagacaatccagaagaaccaggtcagcgccgacgacgtcgtgtcgcggccggcgaggacgaagttggtgaccacgtcgcggagactctcgtcgctgtgctcgccgctcgcagcgaaccgcgacaggaagtcgtcaccgcgagccagcccggcctcccctctctccctgcgctcccggacgatccgctcagcgaagccgtggatcgtggcgagcgcctctcgcatccgcctctcgggctccatgttgaagagcttcttgacgcgccacagcgatttggccggcgagttgaaccgggccaagatggcgttctgcgcgtcgttgaacgcgcgcatgaactccgcgctctggggcgcggccatcctctccttggtgaggcacgccgggtcctcaccgaaggccacgaggcagatgttgtcgaacgcgaatcgctcgagcacatcttgcaagtccagagtccgtccatcgagccccgcctgctccagcaacggaagcagcctcttgacgatctcgaaccggacggtgtcgaccacgaagttcctcagcgagcgcttgttgaactcgtagctggcggccttccgctgccatagccactgctcgccgtcggaattgaagatgccgtggccaagaaagtcctcgagcatggacacggtgagcttgcccttggggtagttgtcaaagttagtcttgagaatgtgctcgacgttggccgggttggcggtgatgacgccaccggtgaggccgagcgccttgtacgacatggtgttcgtggggctgcacttcatgatgctggtcgaccacttaaggaaccggtgcttgttcttgatgatgtgcggcagcgtgccgaccacagggtaggacttgagtccatgaatgcgaggcttcttcttgggatcctggtgcatgtagaggaagtagaggaggggtagaaaagcgagcaggatcaggatgagcaagagagaagctgagattggggagagttccatggcaacagtgagatgatttggggcttttgtcttgcgacttgtgagctgtgattggcgcaagtgcttgcgagaagaggtcgatttttttttttttttgtggctggagattgcaagtgatgcatgatgtgtcgttatttataacggaggtgctaactactaatacctccgttttttttaaaaaaaatagataatgttgttaacttttagaataacatttgattatttatttataaaacaatagtgtaaatatgct

SEQ ID NO: 7200 - DNA, 1501 bp, Oryza sativa
tctcacactgggtaccgagcaggtttgcaaatacctggttgcaactaatgaggtaaggcaccaactcaatacaagggttaagacttgcaagtcagcaattcaggattgaataggtggcaggtaaaaaggagcagtggatctgatggattgagatttgaggcctgcctacttgagacgatgcaagtttgttttcagttttggcagtccctttttctgtttaactctctagtaaattatgtctatttgtttcattgctctctggattagcaggcttatgttacctacaccttgatagtctttgtttccacaagggaaaatgaaagttataccatttcaaaagaaaagggaaaaaaagtaatttgatagttcactctcaaatatgttctagaacatccaaactctacggcaaaatgaaaggaaacatcaaaatcagcagccatggatgtgctataaaatcgcattcccctagattgggtgcttagctataaaatctgctatgcttttcaaaagagataagtatctccaaaccagccatggaaaatagtaattttctgcttcacatgttgtcaattgccatgcagttcttatgattgttagttcttggtttttctgttctgataattctcaagtcaatagcacacctcaaattagctatatttagtttacataatgatccctatgttgttgtcaggtctccaaaatggctcctaattttggaggggaatgagttacattacacttaagaaaatccctaaaacctaattcccaacagaactaaataatgagaaacaagccatgcgattcatctactataacactacactattaatcgaagcatagccaagcaattattaatcgaccaaccaaaacgcacaaccaaccaaccaatcttgcccccaacttacagtaattacaaggccgggtctatagaatacataaacaaggccaaaaaaaaaaaacccctaaaattcgtgaaaggggatgaagaatagggattagaggcgccgtacattcctggtcgttgagccacctcagccggtcccgcagcggcgcgtcggcggcgggtggctccggcggcttctgcttggcggcgacgcccttcttcctcctcggcggcatcgcgcgcgcgcgccgggcctccgctcgtagtagtcgggaagatctcgacgacggagggggaacggtgggattgtgggggactggagcgagcccccctcaccgacaaccccggcggcggcccgacggttcccttcccccgaggtggcggagggcagcggcggaggcggacagaggcgcaaggtcggcggatttcgccgaggccaccgagcccccggggccaaaggccaaagcttggtttgaagtttgaacgaagaggcggaagattgaaaaggaaaaaaagaaatgtccactctacttccctgaatataggtttacaaaaaattccacttgaatcgtgtgattcctctttaccgaagaagcctgtgcccaaaataatcgagca

SEQ ID NO: 7201 - DNA, 1501 bp, Oryza sativa
ggtgggatcaaaccacaagtgtaaaagaggcacccaaaaaggctctacgctccctaacgctcctagtcgcctggttgatctggaatgaaagaaatcgcagaatattccagcataaggagctcccaccgagtggtcttctgacaaaaatcaaggacgaggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttttgttgtcaagcttcgccgctccccaaatggaggaaagcgtcgatgcggtccctgtctcaccagtcggagttgagaaaaccaaaaaaataaaaatagtttgatttattttgagatacgacatatctaagttgtgttatgttttttaggttggtttatctccggttaaaagacaaaaggaaataaaattcatcggaaatgatgatttatgacgtcttatcttaagcaataatttatgacatactccctttgtttaaaaaagaatcaacttctgataatgaatatagataactgtcagttcagaattattctagaagttctttttagcggaggatgtaccccactgccgcaatccaaattacttacgccacttgcaaaatgacaaattacatttactctttataaatgacacaatattacgggaatgggcccgcgcgctggctgcttaactcgctcagccgccggcccccccccatccgcgtgcgattagcacaagctaattacgattgttactgttaaataccataattaaaaaatacatgtataatttaaaattttgagttatcagttttaaaaatttgggttaaaacttttgaattttgatatgaaagttttcaactagatatgaaatttttttaattttgagttggaagttttgaatttcaataccaaagttttaaaatttgagatgaaaatttttaattgagttgaatgtttctgaaatttgaattggatgttttcaaaaattgagttgaaactttcgaattttgacttgaaagtttttgaattttgagttgaaagtttttgaaatgtgagttgaaagttttcaaatttgagttaaaagttttcaaattttgagttgaaagtttttaaatttgacttgaaagtttttaaatctgagttgaaagtttttcaaatttgagatggtaagttgaaagttttcaaaatttgacttaaaaaattcaaattttgagttgaaagttatcaaatttagggtgaaagttttcaaaatttgacttcatgtatagatttcttatcaa

SEQ ID NO: 7202 - DNA, 1501 bp, Oryza sativa
tcaaatttgaatttgaattcaaatattagtttatagacccaaagtttataagtcaaaagtctgcatacctgtttcaaatttgaatttaaattcaattttttatatatagtatttctatacataaatttttccaacttttattttttttaaaaaaaaatttatagtgtactgtaataggaagagaagaagggaaggaggaaggagtgtatagccgtataggggggaggggcgggcgccgcccattagctttacctgcatcttatccccttagagcaggtacaataaccggcggtactgcttccacataagattttgtgatgatctggaggagagaggggaagagagagagagagagagagtgagccgacgactaatttgtcgccggactgcacgtgccggtcgaggagttcgtggggctcgcctagatgcttgcgctgcctgccttcgtcgccaactcctgcggccactggaccaccgccctcagcctcgccggcgtcgacgcacggccgccgcggtctcccacatccgtcgcacggtccccgtcacccctcgcctgcacggctgacgccatctccgacgcccaccgctctcttccgcctccgccgcgcggcccggccaccgtcgtctccgacgcccaccgcacggccgccgccctcttccgcctccgccgctcggcccagccgccgccgtctccaacgcccgccgcacggccgccgccatctcctgcgtccgccgccgctattttccaccccgccgccatctctgttgctcaagaaccaaacaaagaagagaagacatgaactgatgggagaaagagagagaaagagaatgggaggtagccggtaggagaaggtggtgggtcccatgaaacaataaaatattcgtgttatagtatttttattatagacattagttatattgtttactatatatgacatggctggtttttaaagccaacaacgggctatattattgaccttgctcttagcagattctatcgaggccatagcgacaaacaaagacaaaaggtagtccgtgtgatggggcaaacttgacgccacagtggaatcaagaaaaaaaatcaagttcgctcatctttgtgtgttcgcaaaaaagacaagtccgctcacccttttgcgcattcggaaaaaaaagcaagtccgctcaccgattcggccaaccgagttggacacgttccagattcttgcccactcatcattgatcagcggggaaggcgagaggatgaaccgatgaacaccgagcaccaggggttgtatcagttgctcggccttgtctccagttccaacaccgctccgccacggcatacttttcggctgagacgaagtattcaaatttgctcgatgtgggcgcgccatgggcagcccatcaactcgtgcaaatagcttctcctgcaaatctgcaatcctatatccgacaactcgtgcccatctcatttcgctcggtgcgccaaacacagccgcagaactcacgtgaatcccga

SEQ ID NO: 7203 - DNA, 1501 bp, Oryza sativa
cctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgctcagcttcgccctcgcacacattgtaccaataattccctggctccacgtccccaaatttcctaacgatcaggggatccctcgacttggagaacttggtgggcgcaaccctgctgtcctcgatgatgcggactccaagctgaccctgtgctccccacttgtcccaatcctcccagaaccgcttgtgttcaacgatcccgaccacggattgcaggtgctcaatgtcaatatagaaggcgaggcgcttgccctcctcgggcatgcccccggcgtaggcggcggcgagacagacgctgagatcgaggacgagggtgcggttgaggtagcgggcctcggcgatggagcagaggagactacgaagataatgcggcatgggcttgcaccggtcgccgccgccaaggtaagagaggtacttgcccgcggcgaactgggagcgcgagagcgcgggtgggggcggcggggcggtggcgttggtcccgccgcggcggggcttgcgggcgagggggccggagtggtattccccgatggaggtaacggagtaggcgcaggtgacggggtcgcgggcgacggagaagcggcggtagtccttgtagttggcggaggcggtggatcgggcgcgccaggccatgtcgcaggaggacgacggcgggtcgccggggacggggcggccgaagcggttgaagtggacgtcggggaaggcgtcgatggcgcggcgcatcatgaggtggaagagctgcgggtcggcgcagtcgagcgtggaggtggtgtcgcagctggcctgatcctgctgctccaggtgggacgtggtgggcgtcaaggcggcggtgggaggggagagggagatggggaggttgcggagggtgaggaagaggaaggcgacgagcaagagggcggcggcggcgtgggcggaggaggtgatgagggcgccccgccccagcaacggccggctcgggtccatccggcgacggcgacggccgacggcgatgagatctggtggctgattgtgtaataaagccccgtctgcaggcggcggacggtggtgaacttgtttctaggaagacgacgaactgttcctcttaatgggcctaacatgagtgggcctaagacgaaggcccatgatttggcccaagaatcgcatctcgtcgtggataagacgataaagcaacattgtgtggggatagccatagccctgcacc

SEQ ID NO: 7204 - DNA, 447 bp, Oryza sativa
aaaatttgacaggatatattttaaaattttggaaagggagagaccggatagtcagatagattttaaaattttgctcgtgttgccaaccgccaaacgcagctgcagaactaacttaagcccagcccccaactgcccaatagtgtggccgtgtgggctataacgcccattcgccgctcggagaaaaacaagaacatcaatcagggcaagttttataaaaaaggtgaatgttgcatctaatcttgaccacatcatcaactaataaatgtagaggtaacatgtacaatatatcacatctatactaattctaatacactagccccaatatttgtttgcccaatctactcttcctctctctccttttgtcttgaattttgtgtagtggttacctcttgcataagaggtggctcattttctctctcatctcatctctccacctatagatggcca

SEQ ID NO: 7205 - DNA, 1083 bp, Oryza sativa
aggggggggggcgcgacgggatctcgctgaggcagaagaaaaaccaaaagacaaaaagaaacgggtgagtgaaaactcgccttgggagatgggagaatgaatacggccgcggtgggcgcggggacgaacctgcggggaggtcggctaaacgaccacctcgggggtgagatgaggttcccccggcatggcacaatcccccccatcttgcggggccgtttcttctttcgctccccctcgggctgcggcgtcggcacggcaccctccgggcgcctgctgctggcacgcaccgccccgccccctcggggaggagatggaggaggggtaccctcttgcttcctcttcccccgggcgtcggcagggcggctgccccccgggcccccgtcgcggggcccagaagcacgaccccctcccggggtagattgttccatcatcatgcctccaggtgaaacgaaccggctcgtcccgattcgcgcgctgctcgagtaatgtagcggtcttaaagaggccgctcattattgttggtcggttttcccttgctgatgcgcgcgatttgcgaccgctgggtttctgctcgcctgtagggaccggccccacctgtcaccgggcctaaggagtggcgtcacgcccgggcgcttccctcgagggaggcgatcgccctggcgtaacgccgggggctactgtcggtgtcatggggccgggggtatcgtgactagaggcttaggtagccgcggtcacccacgtggcctgaccccctcgggggggtcgggcccgagggcgacatggccacccctccctctgtctccccgaggggtcgggccgctcccgtttcggccccgagggctggggcgccccgaccccctgtggtgttggcgccacgtgtgtgggttaggtgagcacagcagcgctcacctaaccgcatttatagcgggttagacgagcgcgccacgccgcattcaatgcggcgcagcgcatgcttatccggtccgtgactagtcgcggtatgtgaccggtcacagaccggtcagatcgcgggataggtggcaacaggcgtcctgtcgcacgcctcgccccgtcccgtcggaa

SEQ ID NO: 7206 - DNA, 1216 bp, Oryza sativa
agcttttattaacagcttgtatatctctaataccaagacctccctttgaaatgggcctgcaaatgtccttccaagctctcaagcataaaggatttttgtcatgtccttctctaacacctgcccaccaaagttttctaataatagctgtgattttattaagaatattttttaagagaagaatagtagccatatagtagacaggtaaagaagcaaagacagagttaatcaaggtcagacggcatgcatgagacatattattagccttcaaggtggtcagcttggctttgaatttatcaatgatgaatttatagataacaaacttgtttctattggtgacaaaaagagggtgacctaaatgtctagtgttggcatccatgagattgatagggaaaatgagccttatagcctcttgaatgtgggaaggggttttcttactgaacattatactggatttatcataatttggagtttgcactgagttcctgcaaaagttttcaatgatgttctttatctgacaagcttcttcaatattagctgtacctgtaatgatgaggtcatttgcataaagaagagagtgaataacaggtccagaatcacttagtttaatgccattgatgtgttgattatgaagaaccttattgagttgatcagaaagttcatttaaagcaagaaaaaaaagataaggagaaagaggacagccttgtcttatacccctgttagcattgaaagaaccataagattgaccattaatgattacagaaaaagaagaggaactaatgtaggatttaaccaggttaattaaatgatgatgaaaaatctttcctttgaagagcagagtcaataaaatcccattccaatctatcaaaagctttagaaagatcaattttaagcataaaggcattctgagagtaagagttcaggcaaacattggagcttcgctgttttgacacttctagtggataacaaatgggcccatttgtgtctatgaaatgtgggtccagtgtcattttagaaaagattaggggacgattttgatgacaagttgaggggccttcggtgtactttttccgcacacaatataaccctgttcaggcccaaccgtacgacaaccgcctccgatcccctctcctcactccttctcggcggcgaggcgtctccgacgaaaaccctagcacgcatctcttcccctctttcccatggtgagtatccacaacca

SEQ ID NO: 7207 - DNA, 1079 bp, Oryza sativa
cccccctcccccgacgccccaccccgtgcccctttactgccgggccggatgggccggcccaccgcccccctagcctgccggcctgtgccacacggtggtgggccgaattctttagatttcggcgcactacctaatttaccatttaaatttagttttaattttaatttagcagcaattttcatctaagtccctgtgttttatttaatttagtacaagcagttcatcagttgtacaacttactatgtaatggtcctgtagaccactgatgttatatgttacttaacataggtgtttatttaaataccctgcttcactaaatttatttgttgtcttaataacatgcctcttgcatattatttcaagacacactctactttctcgctttattaatttacaaaattctataaattttgtactttgatttagcaaattctcttaattatgtacaacatgattaatggaggatttaatgaatgttccacttcacattttgacttggaaattaatcacatgttgatggagtcctacactttggtcatcacgaccataacttaggccgcgagtatctcgcctatcatcaagtggtctacattttgagatgattacccgatggagtcctacaaattggccgcactggtcataacctaggcagcgagcatctcgcccatctcacagaggtctacatcttatgatgattacccacatgtgttactttccgagaatatgttttgaaaaatgagattatttgaaatatggttgagcacaaggtagtggagttctaaacattggctgcggtatattcaccagaatatatttgcctggagaccgtgttttaggcagcaagtataacttgcccactattaagggatctactccactgtttaattacttggagattatccacattgtgccacctaatttcgaattctaactcaaattgtcaggtctattacctacatcttttcgaaacattacaaaatatgaagtcttacatttcgcattaagattacaaccttaatatcatgtttttattaatttacctctgtaaattaataatgttaaccatgattgtagggaca

SEQ ID NO: 7208 - DNA, 1501 bp, Oryza sativa
tcaagcgtgaggattatatctccaatttggacttgttccggatacattccacatggattcatagtcatgagtttattttctatgctcaaagactggaccaattattattctccgtaagggctatcaaccgaatacttgcgccagtcgggattcaattattatatttattttggagtatcccataagggataatcattccgatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatagtcaaggtgctgtttgggtttatcaagcaattgattggatacaatatcattgctttttgccacgtaagtgtgcatttttattgaccaatattatggcttaggctgattatatattgtggtcattttctaggcggttggtaaatcctttatgagtttatttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcactcatcatattttacaaagcagttggtatatcacccagatcatgttatttggaggattcacaccgcatatgctatatatcgatatcaagtcactttggttgattacgattatcaaaaccactcggttggttggattattattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatctttttgactgcgaaggtctcaggggctactgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatga

SEQ ID NO: 7209 - DNA, 1501 bp, Oryza sativa
acggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattatattttaccagtcttggagattttaatcttgtatagttttcaatataaaaagatttgataactattgatatttatacaaaaatatagagcacagtataaaatcgccctcccccagggcggcaagggggccgcctgcaaaattccatgccccctcgccgcccatttgcaggcggccccccgcatagtacaaaatcgacctagcggagggcggcaaaggggccgcctgcaaaattccatgccccccctcgccgcccatttgcaggcggccccccgcacaatataaaatcgccctagcggagggcggcaagggggccgcctgcaaatttcgttgacggccgtcgcccgagagcgaacggccggctgccacgtcattttcgccgccctctgggagggcgatttttaaaaatcgccctcccagagggcggtaggcgactacttccgtcaattttcaaaatgaaaaattatttttgtaaaacttttaataaaaaaaattataaataaaaaaaattcgccgaacgagccctatgggggtttgaaaagcaagtgtggccttagacgacttagagaagtgcaatgtatattgccaccgatattattatagcatctttatttaaaaaaaccgtgagttgtcaaagttttaatatgaatagtgtccagaaatagaggaagtaaagttaaaagagaaaaaagtcatgatacgtgtacataagagaatacaggaaaaatcgatggaatgaaagttaagggaaattttttgatggtactgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatga

SEQ ID NO: 7210 - DNA, 1501 bp, Oryza sativa
cgcccaacagcggcggcataataggccagccgtgcaggcggaaacaccagtcggcggcggcgaaggccagccggtcggtgaagacatgaacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagcggtcgacggaaaggaagtgaaaacttccaaagcgaaagcgaagtcggcgactcatgaaattgattccatcgcgctcgttgataggaaactcgacgcaacccctacctggcgcgccaactgtcgaaacatggattcggcaataataaaagggggtagcgcacgagacctaaaagtggatggatgcggagacaaaggatttagacaggttcaggccctctcaatgagaggtaataccctactcctgtttggggatttaaatccgccgggtgtgtattgatctgacgatcaggttatgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtaccatcaaaaaatttcccttaactttcattccatcgatttttcctgtattctcttatgtacacgtatcatgacttttttctcttttaactttacttcctctatttctggacactattcatattaaaactttgacaactcacggtttttttaaataaagatgctataataatatcggtggcaatatacattgcacttctctaagtcgtctaaggccacacttgcttttcaaacccccatagggctcgttcggcgaattttttttatttataattttttttattaaaagttttacaaaaataatttttcattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatattgtgcggggggccgcc

SEQ ID NO: 7211 - DNA, 244 bp, Oryza sativa
caatgatcaaactttattcttcaaccaatgaaccaaagcaacctagcatcttaattaccaactgaactataggtagttgcattacatcacatctaggctgaaactaatacgatgcttgcttcaaaacagaatatacagattatttctgaaatgctgacatgctagtgacaagcatggtatggtaacatgggagagctaatgctagtgagatatacataagatgcttgagctttctggccaacca

SEQ ID NO: 7212 - DNA, 293 bp, Oryza sativa
gtcacaggtgaggggataccagtgacgggccactgaatagaagcccgtcaaaggtatgaccaatacctttgacgggctttttttatctaacccgtttgaggtgtgttgggtctataaataccccccaaactgccaactgctttccatcccgaccattttactgttcacaaatcggttgggagggcaagggggcgattttttgctaaaattcaaggtaaaaaacacattattctccattcattctcaacatatcgatcatcatttatttttctttgtatgttgttgatttcaga

SEQ ID NO: 7213 - DNA, 1501 bp, Oryza sativa; identical to SEQ ID NO: 1651

SEQ ID NO: 7214 - DNA, 1303 bp, Oryza sativa
agcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtgtcgccttcccgttggaccgccgcccgccctgtcagtctgtcacgcgccgccggcgcttttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctatactttggccccactcccaccatcataaaataaaccagcccaaattacgattacgatgacactacgctacgctaggtaagcttatacttattaaattattgtaattattgtagagacaacattgcaaacacaatccaatttcctattaatagttccacgactttgagaaaattgtgacagtatcaagtaattcatgctagcatttttataagaaaatgcagtgataactataattgtacgtatcaacatgtatcagtgatcgatcctgtatttagtggtggttatattaaataccatcaataatcatctcaataaagaagagagaggagaaaatgtgtggaacggtgaataaataatccagtgttaggattaatcaagactgatcgaggcccttatcacggcggggcccagggccaccgcaccactcgccctaccccagggctagcgcaaaccgaactcgagccaagcacccgaaaccgaattcgagccgcgctgcggatccatcacaaagcccatctacccaaaaacccaatcatatagcccacgcgcgggcttggcggcttgcccccgtttgcgaaacccgatcaacccccaccgtcgcatccagatcgtacggcccaaacgcaccaactcgaaaatcccctcctcttcctccctccctccggccctcccgagccctaaccctagctctctctccccatcaccaccggcggccatggcgctcgccatccgcgccgccgccgccgccgccggcgacatggcgccgtcatccgcctccgacccgaccctcgggttcctcaccaagcgggacacggaggtgaagctgccccgggcgacgc

SEQ ID NO: 7215 - DNA, 1282 bp, Oryza sativa
tacacgagaagaaatagcacaaacatacgtatcccacaggttgaatacaggaacacgagagcgctagccaggccgttcccgctgaacgggcgagcggaaccgcgatggtcctacgggccgaaactgtgaaactgtgacagtcccgcggctcaaaaacgcagcaccaatgcagtcctgcggttccattgcgcggaaccagctctgtgaacagtagtaaacagagttaaacaataactaaataaacaatgttttgaacggtattaaaaactcatgcgtgcttagatgccggtgccgcaccaccggcaccgcaagtggtgccgtgcgaccaatctgcaggaccacgtcggtcccgcggcaccgcccctcctgtccgttccgtgccttcgagctgcactgatggcacggtgccgtgttcctgtaccgcggaaaatgtatatttctgtaaatgcatgtatatatacaaaatagagaaaaataatgtatactttaaaatttaattgccggctgtgatgttctatcactaattgttttggctctgacgttgcagatatgatgaggttgcaatgttagtaggatgtggatgggtaaagttaggagcatctcttagttgcagaggagattccaaatcaagcgcccaattcctccaaacgaatcggacgatcaaatgtttcagtaaaaataaacaacaattaaaacttttaaatcttgtgaaccccctcccgtgtcgacggttccttcaccgccgtcggccgccgctcccttctctacccgctctcccgctccccctaccaccacttcccccgccgccaccgcctccatccaactgccgcacgtcgttcatctcaagttgccatatgttcatctggactctgaaagctggccttggtctgcttcattttggtgttgttgtgtctccatccggagaccagagcccgcactcactgctagttgccatccccaacctgccccaatatttctccaggttttgttgctagctctcgatctgtacacgctgtgggataattgcttgttgacaagtaagatcaaatcctgatggtggaagaatggcaccccattttgtttttgtatcagggctgcatagagtataaaagctttgtccccctatgcttgcactcagagactcttccattgctgtcatcgcatatggtgttgcaacttgcaagtaacactgtcatctcaatgtgcttgcacgggtagcatacatattctcactaactgctcttacactaacaaggatgaatcagactagcagagagagagt

SEQ ID NO: 7216 - DNA, 1501 bp, Oryza sativa
acaagatttcggcaatactaaaaggggtggctatcaagttggaaaagtggatggattgaaagacaaggaattttatacaggttcaggccttcttaattaagaagtaataccctactcctgtccgaagattgatccgccgagtgtattattgatcgtatgatctgggtgaaaatcgtgtccctagaggcacccggacccctccttatataggggaagggtccgcattacaatgcacaatccatatccttaacggaataggttgttacagataagatacaatcgtaaccgactagaatcccaggtatttccttgatgtacaagtttggaatttaacccgagtccttttaaggatattatatctatacatggcaccccatacccagtcggactatacatgccgtgtaggtatggggtatccataatctccacagtagcccctgaaacctttacagtcgacgaaatagtcttctcccgtaatccaaaacgataatccgagtactccgacttcttctgccataatctcccgagtatcaaaatcaaagactgtgaaggtctgaaaatagaaaaaatcgggtacattgactagatacacctaattaggtgtagccccccgactatgtgattagttaaaaactaaacatatagtcaaggtgcaaataacatccaaccgagtggttttacaaccaaatcatccaaagtatcatacagctaagcatatgcgatgtttaataaaacatccagccaactgctttagctttaatacaccaaaaaaggagatataaagaggcccgagtgagaaacactctaaaggtctataaatccacacatatgataaaaatccgagtaaaaaatcttaaaaagatccatcaaatgtgatataaatcatgacaaccaacaagtctaaatagcctaggctatgacccacaccatgattaaatcaagcatataacttgccgagagaatgactattcaaaaaccagccatctcaacaaaacccgaacagcttttgtagcgtaaaaaggcctacaaaattggtataacacttttctgttgggcacctttttatttgcatcgtagcagttccaaagaattatctaactgcgtcaaaaaggattttaacaacattgctatactgttgtgagcaaatgttgccgaagcaaaaatgcctaagtccctaagatcacaacttagccacgccaatagaaaaattgggctgaagtactgtttaggcccaggcccattagtactcccgatatcttaatgaaacaacaccgaaggtcaagcgtcgtttcatcttccccaccgaaactctcgccactttccccattctctgctacagtacgaaaccgcaccgacgaaactagggttcaccgattcactccaatccatcctccaaaactccacgaaaatctcccatgcaaccaccgcatcaatctcccatttagtcccagccacactccaaaccaaatcatatcatccagatcgcatccatggcggaaga

SEQ ID NO: 7217 - DNA, 1238 bp, Oryza sativa
gaagaagagagaagaaagaagatgccgcggagcttggtcgggaggaggtggcggtgggagaggtagacaccggtgcgcggatccatccaccccgccctcgggcacttccggagttgggcggcgacggggcgtcgaccgcgtctcccttctcgggccggtggtagggatccttgcggagccgggcgggcggaaggcggcggcgacggggttatcgtcgcggttgatgccaatggaggagccatccggtgtcgaagcagcgacgccaatgccctcctccttctcctgcctcccgagcctctccgaccctgagctcgcatacgcggcgatgccctcccttctctcccgctgccaccgccgacgtcggcggccgtcggtgcggtgccaccctcctctcccacctcaccccaccgactggcctacaggtagagaagactaagagaaaggaggaaccgaggaagggtgagaagaggggagatagagatgacctgacattctgacatgtggggcccacactgactcagccgccccgcctaacaaaacagaggtcaaaaccaccgaagaagtgaatagttttattagtgagggatgttgtatatagttttgtggttgggggacggttttatatcttgacgagggagggattgtactttttcctcggtagatccacacctccgaaggaatcgaggatgtcgtttccttccccacctcagcgcggttccaggcggaccgcgggtcccacgcctggccgccgcgggagctgagcggtgccacgtcagcgcgcgacgcgagctccaatccacatacaccttctcttccctccacacacacacgcccgcacactcctcgccgttcgcctcgcgctcccctcgtcgtcgtcgcgcaaatggcggcctcctcctcctcctcgtcgccggccgcggcctccgctcccttcgccgcgccggggccccaccgccgccccggactcgcgctgcgcccctcgccgccgacgccgccttcctcctccttgtcctgctgccgcgcttcccccgccgccgcggccgtctcgtccgtctccgccaccgccgccccgaatcgcgggcccagggttcgtgcggtttcggcttggccctctcgtttgtccgatcgtgtgcactgggcacgctcgcggctgttcccatctggggctaaccgccttgtggtttggcaggggatgggtcttcgttgccgggcatcggagggagcggcggcggcggcgc

SEQ ID NO: 7218 - DNA, 309 bp, Oryza sativa
ttgtgttttgcctaatgaagtaatgacaaatgataatgatccttactgtgattgtgatctataatttgctgatttgttgagtggagtattttggatatatttgatataatgtgattgtgaatatgttgtttaaccggggacgtgttcaccatggagaaaaattcaccgcgtggtgatcggggctagagaaattatagccccgttgtagttgacgggggcggggacagtgacatattttcaccgtggtgacggggacacgggcatgaccccgacggtgaattaaccattgccatctctattaacaccaga

SEQ ID NO: 7219 - DNA, 682 bp, Oryza sativa
agcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggt

SEQ ID NO: 7220 - DNA, 1049 bp, Oryza sativa
tggacgcacgatcccatgtttccaaacgccgaccgttggtgtcacagttcactttccaaacgcagttcagattgctccatgtgttttgtttcattcggaataagttcactttaatccctcgtatttgcttcgagtttaaatcacatccataaatcatgatacgagatataacacgtctttaacttacaatactgaaatactactaaattcacatgataatattatgtccggttttagctgacgtgtcattgagtcaaggtgaccacatggacgctacatgtgaacgggtcggttttcctactcctccctcctcttactctctcgtccccatcttttccaggcttccctccaggtggtagcgagcggtcagcaatagggagaagggcgataattaaccggcaagacaagagctgagtggcagctggcatcatcgaactagaccaatcgccgaatgggaatgtgatgggtggtgaactagaacatgcggtgggttttcgctgaactggaatgaaattgatttttgcatgcagatcttttaagtagccgtatgcgaaaatgtagaccgatgtttgcaggcacgactagttacggttcacccgtaacctaaagatgtcctcgttcggaaaaatgttttctgtagtagtgatatgacaccttctaataaaagtttgctccaaatgtcacggaaagagcaaaggatttttttttcgctgtgatggactgtataaatattgataaaatgtgttcagcatatcgttgtgaagttgaggtatgcagtgttaattttggataattacattgttatcaagctccatcatatgtgttggatagtatatggagagaggtatattgcgtaacatggatctattgtattgaacctcagggggccggtatatataggagtatatggagaggagataaggaaggattacagatatggaaggaatccacacaaatcaatcctattccacaacgccctcttgtgtgtcaattactaccttcccaaatcctatccatgaacgcatgtgtatacagataagagagagaga

SEQ ID NO: 7221 - DNA, 1501 bp, Oryza sativa
tccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcatcgagaggaggaaaaagaaatccggcaatcacctggcgggaaaaaagaatgaaaaaaaaaatgaatattgagagagagaaatttgatggacacagaggaagtgcaagat

SEQ ID NO: 7222 - DNA, 1501 bp, Oryza sativa
gcctcctggagctctacctctcacctggtacttgtccgagaagcctccccgagctccgctctcaccggaattgtctttcaagcctcgctcttgccgtctagaaccctaaccaagctccgcctctcaccagcacactcccatgatcagtcctgatgaggatataactagctcggatataaccatgactaccttatgtattaatcaatcaaaggtacatatgttctacattagatttacttattatatatttgaacaaacgttgctacacaataagtttcctgtgtttttgtttgtacagttacttgcttgggcgaaagaaaagagaccgagcgtaaggaatgcatgaatgattgaagaagttgattggggaccaaaccaagaccttctctaagtcttatttcatctcaccatgtcacttttggtccatagaagacaagagataaagttctacacgttttgtattcggattcgggcctcttgacagcatcaacttcaaacggacctagccgctgatatagaagaaatttcagggcccttgagtacttgttggaaagcttatagagtctactttcagatggttttggtcccatgtcaaaattcctaccgagctgtcaggaatctgcaaaacaagccacgtatcttatccagtccgaatctgatttgggttttgggccttgtaattgtgtcgtgggcttagcccaaggcggtgtgcgccctagggcaaccctaggatgtccttaattgcatttattcagtagctgtcatcgtttagagtcgggttttgcttagattattctgtcaagaacaatttcaccgctagatcggtttgtggaaccccaaattcgagtgcttaatcattcatatgcaattgtgttgcaatctatcttgttcttgcttgtgttttttgattcgcatgtagggattagccttctcggcgagatcaaccgggtttagagtacggttgataactgttgatgcgaaaaacacacactgacctggaagatctgcttaacttctgtgcaggtccaaaatcccgcctttaggttcgtcagcgtgccagttgatttgatcctgcaatcaacaagataaaagataagaaaacacagttaaatccaaaaacgatagccgatcgactagttgccgatgacatatcatttatccttgagccgatgtcaggtttgaatcgatcggcagtgattaataaataagataaaactaaatctattcgatcggctgtagatatcaacatcatatagtcctttacttcgatatatatttaaactaagtgattgggatagatcggtcgccatgccgagacattataaaccacttaagtcgaaatatatattaaaacaaagattatatggatgtttatagcatagccgatcaaatagatctagcgtgtatcggttaatactccgataccactctatatcaagatatcgagacaaataaaatatatcaaataataaacctaatataactttaatgcaacgggatc

SEQ ID NO: 7223 - DNA, 1501 bp, Oryza sativa
atataatttcatactactattgatctcctaaaaagaaataatatatagtccatactaccaccaatgcagttattgacttgtagaaacatactattcatgcacatatttagtgctccaaaaatatctaactagccaaaaaataaataaatgcattagtagaaaatgaatattcttaaaaaccgacttttcgcaatgagaaacatttaaaagaattataaccaactttcagtaaaaaaaaacagagagagaacatgataaaccctagcatgtacgatggttattaatatgtgtctcttaatattgctaattaggtatattggctgacatggaagagagagaaagtgaagagataaaacataattgctatgggtaatgatggtgtaacaacaaagcctctggaaaatggttgcatgagaaaaaaaaaaggaaataatgacaataaaataatatttttaagttaatgattaattagagcatttgttgtctcaactattgtagagacacggtctctaaataattttgtattatctaggatatcatactcgtctataccatagaacatgcccttaatatcttgcatatgcatgacaaatggcagaaccaaagtttgaactagttggttaagttaatgaagagaaggttggtaaatgtagggtccgatcgatatgatatttgttttatgaatggaagcggtagtactataatatttggaaaaaaagtaatgcacgcataaattttggtttgaacctttttgaacagaaaattttggtttaacagcacaaattagtatagttatatatatggggaaattcaattcattacacacctcaaggattaattatccctcatttcaccccctttaggtatgcacggttttcaaatcttacaccgtacatggattaggaacacaaattaatatgataaaatcctggacacaaacagttgttatcatcctaagcaagtgtcaaccccattttgcttcctttcccacctccagttgctaattgacaatcagccccttccagggccactacatccaattatatacacaccctccttagcatatgtaccccacaccaccctctcacagcacagcaattgcatagctttccaattccttgacactatagaaaaaggggagaaatgggagtatatatcagtcttgaaaactagtcaatgtagtggaatacttgtccatttctgctcctaagctcctccccttattttatcccccacatcattagctcttgcttatgcttcttcccctcccttattctcccatcacactctcctcctcttcttcctccctggttcctaactcctctaccccacatcattccaatcctatcatggtggtggtagagaaatatagagagagctagaaggggaagagaagagagaagatttctagcttaattagaagggttgttactatgggggaggtgaaggagaatgaggtggtagagatttttgagcatgatcatgacaacaagatcagatc

SEQ ID NO: 7224 - DNA, 1501 bp, Oryza sativa
catgttggtccagtttcatttttacatggaaatttaattagaacaaggtgagtagcatgcatgttgaatttcctttgtttcgtttctggtctaaattaatactccctccgtcattctagccactggtggagaaaccctttgtagtcccggttcgtaacccccctttagtcccggtttccaaaccgggagtaccaatccgggactaaagatcgctatctttagtcccgggtgaaataaccgggactaaagatagagctgatcttttttttttgcatgcccctgttgctgcatggtttatatatatatatatatatatatatatatatatatatatatatataaaccatgcatatatatctttcaatacatatatatgcatacatatatatatgtatttatacatatatatgttatgcaaatgcatatgtatatagatatatatatgaacaaaatatatttacattatagaaaatgtgtacacatgcatatataaacatatgtagtcatgtattaattacaatccattatatgtcctagctagctacgatttcgacgtagtagtactcgctgctaactcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaagaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcg

SEQ ID NO: 7225 - DNA, 1501 bp, Oryza sativa
ggagcgcgatgcggatcggggagatgagaaggggtgcgacgggtggatcgtgggagaaaatctcatccgctgattcctgtgagaggattctccgatgaatgttaaccatttgatcgttcaggactcaccaccaccactatgaattttttaagtagtaaagattcaagaccaaaagcccacttcctcacaaaatataacaacttctaacatttaaattttgtttcaaaatataataatttttcatctataatttttccttaacaaatcataacctttaactgttcaaattttgtatctacctacttttcttaaccaatcataatatttctttaagtttatcaattttcataatactcgtattcaattctgaaactttttatattttgcaaaagatggggtaacattttcctcctcttttcgcggcttgatcacttgttcagcatacgcgtatacatgaatcattcccagctgtgtgtctgatcgtttgtcaggcaaaaccatgcatatcatgcacgatccaggcgtcagttgcctgtacgcgtgacgtttgagtcggctagcttgttaattagctggattaaactagctcctgtagctaggatattaatttttgtaggtcctcgtgatgatatgacgacgacgacgattattgtaattaatgacttggttaattagaaatccaatcatggtcgagattgaccagaatcacaattcacagatgcaatgatctcgtgcaggtgtcttccactggacggttgttggttggtcgattatctgccaggagaaacgtacgccaaacagacaccaaggggcaccgtgtcactaatctgccggacatggctggaagaattcttgaatatatattgtactccgtactaactatgtacaatgagtgccgttgtcctgctctcgattactactccatctgtttcattttttttataaatcgtttgactttttaattattaaaatttctttatatttaacaacatctataataacaaattaaatttattaaattttacattaaatatattttaataatatgtttgtttatatttgaattgttactatactttttataaacttaatcaatattaaataaattttactaataaaaaaaattaaatgacttctaatatgaaacagagagataggttcggagcgggtgcttatatatatgtacaaccatagccaaacaaaatggtcagtttagcggcagtgcatatgaattgatggattcggtctcatgcagtcaatagtgtgactgtaacttaaacggtcacacaccagatctgtttgatctaatttcgaaaacatttttggttaaaaaaatactccctcctttcctaaatgtttgacaccgttgacttttttaaacatatttgaccgttcgttttattcaaaaacttttgtgatatgtgtaaaactatatgtatacataaaaatatatttaacaataaatcaaatgatagaaaaagaattaacaattacttaaatt

SEQ ID NO: 7226 - DNA, 1501 bp, Oryza sativa
aaattgatgtcattatttttttacgaaaagtccgaattacaccctgaaactattgggtgagcgaagtaccccctaaacccaaaaaccagatattttttaccctcagctattaataccggacgaattacccccccaccccccactcaagccgaagtggttttgatcctacgtggcagtccaatcagtaatttttttaaaaaaaatcggcgggtcccacctattagtctctcaccctctatatctctttctcctcccctctctctctttccctaatcccctctcttcttattccttccctcacctccatctctctcggcggccgatgggggcgggccgacgacgacctgccacgtctacctagtgcgattcgaggcggatgcggtggtgaaccgcccccctgcagccacatcttgcatcacgcctacctcgagacatggctcgactaagaccatgccacttgcctcgctctgtcactcccgcctcctcactgtcgttggccactgccttggccctccgccgcgagacgcacgcagccgctgacgcgtctcctccttggcatctgacaagagagagaggggtctgaggggcgaaatagataatgaggagcgaaatagataatgaggagagagatctaaaggtgggccctatcgactttttaataaaagaattattgactagactaccacgtaggatcaaaaccgcttacaaagctacccgtggtggtttttcatctagtattgatagttaagggtgaaagatgtctggattttaggtctagagaggtaagtcgtactcacccaaaagttcaggggtgtaattcaaacttttccttttttttcttaggtagtattgtgttttatttgtaaatttcatttgaagtgaaatatcaataaatatagggtaatttttatacttggggaaaaatggaagccaaacagaccggaagaaaaaaaatacataaaaaaaaataaaagctgagccgacgggaagtggaaaaaaggaaagcagaagaaatctctcgtttattccaatcttctcagtctctctattccccacgcttgcactgtgaaaggccttatccttttcccttttagggccctttgaatcgtatgaatgaaaaaacacaggaatagaaaaaacacaggattctgacatgaatacaattataaaacagaggattgcaaaatacagaaaaaacacaggaatggccgtttgattggaccacaggaaaaacgcaggaataagataagagagatagactcagagaaaatggccgtttgattggatcacaggaaaaacgcaggaataagataagagagatagactcagagaaaatgttccaagaggttagatctcttgctaactttcctccaaaatatacataggattacccattccataaaaattttaaaggattagataggatacaatcttttgtttcaaagaccttcgtaggatttttttttcatagaattgaaatcctccaaaatttctacatttt

SEQ ID NO: 7227 - DNA, 1501 bp, Oryza sativa
gatatttctcctctagctttcatgatggtagtcggacatgtcatgtcacgtgggaaaagtggcaagggactatggatgcttttccattggcaaaaatttatgaataaaggcaaatgtggcatttgaagaattggcaagggtggcaaataattaaattctcttttgcagagacgtggagagagataccgctttctccgtttcctactcgctgcatcactcatccaagcacagtgagcccaaaaataacattgggccaatgaacccgagcccggcctagccgtccctcgtgcgggcgattgtcacgccttgattttttttcaaggatttaaacttatctaataaaccatttttagaatttatattcatgtgtaaatttattgacaagtgaagtaaataagggaaataaaatttccttaataaatcatggttagtgttacttttcttaaattctccatgcctgaaaatactccttggattttctcaaaattcccatatctcaatagctaatttgaaaatacaaacatcattacagtagtaatcatcaaagtgaaaaccgctaaattgtcaaccactcatgcccgctcactgctccttctccccacctatcgttgcttctcacagctagatccggcaaaggtaagcttggagtagcccagatctacgatctgcgagctcagcactgcacgttgtagccaccaaagcaggcaatggtcccttcaagctcgggcagctagaaggctgggcgagcattgacggcaatggcgatgcctacgacgatcgtgcagcaacggagaggagactacaacgacgactcaagaggagtcaaggaagcaaataagggaggtgggatgcatccccgcctcgctcaccatttacaacctcgcatcccgacgttcgtccacgcaactgcatgcacttagtcaggtgagaagtgaagctcaatttgagcaattccctcttgtcttgctagtcagacgattttcgtacatgtagagcttatccctacaggccatgctagcactaccaaaaaattgatacaacaaaaattgatttcaaacaaaaaagcccataaaccaaacctacatggcctataggataagatctttgtgtacgaaatctatcaaattttagcactagcaaatttaaatttgatagtatagaattggttctgaggtgaaaaaaaaaacggttagccaaatacccaagttatactagcaaaagaattgataaagataaaaattagcttcaatcaaggtaaccaaacacgccagagcttcaagccttcaatccagttagcccacaactgatccgggcggcttttttttcttaaaaaaaaaaagggacccgggggcctcgtgacgacgtggcttctcccaccaccgtaactcccgccccctcgcagtctccttcccaacaactggtccatacaccaccaacccccatacccccgccgtttcacctaccacactcccggctctcctgcaccgggcgcacccaattc

SEQ ID NO: 7228 - DNA, 424 bp, Oryza sativa
acaatggtggtacagtggtgcaaaatgatggttgcaccttagatgtgttccaggaacagggcatgcttcatggtagaggtgtgcctcgagaccttagtccacaagagttgaatgttgcgatgttatatgtcctgacaaattgctctatggtcgacaaatttcaagagtatgtgatgaaaatttcattatatatagtttgttacaaacaaaatttctaatcatatcttatttgtagaaagttttctgaagagaagcatgcaatgcataataatctttcagtcgaggggcttgatcaattgatgagagaggaatttgttgactggtttaagaatgctgtaaaaactctatatatatccttatattttcttacctataatgttcaaaatatatatttttaatttctaaattatttacttattgtagt

SEQ ID NO: 7229 - DNA, 822 bp, Oryza sativa
  unsure (1)..(822): unsure at all n locations
tctagtagcagttttcattttttttcaaacctttgcacgcctccgttaccttttgggaggcctacgccgaaatagtgtgagttactcgctcgttatttttgtgcaggattgactaaacagctttcgtagtgcccattttcgttgattggcgagttaatacaggaaaagaaaaggctgtaccaatcatgagtagtaaagcggtaccagtgaattttttgctttttcagtgaagtactcttgcttaacttttgtccataaatcccgtgtaagcagtaaatctcgtaattctcaataggccccctttctgttaagtgaagtgaggcggggtcgccgaacgaacgacgttagtttacttgcacgcaattaattatcatctttgaccacgagccattctagacagtgccgtcggcaaagcattttttaatggttttggtagttcaatttcacgtcatgaaagattagatagcaaccggtataggctctagttttcctagagggggttaaacccaccccaggtagagacactcagtctaaatgcccccccccccccccggtcnnnnnnnnnnnnnnnnnnnnnnnnnntcctcgttagaaaatacattgctaggaagtaaggcagaggctgcatgccttactatacgttacctgcctggaaacatgtaagttcatgtcccgcaagttagcgaggttggtcgggcggagactctcgaacgaggaaaaggatctcttcgaaagaattgaacgaggagccgtatgaggtggaaatctcatgtatagttctgtagagggacaggaagggagacttatctgtcgacttttcca

SEQ ID NO: 7230 - DNA, 1109 bp, Oryza sativa
  unsure (1)..(1109): unsure at all n locations
tcctctttcactctcatctctccctctccccttcctcttccacatctgagttttcctctcttccgttcctcagatatgcgggagaagcagccggcggcagctgggcccgtgcaggggaggggcggcggcggccaggcctgtgctgggcaggggcggcagctgccgtagctaggcgcgtgccgggtggggcggcggcggccaggcccatgccggaacgatggcgactaggtggtggcggagcgacggcggcccggcgcggaaggccgcgcggcggcaggctccatggattttttttcttttttccttctcgttgtgtgaataatgtgaataattgtttgttgatttgatctgtgatttgagaatgatgtgtgaatggatttgtgatttgttgttgtggatgatttgggatgttgagatattgggttgttgttgtggatgatttgggatgctaagatgtgtgaacaatatgtaatgtgtgaacacaatctgtgatttttgatttcttattttttaatgatttggagatatttggcgccagaaaagaaaaaaaaaggaaaaaaacttttgttctagttatttcaatattaaaagcgacgtttttagtcccggattcataatcccggttgaaaaactgggactaaaaacgattctccagcagtgcgtccctgttacttcctaaaatggttctagaaagttggctgttttcttttgctacattcatatttgctgaagtcagtttttggcccaggagctctgtgcagcattgcacctggcttanacctgncgtgttcttccgggttggcctaatttgttcctttctaaacctggccatttatgctttcattaagcattgttaaagcatcctaaaatttgatcaaaaatttaaaatatgatacttcggaaatttttccaaattttggaagtttttatcctagggatattttggtcacttggacaaaattgtacagtactaacgaaggctaactggacgacgatagtaagtcgtagaagttaagcaaaagtcagtggcaaatcgtaaacctatgacaaactcagtggtatataatggattatatctaatatatatacacacatgtgtatatacttat

SEQ ID NO: 7231 - DNA, 945 bp, Oryza sativa
ggctgtgcgaccgaacagggcccctaaaatattatgtcctatatataataatattagaggctttaattttgttaatttgcagttcaaatagtagtaaaacaaggtccaaaacgctgcaaaagatgaaccaatccatcttccatcatactcctgtccaggcgtccacgtcgttgcgtattgccgaagtcctgacgccgcaactgcttcgtctcctctccccagtcccctccggcctccgcttctacctcatcgctgatgataggctgatcaccacgcccctttttaattttactataaaaaattactaggctactagggccccattttaatattttgcacacgaacccgatttggcctggacgcccctggctaactcaatcaaccgggcataggcccaggctccctggttcggtgcagggatgtgatacttggctagtatatgtggttcaattatttttatttctttggtgtttagtctctactattcttatctctttaccacattgagaaagtgctggaaaattccggaataccctcttttatccaatggctgagatttattttatctattttgtcacttcatgaatctaacggctaatattaatatgatgatgtggctcatcctaattgtattttaggattcactttacactagtagaaatttgaccaaatctgtaaaaaaaatcattccgaaaattaacagacatgtcagaaattttgataccccggaatataaaacgaaattacgtccatgatggttaattacacatgccaccaccggaaacatccaatcccaatcacaatttcactttcttcaatatggcgtgcaaaacgccgccttattttattgcaaataacatcacagtatcacatccaccaccttcattttatagctgctagaagtctgccagtttccagctcacaccgtacactcactaaaagccg

SEQ ID NO: 7232 - DNA, 1278 bp, Oryza sativa
ttacatgtaatctgatgccaaaacaattagaatagttcagctagagggccaggaatttatctcgctgacgaaaatgcaagcgtgcgttaatatttttacagaattgcttcagcaatacttgttcctgaaatacaaaggaaatagttggtaatcatataccttcattcttctatgcaaaagtggtatccctgtgtggaactgaaattgaaataagatgtataattatatgaatcccattaatggtagattacatgcttagcacttaaaagaatgcagtaagccaatgcaaagaatctgccaagtacaaaccaattaataacataaagttgaccccaaaaccagtttagattatatgttacacccagaataaagtattgctacaaacagagcacaattgttcagcggtagctttgagtttctcaataattcaaggttggaaaacttttagtaaagaaacatacatggattttctgtcttctatgatgccagagaatatatggtgtaggcaaagtacatagcggaatttgaccaatatcatgctatgatcaccacctgtgaaaaaaaaaatgtagcgtaaaccacttagcgaaacagttcataggcgaaccaacaatttcaatagaatcttacatgtgaaagtgaaacatgtaacacattaatagaaaatttggacattataaaatataatattttaagcacgataaatatttttaaacggtatatgactttccctattgtatcaatagtagaagcatcagaaccataacacataagagcataataagcaggagaaacaatattcaaactaatgcatgtgcttaaaggttcaagcactcccttcctttacatgatggtcgtgtaagccggtcgttacatggtcgttgctcttacatgaccagatcttacatgaccatattcaggtgtagccttaactcgaccactataaataaaggtagtgggagtatcgctacacctctggtcgagaaccaggtgtagccttaattaactcgaccacgagaagtaaagctagcgggagtatcgctacaccgcttggtcgaaaccaggtgtagccttaactcgaccacgagaagtaaagctagtgggagtatcgctaaaccgctggtcgaaaaccaggtgtagccttaactcgaccacaagaagtagaggtgcgagagatcgctacagcctattggtccgagaactaggagtaagcctcatctctcgaccgattgacgtcgaggtacgagagatcgctacggcctactggtccgagaacca

SEQ ID NO: 7233 - DNA, 1501 bp, Oryza sativa
catggcaattaaggaccggttcgcgggatgcactggaagacatacagcgcttgccacaaccgggaatgggtaactacctgacttgaagtatagctttccgctggctgatgcatccaggcaagggtgagcgtgatggagttcggatgggccctgcgacggcctatgcggctttctgattcgcctaggcacgagaggggactgcctgttgcctgctgggggcaggggtgaaacctgaggtgtggtgtgcttggtcagagggggttatatgaagggtcttgtcacaattactcgacatggtgacgtgtctggcctggcacggtgacatgccgatggattgtgtcatgtgggtacagtagtgcacctctggccagagtaaaactattgaaatagccgtgcccgcggttatgggcgattgaccagattcaccgtgattagtctcacacttaataaatcgacccaatgcactgtagttcaggtgggatggttgggcctgttcaacgtggtgtagtgttgatcagtggagatttaatgttactctaattagtcaacagttttaccctttttctcaataaaatgttttacaaccgcctttatgcaaatagcaacaaactgtccttgtattcccttgcacgtctgcatcattggtgtggcttgctgagtacggtggttgtactcagttttgctattattttccccttttcagaagtgtagtgcttctgagctgaagacgaagttagaagaccaaggctcaaaccccagttgtgttttgcctgaggagtggagctgaagccccgctaggatcgcctttttccgctgctgctgctttcttttcggtgtgaggactaagagcctcttctgtaagtatttactctttatttacgtttggaactgtttattacttgtcttttgtgtaccctggctgattcctggacagggatttaatacacaaaatagtctggaaatttgggctaaatttctgggcgtgacacctcccgtcattcactcaccctcatctcctcctcccctctcctcctctcttctcctccggcctcctcccatcccctcccctcctccactccgctcccctcttcccctccggctcccttctggcgggcggcggcggcggtgtcgtggggacgacatgaggggcgcgagggcagcagtggcctcccctccgccggatccgggaggggaggcggccgtgcggtggcggcggtggcgccggggcggcccgaggggcgcgagggcggcggcggcctcccctccgcgggattcgggaggggaggcagccaggcggtggctgtggagttgattcgtagatttttttgtgaattgatttgtaatgaatgatttgtagttattttttattgatttgtgattgatttgtggattgtggatgggcatgtgttgtggatgattgtgtatgatttgttgatggttttgtggatgattatgtatgatttgtggggatttgggtgtgacggtgatagtcgaggtgcaa

SEQ ID NO: 7234 - DNA, 1254 bp, Oryza sativa
ctaattataaaaaaatttcatataagacggacagtcaaacgttggcacgggaacccacagtttgccttttttttttaacggagggagtaggcttactccatctcataaaaaccatcattttgggcctattcactttgatgtcatttttaaccataccattttttgataaaattgccaaaaaaaatgtctacgtttagtccaaatttggtcaatacacaaaaaatcctgccaaaattttaacaatattgtcatcttgctaaaattttagcattgctaaaatctggtaaggtttattttaactacaatctgaataggcccaaaaaccaccttagattgattttttatcggatggacagagtactagttttttttatgggacggagggagtacgtgccaacgatcacgtctggctttatcagaggatctcaatattgatccgattgtttagtaccgacagacatttcggctgagttctttggctacctttctccttttcacacgtacgtttttcaaactactagacggcatatttttaaattttttttataaaagtgctttaaaaatcatattgatatttttaaaaaataaataattaatatttaattaatcacacgttaatgatcacttcgttttgcctgtttggggttagaggatctcaatactgatccgattgtttagtaccgacagacagttcgtgttcatgcagacgcagaaagtccgggcaacatgtcgatttcaacagcccaaaaaagcccagtcagtctcggaattggacaaaccgagcaggccgcttcgctcccggcccaaaacaatgcggcccaaccacgaagccgccactttcctcctccgcaaggtcggtttccttttgtcctttcagatctctctctctctctctctctctctctttctcgtctcctcctatccgcgtgcatctctctccccgtctcgattccccaccagcggcgaaaccctaaccctagagcggccaccgccatggagaagcgcgcgaccaccaccagggcggtggtgctccgcctcgacgacctctcccttccgccgcgccgcctcaccgtgccgtcccgcctcccggtctcccacctcctccgcgcgctgccgcagccgctgctcgagtcgtcgtcgttctacctcaccgccgatggccgcccgctcctgctgtccgcgcccgtggcgtcgcttccgccgtcgggttcggtccagctccgcctccgcgcgctccgcggcggtggcggcgac

SEQ ID NO: 7235 - DNA, 1501 bp, Oryza sativa
acttactccatacttacatatcacttacataccacttacaccacacttacatatcacttacataccacttacaccacacttacaacgtaattacataccacatacactacagttacaatgtaattatataccacttacactataattacataccacttacattactagttatagaataattacattgtaatttttatgtgtttttaatcatatggtttaaaaaataaaatacgtactagtccctaattaatcataaaagggtgtacgtagttggaggtccactgagtcgttaggtatggattagcagtagagaaaaatccgactgcgtttgggttcgttttatggcgaatgatttgtagatagtcccaattcaaatagaaacagaaagacatattttccgatacctttctttacgaaaggtgccaaacgaacatctctgaaccttcttttgtttttcctttgaatggcatctctgaaccttttgtgttagcttaaacaaatcatcatcatcatcatcttgatcaaatgtttggcagagaacaaagtacatatcacacgccaataaggtcgaatccacaaagggatttttggatattgttgacatggaaagacgagttaggagcacaatcacacacaacattcagaggagtacgaaaactttttccaaagggaaaaaacatccacaagaaaccaaaagaaaagagagaaagtagaatgcaattgaccaacaaaactacaacagcacaccaagagaaaaaaaaaaggaagaagaaagtagcacacacagatggtttcagcaaaagagttttggtgaaatcctagaggttggcgctgctgcagcgtcagcagcaggaggaggtgctgctttggagaagccaacttggctgggtaggccaaggtagagcattctttttgtctcttgttagagtggcatcccctgcacttatgcaccccaaagggggagaagaaaaggcaggcctagcagtggctgaaaaattgggtaaatgcatagctatctatatttttaaactctttatttgaaattttggaaatgaaccaaattctaattggttggcttcgttcggaacggtttttttgttggtgggcttataccggcatgcgaaataagatgggtcattagcatgtgattcattcagaaactattataaatgtggatatttttgttttatttgaatttttatggaacttctatataaaaagtttttgtacaaatacaccgtttagtagtttgggtcttcaggaaacgtactcacggacaatgatggagtagcctagccgagaatccaatcaaaatgcagcctttgttgataaatctttagttaattcaatgttttagagctcctctgttgtcaaacaaaatcactgcataactcaaaccatatatcttagtatgtcttttatttttgccaattacatttttctctaatttatactgcttccttagtgtagttttggtcacatactgactttggttttgaac

SEQ ID NO: 7236 - DNA, 1157 bp, Oryza sativa
tagtgctagttttctaataggatgtagaaatggccaagatggtagtgtcatcaagatatatgaaatttaattgtttattgtaacaacatctcttttttctttataatgcgagttatggtaactctcctctttcctgcagccaaagaagtggcgcctgaaggcacaactgatcagtcacaagtttcccatctttacaacaaggtacttatggaacaaagttttttttttttgaggggatcctctcaaagaaaagttttcctatgctaactctggcctgaaaattttcttgagtgacaacttcctatctatctatgatatgcagatgtgctttgtccttgaagacagtgctgttcctgcactcaactcgcatttcggtgacaaggcagcttcctccggtttagccaatagcctccataagtttgaagctgtatgcgaagacgttagtcgcatcttgagatcccatgaaaatggtaccactcccaaagaggaagttatgctagatgcaagctccaaagagaccacgtctccaaaagatccagcaaccgaggtgccttcgtcagcttccaaagaagctacgcctccagtacaagatccagtcatagaggcagtgaaggaggagccacccactgttaaggcggaggacaaaatggaaatcgatagttaatttgtaggaatcataacgataatatcgaacctttttcgtctaatctaatcgctaaactggctgtagcttttaccatattacaagttgtaaactaaaaaatcactctaagctagtctcatcctgtagaggcctggacatctccaggcctgagatgaacgattaccatcaaatctgtcgtactaaaggttaccaggttttgctagctcctgccccgctgcatctgttaaatgtttaactcttcactgtcgaataggtcacttgactggtttgccatcaggatgattaggcccattgtaatgaccctactgctaaagctgtgttgctaattgtggcattgtgatgtgatgatcccaacgctataaagccgtgtggctgattgcgattacgacgtaaacatcaggaccgtagggacaggacaaactagcatcgactaatcatgagatgccgtgattagtagttgggtcggaggccccaccccgagatccacacggga

SEQ ID NO: 7237 - DNA, 636 bp, Oryza sativa
atcagaacggtatgtcttcagtatagataaaactaattaatgttatcacattaattaatactccctccatttttttatatgatgttggttagttcaataaactaaccaatgttatacatatatggatgggggtagtatatatataccatgttaaatagtataggtgaatatatatcttctctttttctctctagtactgtgcttgaatgtgagggttggcttaagctttttttcattgcaggtgaaacgagacgatcgagtatacatttaaaactattataaacatgaattttctctttctctctagtgttgctatcatcaatgctagtagcatttagtgggcctaacaaaaaaaataatgcaaggaacaagtaggccctgtttagttcccacacaaaaattttataccttatcacatcgaacgtttaaacacctgcatgaagtattaaatatatgctaaaaaataactaattacacagattgcggctaatttgcgaaacgaatcttttaaacctaattgctatatgatttgacaatgtagtgctatagaaaaatttgctaatgatggattaattatgcttaataaattcgtctcgctgtttactgacggattttgtaattagtttttttattagt

SEQ ID NO: 7238 - DNA, 1501 bp, Oryza sativa
ccatttctgcaactgaagatcacaatgtaccttacaaatgactgttcaatgtcgtatataaatagacagaagattgctctgacatttcatcaacccttttctaccaaattggaacagaaatgtggcaaaataccaaattccgacttgagatagaaattttgattagtaaaccaaggatgattttcccacactgtcagccagacaaaatgttaagctagactgaaatgtcatgaaaaagaagtcaagatcaccaccatgatttcttcttcttttttttctaacatttcaccaccatgatttctcaatgagataaatcaacaaacttcagttttcttctgtaatcaaatacaaacagcatcatgcatgtcctctaatctcttgcctaataagcatttgccttttccacacactaaggtgtactaaaaacaaaaaatgcagagtgtagttgtagttgtagtgtagtgtagtggtggaaactagagccacattcacaaaagtctcaagctgacattaagttggaagcttgtgggggtgtgaggtccacacttagcaacaggacattgtatcatatgcagccttgttgccttgtcaccagtcatcagtccactcatccccatgcccccctcattctgatcctttataaatcagccacccagcaagacattcctttccaacctcactcaccttgctctagctcagctagctcttgctgctagtagcttcagctttgctactgctactaccactactactactactactttcacctccaagaaagtatagattgcaagaacaatttctgctgctgttgttctttcttgctgttctttctccttgtgtagttgtgtggtgtggttgagctgaggtgtagttaggacagtggctggctttgcttgcttgattggtcacctgggaaggtcgctgtctctgccttttgttttctttgccatctctttctttctgggctgctttcaccttttgctttccaacctcttcttgccatcaataatgatggaggagtaagatgagggcttgttcttgaagtctctccaatctaatctcatttcatcttcatcatctccacccggtccaaatccacctactactgtttttcttttgtcccttctcttttttttcttcctctgatcttttcttttttcaggtgttttgtttttggcagtaggtgcttgctatcttttcattaggctttggattttcctctcgtgttctttagtctcagcctattagaggtttgaggaaagttttccatttcttagctctttttgcttccagcttcttgggattgctctgtttcttgctgagaattggctcgatttgggaggcctcatcttgtgttagctttcaggttttcttgcctgaaattgaaccgattgggtaggtttttaggtgcttcagtttcagttgctagctcgtcaggcttgttcttgggctcctgccttgaattggggtcaaattgggatgcttctgggtgctttgagga

SEQ ID NO: 7239 - DNA, 246 bp, Oryza sativa
catacaaggcaaacattgcaaacatgctataagactactgaaacagggaacaaaaccatttttagtggattctacacatttttcttgatttactgagacttgaatgggcttaaacggagctcggatgaattagttatgaattttagaagattcactgtgtctattactataaaagaaaaaccttaaatcatttattgcgcaataaatcccagggctgacgtcagcacggagggggcggtgccgaca

SEQ ID NO: 7240 - DNA, 1501 bp, Oryza sativa
ttctctaacaaacgacggcatgtagggaaaaaaaaacaattctaattggttagacttcggctgaaatccgtagaaaaatgaacgaggtattacaattttttttttgtggtttaaaagccaagaccgaaaagaatagactaccatataaaaaccctaaaatcaactaaccataccaaatatagtttagggtattgtgaacttttttttttttagaattgtattgttaacttcttttttttttgacacggataactttagtttccattaaccagcagcctcggacaaatcgccggagaggcggagaccaaactagttacaaactccggggcttggctccagtaacaagttgagccaggggccacggtaacagctccataggaggccattcgatcggccaccttgttacagattctagggcaaacagatatcaaaagaagtgattaacagggccctaatgattttgaacaaagctccatctgcactccgatccatctcctgggaagaaattgtattgtgaacttagagtaagtttaatagtatagccaactactagctccaattcatctataaccaatctaatagctcattcatacaatagttacatactacactattaatatctagtctcacctatcatacacacactgcgtcttggagtccgtgctataaatctgtagcccgctgcgcttctctctccttatttatctgcttaaaatatgtttgtagctggcttatagcctgctattgtaactgctcttattcctaaattttaactacgactgataagccaacgatgaaattaagttgggctggaatacatgggcctcgtgtggtcgtttctctccgggcccaacacgagcccgaaagcttcgatacttctcccagactagcggcggggaggcgaccggcggcgacaggtggccggctgcccgcggcgccgcggatttgccgtttgctcctcctccgggaccgtgtcaccgggcagcatgacgccgcgcgacggcgacgcggcgacgcccttcgactgttcgacgcaatgccagggggaggggttggggttggtctggtggaagtggaacggagccgctttgctgtgaggcgccttgctcagggtgttcggcgaaatgcccgagaggctgtccagttccggtcgggcgccgactgcggccgtcgaagatctcgtggaggtgggctcgtcgaccaggcgactgaggggccatgcttcgtgagtgcgtgccgacaatgccgcgctctcttcacgcgcgccagtgcgcctccttcgacatggtcagttgtgctgccttctctttcagctccatgctagtccctagcatttgtgctggtattttatcaacgcatttcacaaccaacttagcaaaatatcttggttagcagaatttcacaaccaacatggttagtagtgctgacctagttaattttttcaataacacattgatgatcggaaacaaactgcttatagcagaatatcttggtatctttc

SEQ ID NO: 7241 - DNA, 175 bp, Oryza sativa
ccagccccagcgcatcttctccttatcccccggccgccagcgcctcagcgcttcttctcctcctcccccggccagcgccgccgttccacttcctccggccggcgcccccttcctccttccccggccagcacgcgtttcccagccgacgcccctccctcttccgtgggcttgcagg

SEQ ID NO: 7242 - DNA, 385 bp, Oryza sativa
gtgtcctagcacttctatgctggcatcacgagggtccactgtttggcgcttaagatttttgaactcaggtgtagcttctgtttctgtggaagatcttaggtgtttatttggcgtcgatactggagttgataggtctagatattgttcaatgtggtccaataatggttgcattcggtggttataacagttatccatggcaataaacaaggttgagagcggttacttagccattgcactggtttatacacatacttactattgcctcgtgcgctcgggtacgcgtctcattgagcacgtatttataggggagaggaggggggtccgggtgtggttactttggcctgcttttgtcgagcacgtgggcaagagagaggagaggggaaaa

SEQ ID NO: 7243 - DNA, 1501 bp, Oryza sativa
cgccacccttttatcccagcgagttattagtttcgagcatggctgcattggttaagttcgatctccggcaaggaagttccatcaactttgcttgtatcagcctggcgagaactttctcgattaagtctaatattctatctaggttgatgcaagcattgcctatttgatatattgattctatcttcaattgcattactgtttagagcttgtataatcttagttaggactttcttagttgggtctgcatattctagctaagttggtagttctctaattgtactattacttctagatagcatctctattatatccatcacgtttgtatagatctatcggctaagtaggtttttcttcacttatctttagctcttatactggtctctgtcaggcccaatctcttagatctttgctattttgtctaattcttgtaagccggtaaggtttttatgcagcgttcattggagcgctacccgatgttatcattattttgggcttcaactatcagatgtatcagttagttagccgatatacactttaatttacttacattagatctccagccaatgtatgttttaaccatcagatgtacatctaccacattatattagttttagacgatttgttcacattatattatctcattgcatcttctgagttacatcggcttacactcaaacttgtataatctttagttaaatctatatttatcaacttctatcttatattgtctcagtttggtctgatctatcaagattgcttttgataaagaacggttgtttagttccagccgatgataacatagtttagttccagctggtgataacacaaatctcattgcttatctgattatctgaatttacattagacctatagccgattattcaaaaccctattgacattggttggcctcgcaacatcatatcagtttattggtcgattgactccttgatcttatacgatctatctatctatctatctatctatcttgctagttgcaggatcaaattaattgttatgccctacactggagataagcatatttccaaggccttcgtgtgtcacgaagaatttcacatcagcagggtgcaacccccaagggctatgctcagggcacatttgtcacctaccctccgagagtggccccctatgggttgttgttggtatttattctgaccacataatagtctgcaaacgcacagataccgttgtaaccttcacccaagggtattccaaggtatcgtattcacatggaacgtgtgtgtataatctaagaacaagattcttccaaggaaaacaactaaatggtaggtataggatagagaggactcccatgggttagttatcttaatgaagttatggtaaaactctatcaatttcttcgacactggcgtacccctggtctgcgaaggaaactctgccctatagctctaggctggcaccacctgccgcctgcttctacaacccgtgaaacaccaacaaacaaaggtaaccttctacctag

SEQ ID NO: 7244 - DNA, 1012 bp, Oryza sativa
ttaggaccaccaattgacttgcttgctgttatgagccatttcttttagtagtctctattgacaatactctactactattattatcaccaatagaagttatcttaattgttgatttatgagttctaattaatatcagtagaataaatgattctattactgtacttgtgaggtgacagtataaattgatatgatctattggattagaaaaaatgaacgacctagattgattctactacgagcacagaccagtataaagaaaacttttaattatgtgctattgcttcttgtaatgttggggaaaaagaccagctgggcttgatagtgatagttactcctaatttatcagcttctccaacttgctgtaatttgtaagcatgcatgcatcgacaatgatgaaatttggaaatatgataatactaatataatatgaattgccttcttgttttggacatgtgcttggttggtgactagggtaattggcttgaacgtaaagaccagactgaaaacttttgaaaagagttgaatttggttcaacctgccgattatatattctggaatttacatcctgattattgatacaattaggcagcagcacatggacatgatatatatacacatctactacttagaagaagcaggcaaaaacacaagatcggtggaggaactatgattgaaatattgaattaaccaaagtaaacgcaatagaagcttcattattgatggtccaggagagatgctctttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggag

SEQ ID NO: 7245 - DNA, 1501 bp, Oryza sativa
ctttattgagtccaagataccatactattaagacggaagccacatgtaataattggattataatttagtgctaaaagttgcattttctcaaagtcttggtactttttaggttggaatatctgactcactgacagaattccaatgcattgaaattttttttagccgagttgagggttgggctaaattaaaagtgatcaagatatccgctgcaattttggaatatctgatccgtcggaatcttcgtttttctaaggaactcgattatgtgtttgggattaaattcttgactggagttttcaatgcttacatcaaataccagacggaccgaacaatccaaaattcaaaggactcaactcttgggtagaaacaatatgctccatcacatatcgcctagtagtatgaacataagatcacctggaatgccttgtattccttggaacttgagtctcagtttggtttacttctttgcttttggagttttcgatatcaaaattggaatatccgaccagtatttttacgagacaatatttgtttgtcacagttggagcatatccatcgatgaagtcagaatatccaaggtgggactaaaattaccacccccccccccaactcccccacaacaaccaattttatgttggctatttaaacctccacccaacccttctgtaaggttatccattcatccaattcaatcttgcttgtgggtagagctttgcctatagtgctttggatcttgaactctttctcttgctctctcaaatccttctctatcgttgtggttcgaatctttgggtgtgtggatttggagtttcagaccaagcatgggcacaaacagacatggggtaggttgggcttgagccctatgcctagctctataatccccaatctaatcttgaaatatgctatataatctgtgaaaatatttgagctctaactagctcaggcttacgcacgaaggttttatggctctgccgctgtgaccaagtgtgtgcttctcttgatatttgagcactatatatggttgtttccatgtagttgtgagggatttattattggaggtgttgaggactcgtatatggctaggtgtcgacctcggtcactattttgattgtggtgagccaaggaagtttgcaaaggctggatcttgttcaagcaaggagaatgtacaacaagtcgaggaggattgcatttgtagaacatcacaaggatagggttgaaaaatatctggatatttttaagctcctctacggatatttttaagctcctctacgaagacgtagaatctcgaggtttcgaactctgggaaatacattgttgagtaaatctataacgacacgattttttgggctgacaaaaactattttagtaaatccctaattccaaaattttttgttctctgacagtggttaaggactaactgccaaaagatctaaaaaaatccctgcttgagaccttcctaaatcactggtggagaaaggggctttactcccggttcataacc

SEQ ID NO: 7246 - DNA, 748 bp, Oryza sativa
tcaagcttccagcggtttgggaaagcggagaggagggatggagattaccttggccctcgctgttgctgtggcgggcgaagaggtcggcgtgggtgggggcgggggcggtcggcaacggcggcggcgggggaggcgggggcttggccttgggcttgggggaggcgctcgggttcatgtcccaggcggcgcgcacgcggaagcaggggcgggggtggtgcaccgccgccaccatggtcgtcgcggcggtggtagccatgtgtggacagaaagataaagtacgttcaatggtgtcaatttataacctgataaagaaagaatgttaaattagattcatgccaagtggcacaaatgtcttttagaaaatttataacctgataaagaaaaaaaagttaaattagattaatgccaagtgtcacagtatgtcctttagaaaattttgagaaatgaaaatttcttataagagtataccttgataaaaagatattgtgtgactatgagtagtttgtggtctagattcttcttaagaaatttatgtgagtttggatgagtacaaagtatgtgagcttacatttttcgttctaagggtgtttggatgagattcagtaaccaaattacatcagctaaaaacggaaatcaaaattaacaacttgaaagtaggtggagctgggtagaggcagatctaacccccaaactttttgagggataacgcagaatacctgatgaggtatgggtagagagggatgctcac

SEQ ID NO: 7247 - DNA, 1501 bp, Oryza sativa
gtcttaacattttctgacatgactaaacgaagtatattttatttttttactagtatttatatattttaatcaagtactataatggtactcttcacaacgtacaccatgtgcaattaaacgtcacagcaacattgatatttatatatttttgttacgatgcatattcattgtctggctaacatatgttcacatcaaggcctcgagggtgaggacactacatacgtaaggagatatgtgcctggcaaagggggatgatgttgtaatgttgttaccagcagtaatgtgttgcactttgacacagtttcaaatgaaattcaaaattaaattttctgggcacagacagtgtagagatggaagtgggaggcgtcaggataattacttgtactactcctgcccttgaccatattggagtgcacgaatagttttggctcctccacccagccaagccgtgttgtttgtgttggtaatgatggtcaatgtactgtagtgtttctcatgcatccgaggctgcagggagatgatcgccaagagagacagaacacttttaggaagctgctttggtgataggtgcatagggtagagaatgccacagcagaagatggtgacttgtaccctcaagaacaatgagctgaatgagtatggctgggctaaaaagaaccagcggtgatatgggacaagaggcagaggagatcagaatgaaactagtgaaacaacaaaaagtcatgcaaaatttgtagcttattcagaagcaatggaagcgatgttttctttttccaaagttaacagagtagtttagaacagggcagcgagtcattcgaattgtattagtacttgatagtgacatctcaatacaggaaaaaaaacttgtacacttcctcatttgtaccttatcacttttcgctaatttcattatatatacggttatgctacacgacatgtagcgtgctaggaatccaatggcgtgcctccaagctccttctcctctagttttcccttttttaaatcactaagatgatgccccgcaatttgctgtgagatatacgttagatagttgagaaatgatgaaatgatttggattgaaatattatgaaaatgatttgagaatgatgatttagcatatagatgtttagtttttgaatgaaataaattgtgatataattagtatatgtttgcatgttgagttttgatgtggcatgtttacatgtaggttttacgagtgctaataaatattatgtttatatgtttagctttaggtgtttagtggcattaactttatagaaagaagagatctgtggtcctatccccaccttttacgtgttttcttgttcttttcaccaccttttccatagcgcaaccaagctggatcgcctccctccctactgccgaaattacttccttttactaactcccaccatctatatccagtaaaagaattactatcagtggtagccgaacaaaaaagttactaacggtggttgtttccactttgttagggtctatg

SEQ ID NO: 7248 - DNA, 1501 bp, Oryza sativa
tttttttgaatgcgcaaaaactttgtatgccaatatatttatatgtgtgtgaattttataggagtgaaagacatggaagaactgtagtactagtcaaaacatgcaggtgagaactattgcagagcaaatccctcagtgtgggagtcgtttcttgaaaagctgtgttactgtcttactggtaggctgcacaaggaagaagtcgtcacaatagatcagatatcatgaacatatatgatatatgaagtgatagttgcacggggaagaaggtagtgttgtactattatagttacaaccgcagttcaccagtagagattcaatattttttagagtcatatatattatagaaatagaagtggaaagcattgggtaaactaatactcctgcaaggtaacatctgttagaggtggtttgagggaaccacgagggcgtcagtcactaagaacatgtacaacgccttcagttagcagttgatgaccgatatggattgaacgcaccggcaaccaagtttggtgctccttagacaaggaaatttttttccatacagtagcatggtgagattggatgatcaacacaattcacagaggttgaagcaaagaataaacatggtgatttctttgacaagaaaatgcttgtacaacctttttagctgctgccgaagaaaaactaagtcaaataagcattggtatgaattctagcttgaggatagatggtcaaaattgttggtcaaggatgacaaaggagcacaagaatcattccattccgatcgaggctatctcatctagtcgtcttaccagtagggatgaaattttggtcaattttggtaattttgaacccccagccataaactatcttatccacaatttttgtatttttcaaaattttaatttggtcaaaatttattcaaattcagtcataactttattagattttcattatcttaaaaaaattgttaaataattttgtaccgaaattttctaaaatccctgaaattgtactcgtcattctgatatcaatattttttttcttttcattgtgcaattttcttttcggtatgcaatcaaatggtccgttagtaaattggatgttgtaaaactcgtccgaaatcaccattgaaaccaaacgcgaaataaacgtcatagaagatccaaacacggtgatgataccgagacacgatacttaataacagatttcagccgtagcctatatatacataacactgattacggatactcctccttggtccatcataattacaatgtattagatttacaacgaccctcagccagtcattgccggcagacgctccctcgcgcctataccaagtcatcacgagtttacaatagatgtgcctctctatttaagagagagcataggataaagtccaaacctaactctatcatatacatgtttcaacttcaagtcctaaactataaccgactatatacatacacatatttgacataaactttaacattgaaagtgttgcccgactatgagaatg

SEQ ID NO: 7249 - DNA, 880 bp, Oryza sativa
cactcgcgtgcttgctttactctgtttggggctgagtttaggtttgatatgaatgcctaagtttggattgaatatggtgaaaatagataaactataataataaaaggtttcttgaccgggttcctgggcaccccctctctttaatgtagctccgcccctgcccagattcaaaacaacttaagttttgcatcttataagaagggtatcaatggtgtatcatatatagtagaacattatttttgcatctatattgcatctactagttgaacacagataaaaagagggggaggggaggagcaagagtaggacaaccgaagacttctgtatgatattttcataatattcgtaggttcagtgttttcgctaggatgataaatacatatttagggcgctttgattcaaaggaaatttataggaattttagaggatttcatttctataggaatttttcctataaaaccctttgaatcaaagaaatgaaccctatggaattctatgaaattcctatggaatgcctcttcccgtacaagttttggaggaattttaacaagaggtagaacctcatggaagaaatcctttgagtctttatctttcctcaaattcctgtgtttttcctgtggtccaatcaaacggtcattcctatgtttttcctgtgttttagaatcctctgttttacacttgcattcctgtcagaatcctatgttttttctattcctccgttttttcattcctataattcaaaggggtccttaggattgggaggcacaggaagcaaatgagcgcattatgtcttgacgaatcaaccaagcgtgaacaagtagcagcatcctgttattgaattctggatgcagtaaaaactctcgggttttactctaacagt

SEQ ID NO: 7250 - DNA, 1362 bp, Oryza sativa
gacaaccgtcccccgcccgcgctagtgaaggcaccgccggttgtgctctccgcatcccctccccatgacggtgtctactccggaagaagtcgcgagatatcgccgaagaccaccacaccggcgctgacctcgctgccggtagcacccgctgcaaacaacacaaccccgcctcctgccaccccatcgacgtgcctctgtcgctgatgcccacgacgtcgatcactccctcagcaccgccacctgccaccccatccgcaccgtcccccgccacgccagcaaagccaccgccagctgtgccctccgcataccctcctgcgccggagagaatacagagtgggagagaaagagagcaagaggggaggaagggaatggataagaatgcagagggggatagaggatgattggtcaggagagcgcccgcttatttttttctccatcggtcgaccaactcaaaggatttttgtttttgatccaatcaatacactaggaaatgatatgaacatactaggttttacctaaaagttcattcttagaatagcatctgtgtaactgtattgatcagtcatggttgatatatgccattaccaaattaaacaacatatactccttaatttaggtcaaatctcagcacaaaacacaaagtaaattcaattcaacatcatagcaggatcagaggtattccccgtggtactatgtgtcgttgcagtttcagctgctcatgctacaatttgtgctaatttccatgacacactcctttctgtttctcttacactactgagagctgatctttgctgggtcgacctaaaaccttaatagccccggttctaaagagaattgggactaaaaatcatctttagccccggttgtaaaatcaaagtatgtttgattcttattctgtgatgaacaattggcatatgtgattattggttttgatatttggagattatcggcggagtggttttggagatgattggattttataggtgatgaaaaggtactgctggagttttggtccggtcagacctgtgcgcatcgagcggtcagtactctggccaggcccacagtgctggtctcggtctcggacctctggtgctccagctctcttgggcctttccgcggctctgctcttggctttggcatactcccgtggcatgcttttgctatgctaatacttgttgtttgctaaaaatgagtcaagttggagatatcttagtcttagaatatgatttctttgtttgattcatgtgtaggtgtcttgatgcctcgggagagtattgccggtgaatgatcgggagtcgacttggagataagacgacgtccagacgatcagatagcatgcgggatacattggctaaagatcaa

SEQ ID NO: 7251 - DNA, 1501 bp, Oryza sativa
ctgcggttttccttttttccttaaatggtatatatatatgcttcaaagtaactgttgcttagaacactgaatgactagtcaaattgatgagttttcgtcatggtaacatttgttgaagatgcatttaacctctcatttgtttgttatctgcatcttaaccatgtacctctggggagctaatcagtgttgtgtgtttcttctttggatattcatactctgtccagtggtttgtgacttgactgctaaattagcgctgtttctggtttccagctaccattttctgtcctgacaactatgccaattatgctgctaatcattttagtttggatattattcatactctgtccagtagttcgtgacttgactattaattcagtgattcagtgttattctggtttccagctaccattttccatactgacaaatacatttatggtgctaatcattttagtttcatttggtaattttattcatgcatgtttctcgtctatgccgccagatcttccttgtgaaaattccaaagttaccaagcaatttatcagttgttattaaaatttgtacgtacttattctactctgcttggtttataggaatagagttattgacacagctcatctgatgagggatctatattacaagaggaatccacaagcaagaagttcagggtctaatacttcaataaagagttacttcaaggagcttgcacttgatgaacatgcatcgtctttctctagaggtcctgctgaagtttatcagtggattggtcatcctaaccagtaagcctgtagccctgtactatgctgagcttctgtatttaggctgtttcttgtgcatagtgaattagttatatcaactaaaagagttctcgtgttctcaaacattttctttttagttttttcatattgttcgatttgatcaagtatcttcttttctggagctgcactgttgggattgtggctcaatatccacatttttttctttcagttttctatttcttgtttcagggccaccatatgccgcatgaagagtggttcaatcttaactggagttggagataaggtgagccttgcatcatgtgccgttcttattatccttcatcaatgtgaaatggctgttttttgaaataaaaaagtaagatgtaacaggcacaaataattaatgtttgtactagtacaataataatttttgtgctttagacctttttggtaggtccttttagcaaaaagaaatgtagtgatgtagtatacaaaaaaaaagttatatttatatttgttttttaaaaaataggggtatggtcaatggccttccactctcgctattcaggtgatgctatagtagtgcagaatgccagatgaaacatgacatgacatgattgtggaaaccatggctgcctgagtacattgcgaagtttttagataattgaaagcatgattgaagatttttagtgcttactgcttttttttttaattttgtttaataccgtcacagatcttataatcat

SEQ ID NO: 7252 - DNA, 1501 bp, Oryza sativa
ttttatccaccaattatatagttacgcttataatcagttctaggtgaaatgatggagatagactgtttcacgaatgccactgcaaatttacttgtagtaaatgacttcatttggcttcacgcttttcgtttcctgcgttgattgatttcttcagccaactgaacccagttcgacaccagatgaatatgaggctcagttcgtttgtgatgattcccaacctctccttctcgatttccgcgcgcacgtttttcaaactactattttgatgcgttttttgtaaaaagtttttatacgaaagttgtttaaaaaatcatattgtttcatttttgaaaaaaaaattagctaatacttaattaatcacgcgctaatggatcgttccgtttttcgtgccagagccaaacgttcccaacctgctctttcgaacagagccggcttgttgtcagcaacgtattaacaagtaacaactatagttgctacttcctccgtttcacagtgtaggactttctacaattgtccatatttatttagatgctaatgaatctagacatatatatgtgtttagattcattaacatctatatgtatatagataatgttagaaagtcatacattgtgaaacggagggagactgctactagctaggtactccctccgtcccaaaaaaaaaacaaacactaggtttccgtgtataacgtttgactgtccgtcttatataattttttttataattagtatttttattgttgttagataataaaacatgattaatactttatatgtgacttgtctttttaatttttttcataatttttaaataagacggacggttaaacgttggatacgaaaaaccatagtttattttttttttggacgaagggagtaagcaccaggatttgagggtcagatgtcagtatgtgttactgcgatctgctatgatttcacactgtggcagattgtatgctactcttttggtttggattagggtttttttttttgaaaacttgatttggattagctagtatgattctcgattagtctgaggccctatttaatttggattattgagagagaatcatcctcgtggattatctacctaagataaattaaactacatacaatttgaccaaattattgtaaaactatagatttaagacgttgtatcataaaatttaaatttcggccgagtttagttccaaactttttctctaaactttcaactttttcatcacatcaaaactttcctacacacacaaacttccaacttttccgtcacatcgttccaatttcaaccaaagttctaattttagcgtgaactaaatacacccttagtgactaatttattatgaacctataaatttaaggtcaagtatcacaaaactaaaaattctatagttaaatccctagtattacgttatgttggagctataaatgttatagttttatgattaaattatcactaaatttgtagttttctgatatttttttttgatactccatctttt

SEQ ID NO: 7253 - DNA, 1501 bp, Oryza sativa
agggcaaccaataacagaacttaaaaaaaaattcatcatgtgtatttatgaaataaatgaatttctcaagtgattcctactacagtgcattttgttttcaagattaaattagccaaaactaaattaaactaagacatgtgacattgttgaagtacagaacaaaaagcaaatttcactttggttgggagctaactacatgaacatcctgaaaattcacatcctggaaattcagttactgcaggaacaaaaaccaaggttactgcaggaaaaaaattcacattgttgaagtacacgaacaaaaaccaaattccactttggttgggagctaactacacgaacatcctagaaatttacattaggcaattcagttcctgtaggagtaaggatgttgattctctaaataatctaaatgatcaagcttactcacatccagtacttggcactcagcacctaagtcctctaaatgtaaaagagctccagatagtactgtgatacaatccttttaagtctgtattttagggaaaaaaacatttgtttgggacagggcagtcatgattgtttaatctatttttcagtatagttttataggaacgggagggtagttgactaatccatccatttcaataagtgcaccttcacattcagaaattacatgggtttgagaaagttctaaaaatgtggctttgataaattcagagatataaaaaacatcttatacagaactgtaaaaaataatttcatcatgtgtacttatgaaataatgaatttctcaagtgattcctactacagtgcattttgttgtcaagattaaattagccaaaaccaaattaaactaagacatgtcacattgtcacgtacagaacaaatttcactttggttggaagctaactacacgaacaatcagtacatagaaagcttgcccaaaattgaagactgatcagtggaagtaatagatgaagaagtcctcactaaacacaggatgacaggaatgtgtgaattttcttaccagcactgacaagcatgaatcacacctctagtgatcaacccctgcaagccatggagcagaactgaaactactcttccttaaggcaaaactacaaacacctgcagtgcagcgcgagagaactatccctgcaacacaagcactgtaaaggatgcattgacctaccagttcttttccagtagatgcccaatcgcaatgcagatgcattgcagcgccacaaaaatgttggtcgtgatgattgagtcatggtccagacaaccgcccatcatatttgagaacatggacatcccgatctatctctgcacaattgaatgagaaattcagctagctggctacatttggatgataaaatttcctggtggacacattgcttgatgtcctcaaaacaccagcagcagtttgtgttagccaaacctactcccaaactgaacaaaaccatgcacgacaacattactccaaaacggctaagctaattaccaaactgaagctgagatatca

SEQ ID NO: 7254 - DNA, 1237 bp, Oryza sativa
cgcacccacgcatggcacattgtcacaatgtcacgtttaggcacagtcggagaagagtggacacacacacacaatagctagtgatgagagatataggcggtgagggtctctttataaacagagagctgtgagtacagcaagtttaggacctgtttagatcccgccaaaagttttacaccatatcagtagcggagccataaattactaaagagtagggcttaagtagtgagttatttatctttttctaaatttacatggtgatttaacataatttagccatgattttgaaggcaggcctagggtctaagccctagctgccctaggtctacctccacccctgcaccatatcacatcgaacgtttgatcacatgcatgaaatattaaatatagtctaaaaaataactaattgtacatattgcgactaatttgcgagagaaatcttttaagccaaattgcttcataatttgacaatgtggtgctacagtaaatatttgctaatgactgattaattaggcttaataaattcgtcttgcagtttactgataaattctgtaattagttttttttattagtgctcgaacaactcacgtgacaccctatataatatccaatgtgatacgccaaaactttacacccttggatctaaaccaccccttaatagtatagccagctactagctccaattcatatataaccaatccaatagcttattcatacaatagttcctatcatcatatactacaccattaatatttattcacatatcttagaagtctatgctatagtttcctatagaagtctatgctatagttggctataaatctgtaacctctatctcctcttctctcttcttatccgtatgtgtttagagctgacttgtagggtagtattgtactcgctcgtataggccgcgggctgctggtttccaaggataataaacgcacgacgaccccggcctccttttctttcctgctatatatatacctcctcaccccacaggccacacccgtccaccccccgtaacattaactcctttgttcagcttgacactccattgcagagggagggtatagctggtgacagagagaaatgggcgaggaggccaattgcaacgtcgcgatggagtccgctgcgcccaaggagaacggccacaccaccggtggcgccgcggcggaggccaaggccgccgccgcctgggctgagatcgccgtcaccgacgccgcggcggtgccaaagc

SEQ ID NO: 7255 - DNA, 1501 bp, Oryza sativa
ggacttggggggcatgtgttaacgaccaaatttggtaatatcagtatcggagatgaagattagattgaagcggggtcgaagatgaagattgtcgcgaaaacagagtaagaatcggctgaagtccggattggctatgattggatcggctgagttggagtcagacttggttaggtgatgtacccgattccaacaatacgacttggtgtacgacatcgggttgggttgaggtgcttcaagatgattgccacgcatggatagagtcctgggaaggcaattgtatctattaattaggacattttatgtaatttccttaaagatatgtttgggcaaaagtctgccgtaaagacttgtggtatcttagagtttgttagagataatagtcgtgtccggtatggacatatcttataattctcgggtataaatagaccccgagccctatgtaattaaacacacacacgttcaatacaatttcagcgcatcgccacctttttgctttagttttatttcgacgagttcttgctttcgggttgagctgcatcagtttcgatcttcaacaagaggtaaaacttgttatgatggcttgtgttatcgggattagtgcttccatctttatgatactctaatcttgtttacgtaattcgtcgagttatcatatatcgtacataatctctggcaatatcactatctaacctacaatcggctaacatatgttagtagagggcagccgattaggttagattttgatgttgatttagattatataagatatccaccactctatgaaacttccagcggcttgattgtctagatattgttcttcctttcatacttaatgctgcatcagttgagtttgatctattaagtcgtgcttagaatatcaatctctagcctgccttctggttgccgattagggtagtatcggagtttcagccgatcttatctgatttaaccatattcgctctatatgcttcagtgacatgttaaatccgccatttatgtcaagatcttattgcatttaagtatattaagcttttgtttgatatattatacttgttttaatatcctgatatatagtagtatcggagtattagccgatacatgctcgatctatatgatcggctatgctataaacatatatagtcctgttattaatatatatttcgatccaagtgatttatactgtctcggcacggcgaccgatctatcccaatcacttgatttaaatatatatcgatataagaactatatattggtaatatctacagccgattgagtaggtttagttctttattatctatttatagtcgccgatcgattcacatatgacatcggctcaaagataaatgatatgtcatcggcacttagccgatcggctatcatttatatatttaactgcgatctctttgtttctattttttgttgattgcaggatcaaattaactggcacgttaacacacccgaaggcgagctttagacctgcactggagttaagcagatctcc

SEQ ID NO: 7256 - DNA, 1339 bp, Oryza sativa
attcctgcagccctgattctaattggagctagcgctgtatattggtcaatttgacgttgtcgcaatgataaagtttttaatggtaaacaattatctaaccctatgcaggttatcttcatgtcttcctactggctccacttctagtctacaatgctaccacaggaggagcaggatactatacgcaatggtgctacacttttggaatcggtagccaatggtctcttattccactatgggtggcgtagttctataagaattgctagctaaaatattttatgtgatttaacgctagtcaataataaaggggagttgaggatttgtcccatcaccttatttctcattttgatttacttttatcttacatttttattactattaaacttatggctgtgtgtcttatgacagaagccagagatataattcatttccattattaaaaaataaacttttatgagccagcgctaataatagaaaggagtcgtgccatataactcacctgattcacaagccaaaactagaaaaggaaatcaaaaagtgctcccaaccaattcagtcagatacatcgcgtacctttcacattataagatgttttgggtaaatagattcatatatatatatacacacacacttactttgtatatgtgtccaaattcgtatttatattagtgaatctagactaaagatgaaggaattttatagtatggaatggaggagccaaaacgtaatggaaaaaaaatacttttttccaatccaaggattcaaaagctctagaaaaaactcatggaaaagctaaattcatcgagattgctagtaataggccgtattgacgctactggcgcatacttttttttaagtccattagtaaatttgtcaattgggacctccagaaaatttggttggtagattccatatgctagaaaattaggaaaattctatactactggttattctacttctggagataccaatctcagagtacttctggaggcccagcacatcttacttctagaacggtcggcccagcccatcagagacaccaatcccggcacggactccgactccgactccaattcgcactccgaaactgacgccgcttcgtcgtctcccagccagcgcttgcgtaattagtacgtctcggctccgtttacgagccgagcccaactcggactcgggatttctacgcgtgaccgcgccccatataaacgcggccatcccccgcccggagtctttcaccattcttaccccgacgcggcgtctcctcccctctcctctccccttccctccatcgcatctcctcccgctccttcgatcccaaatcggccgccgccgccgctccgcc

SEQ ID NO: 7257 - DNA, 1501 bp, Oryza sativa
gggaccatgcatgtctcagttgtgcatttgcggattggcaaacgggatctttcggcgacgcaagggaccaacgcccctttgtggcgacgaaatgactccgaatgaggtcactgctcagtgctcaccgagcaatcgtgccgcggaaaaggaagtcccctcgcctcgatcgcggtcgcttttccttccgttttcagatagctttcgccgcagaaacgttctcgcgacgatttttccctctccttttttttcccaggtgaccacagcgtccacgaaggccaagcgaacgtgcggtccgcggcgccggcgcgtcggccactcgtcgctcctagccaccgtccgtactacgtgagaacgcaatgctgcgaatttaacttgctcgttgactgctcggcgatggaaagtacattcattcctttccagccacaactccacgatggtgttggacgacagtacggttaggtacatgcactggggcaaaaaagaaaatccactgtggataacgaacaacgcccaacttctcgctgcgatccaccttggaagaagccccgcacattgctcatccaacttcaacggtgcacgacagcttggacacgttcgcgcgtgttcaagtgtcatgccatgcacgtcacatactcatccacctgttgcttcacgattggctcgcacataaaaaaaatccagttatatagtacgtaaaccccttttaaaatctcaaatagctactgcaaactacaaagcttaatttgacacggacgattgtatttacggttaattatttttttatattagacattcaaattatagatttgaaacaactgatgatatttacggttaattattttttcagtgttaggcgatatatccgacgtatccgtcgatagcggggagtttatggtgacttcgttaatctcaagatataccagctcggtttttcgaaagtgcttatataaatacggtgtgcgtgtattatgggtgtctaattcgttgtactatgtctgtgtttaaaattaataatagaccagactaagattaagatttttctacacagtggatgatcgagcgtcccaatacaagcaccagccagatctaatccgacccagcacgcgcgcacccgagccatccatccatcgttgcggcgctgaccgggaacccaatcaagcggcgcagatgtcaggcgaggcccgcgcacacgcggcgcgcctctgccacacagcgcagcaggatacccacccacccacacccacaccacccagatcgcacggacggacgcaggcacgcgacgacacctcgtcctccaaaggtcagtgtcgcggagctgcgaggacgaagagacgacgacgacgccctcggtaaagccgaaaaacccaagtgctcgccaagttgactttggcacgcaccagcgtggggacggacgggtcgaagtcgacagcgagagcacgtaggagggggaggcgtggcctccgtataaaatccaccccaccaccgccgccgcgactccgcc

SEQ ID NO: 7258 - DNA, 1501 bp, Oryza sativa
aattattaccccatggcaaaaggttattaaaaaatttatgtgctactctttttcgaataaggaaatttctatgctaatcctaaaatagagccagaagaacctcatgttggctgtcgaaggactatatttacctacatgtataaccacagtggatcctggttattaccatgttaatagaacataaaagaattacctacatgtttaaccagaatggatcatatgcattacagcgataaatatgctacaattgtataagaaatgcaattatatttatcaaaataaattaagagttctgtaagaaatacagatccttgtaattgatgagaaattcgatcaattctattcaaaatgttttttttaagaagaaataagttcatcggacatccctcaacttaacagcgagattttttgagatcccttaaccacaaactagaaatgtgtaccctaaactcatacaaaccgtgcactcaaggtccattggcagtatatatgggtggtttcgctgacgtggcatcctagtcagaaaaaaaaatacatgggacccacatgtcagctgcacatttttttcttctccttctcttctctcttctctcttctcttctcaagcgccggagtgcgtccggagtgtggcgtcgcctcgagcgccacgacaggaggagggaaaggggaagcaaccggcgggagatgggggaggggagaggtgcaacgatgtcacgccccgaactagccccgaacggaactagcccgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaaggaaaagcggaagccaagacttggaccaatcatcacaggcgcgacttgggaactaggccgaaaccctaaaactcatcgtaaccgacttactcctggaagaactcctcgtcagcgggatccacatcatcttcttcagcaacttggggaggggttatttatatagagcaagggtgagtataggagtactcagcaagccatgggaattaagtgtttaatgcaggcttcaaggaaaggctgttgtttttgcaattgcttttatttaaactcctttttgaaacaactaagtgagtgcttctcaaacgacacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaatccattccacagcagcaatttcacaaagtagtagtcaaacaaaactacgctaggaatcacctcacatccgcccatgaccgtggacacggctgttcgaacagtttaataacttctgcagagggggtgcactttacccaca

SEQ ID NO: 7259 - DNA, 1501 bp, Oryza sativa
gtccgtgcgatctgggtggtgtgggtgtgggtgggtgggtatcctgctgcgctgtgtggcagaggcgcgccgcgtgtgcgcgggcctcgcctgacatctgcgccgcttgattgggttcccggtcagcgccgcaacgatggatggatggctcgggtgcgcgcgtgctgggtcggattagatctggctggtgcttgtattgggacgctcgatcatccactgtgtagaaaaatcttaatcttagtctggtctattattaattttaaacacagacatagtacaacgaattagacacccataatacacgcacaccgtatttatataagcactttcgaaaaaccgagctggtatatcttgagattaacgaagtcaccataaactccccgctatcgacggatacgtcggatatatcgcctaacactgaaaaaataattaaccgtaaatatcatcagttgtttcaaatctataatttgaatgtctaatataaaaaaataattaaccgtaaatacaatcgtccgtgtcaaattaagctttgtagtttgcagtagctatttgagattttaaaaggggtttacgtactatataactggattttttttatgtgcgagccaatcgtgaagcaacaggtggatgagtatgtgacgtgcatggcatgacacttgaacacgcgcgaacgtgtccaagctgtcgtgcaccgttgaagttggatgagcaatgtgcggggcttcttccaaggtggatcgcagcgagaagttgggcgttgttcgttatccacagtggattttcttttttgccccagtgcatgtacctaaccgtactgtcgtccaacaccatcgtggagttgtggctggaaaggaatgaatgtactttccatcgccgagcagtcaacgagcaagttaaattcgcagcattgcgttctcacgtagtacggacggtggctaggagcgacgagtggccgacgcgccggcgccgcggaccgcacgttcgcttggccttcgtggacgctgtggtcacctgggaaaaaaaaggagagggaaaaatcgtcgcgagaacgtttctgcggcgaaagctatctgaaaacggaaggaaaagcgaccgcgatcgaggcgaggggacttccttttccgcggcacgattgctcggtgagcactgagcagtgacctcattcggagtcatttcgtcgccacaaaggggcgttggtcccttgcgtcgccgaaagatcccgtttgccaatccgcaaatgcacaactgagacatgcatggtccctaatacttacaaaaacgtacttacatgtatgcacatacacactgatgtataatttgtcctgcattttctgaagggattcgtggtgatgtttaactgacgaatggtttttgcttttctgagaggaaatgttcggtgcacaaattgcagcccatcacggctagagaaagaacccaataactctggcccatcaaattaacgccttcaaagttgggccgtccaacgaagaggtccgcgaga

SEQ ID NO: 7260 - DNA, 769 bp, Oryza sativa
attagcttgttaatcgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccaggacttggaccaatcaacacagacgcgacttgggaactaggccgaaaccctaaaactcatcgtagctggcttgctcctagaagaactcctcatcaacaggatccgcttcatcttctacagcaactgagggggggatatttatatagagcaagggtgagtacgggagtactcagcacgccatgggaattaagtgtttaatgcaggcttcaaggaaaggctgttgtttttgcaattgattttatttgaactcttttctgaaagcaactaagtgagtgcttctcaaacgacacggttgagacagtgcgtctcgtccggtcggagtttgtgcaatgtatcagtctttagaattgatcaagatgggcacccggccaacaactttcaaacggccacccgggccaacaactttcaaacggccacccgggcctagctgatcccgtcagctgctgatttttcaaacatcgaacccctttctacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 7261 - DNA, 1501 bp, Oryza sativa
ccgcttgttgctagcgccgccgcttgccgtcgccttcggccgcgcgccactgccgctagggtcgccgccgcgccaacccgccaccgccgttagcttcgccgccgcgagagctacctcggccgccgctcggttgccgccaatcgtcgccgaaacgccgcttctctcgcacgccggtgagctctccatttccacccaactccggccggccgctctagtggccgtggtcatcctccccttcaactgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttaaaaaaaattagctcagtctagggctttagaaaaattttagttggagtttattcgacagtcagttgggaatttattgggagttatgcattaggtcgtgtctatattcgatgggggcaatgttatgcgcatcattttccatgcaactagtctatgtattaatttattgtttagttgcattagtgtctttatttgggttcatgaaaaatgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcatgtttaggtttgttgcttgtgggctagtcggcggtcgatatcatgtgtcagtggtatgactgcctcaattaggagttgcgtgcctctttttcagtgttttaatcaagattaagataattgcacttaaattcataagcaagattagtttgagccccctgtttttcttccttttctcatatttctacctatccccttcaga

SEQ ID NO: 7262 - DNA, 1501 bp, Oryza sativa
tgttgcaacacctgatggtactgttgctgcatctgttgcatcatcattgtcatcatctgagtctgattgtccaacacctgagcaattgttgggttctcgggcggtggggacggactgttgccagatgcactgttggcacgtgctccatcgatcggctcttcgctgccacaggcgttgttcgagtcgcgtgaaccattccttatctccatctgaaggggataggtagaaatatgagaaaaggaagaaaaacagggggctcaaactaatcttgcttatgaatttaagtgcaattatcttaatcttgattaaaacactgaaaaagaggcacgcaactcctaattgaggcagtcataccactgacacatgatatcgaccgccgactagcccacaagcaacaaacctaaacatgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaacccaaataaagacactaatgcaactaaacaataaattaatacatagactagttgcatggaaaatgatgcgcataacattgcccccatcgaatatagacacgacctaatgcataactcccaataaattcccaactgactgtcgaataaactccaactaaaatttttctaaagccctagactgagctaattttttttaaaaaaaatccgatccgaatgaacgaccaagatttttcccgcaaaccaaagaggcaaaactccaaattttcccaaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgataattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacagttgaaggggaggatgaccacggccactagagc

SEQ ID NO: 7263 - DNA, 1501 bp, Oryza sativa
acacccctactcccgtgtggccgcgcgtcctcgtcgtcttgcttgccctgctttctttggctcacgagccaaacgagcccgctcgagctagacaactagccgagcctagcttggttttctagctcgttaggataataagccgagcctagctagaccgagccgagctggctcgacatccaccccctacacgcgtgcctttgcccaaatcttatctcccgggaggctcacttccctccccgagtggctgcgacgacctccgcagctcgagacgaggtgccacttcttcttctctctctccatcccccattcctcccctctcttcccgtgtcccgtcgtccacagctccccgaccaaatccctagccctactattcccgcgcccgcccctccctcgcgtggtcacgcccgacagcgccgtgccgccaccgcttcttgccctattgccgcagttcttcaagaggcttttgtcctgatttgctgcagcccggtaggtattatatatttttgtggttggtaaattcggcagcaaaaaagaaaaaaaaataataccgaatgttataaacccgagcatctcatggtgtccatgtatctgcatatatgatatgttaggatcggtaaggatgcatagcacacgattacaaccaccaactccacctcgaagataatatagcgtagtgtttgccagcttcgcacgttatggccgaattcttatgtataacaaatttaccatggtatgtaagctcaaaaatgcaaaactaattatcctcgaacctaaaaaagtgtatacatgcaagagatgatcaatcccacatataaatacatgcaaataatacacgccctgctcgacagccactgctgcagctgtacctaagctactagctgtggccgcggtgtgcatccacaaccgtagcaatggctgctcagcaggcccatgatctctgaaaaagttcctgcaagcagtacatatgtatgtacagttgtacacaccctcgcccctattcatcctcttaaaggagtaaggagtaatgacagtcgatatgtgttggttgattaaaatttagaagagaacgtttttgaatagaattgtgaacttactcgaatatcgttcttttgtgtattgcttttgttatgcttcacctgactctatctctgtgaaatggcagctagtatattgaaggttgaagctttgtgggtatccagcaagtatttcaatggcgttgctacagtttggaggtaccttggcccccaaacttggggaaaaacctcagctgttgcccaggtcacctgcacttacaagagttatttatgctgatccaagatttctggtgtcgaaaagtgggtatgtgaatgtgttctgatcagtgagatgtactaggaatactaaaataaaggacacattgatattataaaaaggcaagatttctgagtaaactgaagatgatatatctctttttgtgcagtagtggaggcaggcttaaacaccttgtatcacctactgctag

SEQ ID NO: 7264 - DNA, 1501 bp, Oryza sativa
aaggacttgtttatttgaaagagggatgtcaaagtgaaaaaccataatcttactaacaaatagcacttcaaattaaggggccattatataataccccatcaatttcttaatattttataatcttgactggtgcttgctttactttgaccactgatatattttaaattgttcgattatgataaatggaattcatatgtttatatttaccatgtaacatactacgttagcacggtgtaatttttagtacttataaatttatctataaaatagaaaatagaagtagtcaaactaaaacaatgcaaggtcgagggaatatttaggttttgtgtatctgtttgagttatacagagcaacacatatttcatttaacaaaattgattgagttcatttattagcacttaaatatgaaaacatccaatacttttgtatagctttttcatagaccaatagtaatatagtggttttgtgagtctattatgaagctagacatatgaacaactcgatacaaaaatcttacctttttttgttgactggtgctgactgcattggtattctgaattgagatagtcttgtttcttgttgcgtagtactgggatggttcctatagggcattctgcagtagctaggtagttgtgcttctgatatggaagatataaatggattttcaacatccatctccattagtaaagagcttggtttcaactaattgacaaacgaaaacatgaccattttacaaacgatgagtttacatcgcactatgaaaaaaaaaatcctaagtatgatttggtttgtactttacattctttcatgatgaagcaaagatacgcaaatttttttggctttagtgccaggtcgaagtgtaacaaacaaataaatttactattttatccaaaacaagctgaattagtgaatattctagtctcccccccccaacaaaaaaaaaatactatagtcccccaaaactcttgtattttgatttatgactataataacatacttaattattatctctctatatatgtattcagaattttttagcaacatattagacatgatatcaaatgttagggtgaaatatgtgctttacctgaattgtatgatctttcaacaatggatggttaaagcctggttgtctattcatattgatgcaatcatagacatcaccatcttcagcctgatacgatgttctttttgcttgttaggtacaaaacaagatgctatgtatgtacaaaaagatctaattttgcacttacctcgatggttttattaaccccataatttgtgagaccttgactagtatttcccctttggcttatatactgaatttcttcccccctatgattagaacaacatatgcgatagaagaagagttactgtaatcactcgactttccctcattgtgattatcttggaagattccaagattggtattgatacatgaagaagagatactatttatagggtggaaacagatttggtgatattctttttaatgctttga

SEQ ID NO: 7265 - DNA, 1501 bp, Oryza sativa
ggggcaaaggaaaggaagggggggggattggatggttcgagcgactcggggagggaagtggagcggaacctcccgggagataagatttgcgcggaggcatgcgtggcctacgcattggcaccgctggctttcatctgggccgtcggctttccagccgacggagttggtgtcggggctcggggcatggtttttgcgttttgagggaaatgcgtttcatatgtttccgacgaggagtattctagaataatacctactacatctagaatcatgttcattatttattagtgttgtttttttatttctttcgatgaaagtaggtaaggtgtctattttgattggtaataaagaacagagtttacataaatattacatatgctctagcagataaatagttaaaacataacgattttttaccataacggtggagggagccaaactagaaattaagaaattgggagtaaacattaaccaaaagtgcatgtatgattgttatgtaagatttattgttatatatttcaataaacattattgtaacatgagtcatgtatcttctcgtttgcagaaataattgcatgggtgaagtaaagggggcgggtatacagagtgcttggatgatcataaagttgatcagggactaaccaatatccttccccaaatctacttccatgataccacgtcatttctcatctatagaataccagagataaagttctacacttttttatttggattcggccctcctaacagcatcaattttaaacggacatgccgctgaactagacggactcttagggtccataagtacttgttaaaatgtttatggagtctactttcaaatagttttggtcccatgttaaaattcttccttggatgtcaaaaatctgcaaaacaagccacgtgcatcatccaatttgagtttgatttgggccttagaccttgtaattatgtcatgggataagtccaaggactggacaccctaggacatccctaatcatacttattcaatagccatcaaagtttagagtggtttttctatcgtcatgcagtttcaacgctagtcagtttgtagaattctaacttcaagttcttaatcattcatctacaattgagttacaatcgactttgttcttgcttgtgtttttcgattcgcatatagagattatccttctcggcgaagtcaatcaggttttaaactattgataaccaaaggagatatagaattatgattggagggtttgaaatcatgttgattggaagctggatcttgtatgtcaagtttccgcaaaaatcgataattatcttcacttgatggaagatcgaacactcccttgtcatcaatcgatcaagatttttgtcatcatcgaaactttcgatgttacataaggcagacgctaggatgtaatttatttgttgcttatgttgcaatagatttccttatatatatgtagatcataaaagggaaaaaaacaatttttactctattaagccttgtttgaccgtg

SEQ ID NO: 7266 - DNA, 409 bp, Oryza sativa
  unsure (1)..(409): unsure at all n locations
ttgtcnannntttgaantcgctcggacccancgggaggatgcatatacacgattacaaataccaactccacctcgaagataatatagcatagtatagggnttgccttcttcgtatgttatggccgaattctgatgcataacaaattttccactatatgtaagctcaaaaatgcaaaaataattaccctcgaacctaaaaaaagtgtatacatgcaagggatcatcaatcctacatataaatacatgcaaataatacacgccctgcttggcagccattgttgcggctgtacctaagctactagctgtggccgcggtgtgcatccacagccacagcaatggctgctcagcaggcccatggtctgtaaaatatttcctggcggcgtgcgggcgacaaatccggcggcggaga

SEQ ID NO: 7267 - DNA, 1501 bp, Oryza sativa
agctatcgtgccgtcaaccacatatttgatcatgttggtcaacatgttgacaagtactcctgattggttgaccaaagcatgatgaacggcataatcaacctggtcttgcatacatctgagcgcctcgagatcttcctcctgattgttgcccttggctttgtcgtctttgccagaacttgtttccgcgtcatcgttgttcgacagaactaccttatatttctggaccatggtgtcggaacgagtctgtgcgaatgaatgcaggaatcgttttgcaagtcatctctcatcttttcaaattctgccttctgctccagggtcagcttgtccattgttattgggatgacattttctggatcaacttctctctacttgaggcttgccatgaagaaaattttacgaaagtcggtcccaccgggcatgccaaaaagtgtgttgatgcggaaaacacacgtactggcctgagagatctgcttaactctagcgcaggtccaaaattgctttcgggttccgagcgcgctagttggtttgatcctgcaaccagcaagaaagaaaaaggaacaaagttaaatccatcaacgatagccgatcggctggattgccgataacgtattgttcggagccaagccgatgttacttgcatcagatcagcaagggaatataaggcatagaaattattagatctacccaatcggctgtagacgtcagcagtacgcaatctatccaatgaaagcacatttggatcaagtgattgggatagatcgggcgatatgccgagacagtataaatcacttaatatctaaatgtgcttcaaagtagggattatgtatgctcacagcatagccgattgagcaaacctaacgtgtatcgactattactccgataccactttatactacaatattagcacagatgaaatatacgaaacgtagaccaatctaacaagcaaggtgtcatgtcccaaaacgactctaaaatatatcctttaaattatgcctagaataattaaaatccgtgtgaaagcctccaacaattaaaatgtgcaaagttaaaagtcaaataaggcttaggggatttttgtatttttcctaaaagcctaaaaggtgtaaataaattttagtggaattttcagagcacaaataataattactaagaaataaacaaagttgaaaaagttttataaaaagaaaaaccttaaaagtcccccttccctcccttgggccgggccggcccatctctcctccccccctctctctctctcctctccccgcggcccactcagcctctccccgcgcgcgcgccgctgacgggcgggcccgcccgccaccctcgctgacgggtggggcccacccgtcatccccatcctcccgccgctccgcctgcgccaagcgccgccgccgccgccaaatccgccgcatcccgccgtccccgcgtgcaataaagtgggggaaatcactccccgtgatcccctctccctttccccccatttttccctctctctctt

SEQ ID NO: 7268 - DNA, 480 bp, Oryza sativa
  unsure (1)..(480): unsure at all n locations
accccaacaaccataaaggcagaaagggccctccttcccacacggataagaggacggtggtatattctttttttaagccggaaacctagtgaccccatcggttccaaaaatccctttctagggaataccctgacaagttaagggtttagatatattggaaaaatatttgccaggtcactaaaaaaattggtttctccttccggatgaagaaggtatatgtatggacccaaagtccctttgtaataaatcaaaggggatttgtggggcaccatataaaacaatgtgnccaagtacatgactcacttgattcttaatggaccatgaaagcaaanctacacttccaaagcancggataaggattgaaagaaaatcagtgccattgcatctataaatagacaagcgcaatgaaaaccctccccatcgttcacacagttcaagcattatacagcaaaaaaagaaagatctagtgtcccgtagcaa

SEQ ID NO: 7269 - DNA, 1501 bp, Oryza sativa
ccacccgtagtaggggccgtggccggatcgcaatgtcggcgtcggggggattgagcttggtgcgccgcgccgtcgaggccgcgcgccgcacgccgcggtggcagaagaggctcctcgtcctcaccgccgggtacgtttccgcctctccccctcatgctccgcgcgcccctgatatacacctcacccccgttgatcgatctagttatacgcgtgcgcaaccgtgtccttgcgctggatatggtgcgttgggccgccgtacgtgcgcgcgtccgcgctttggtttgattgccgaactttgatacaccgtgtaaatgttttcgtcgcgattttgcgctagttctatcaaggcggctgtataaacatgagagtagttaaagcctttcctccaaaacatgagattagtttaatcggggatgttcttttcaatggattttttttttcggtttaagaattaagtcggtggtgatctgtcaacctgcaacttttcttttgcccctgaagtccgtagcccgacgcttactttacacctagcccaacacttaaacaccgcactacgttgtttattaagatttgggtgaaaaagttgttcagaagttcgatcatttattggtaaaattactcatagatctaacaaatctggttcacgtttatattcataattggttatggtgaaatctaaaaaatattatctatgtcatcttgacacttgaaaaagaatgtgattgtgatgtgaaagtgaaacaacaaattatttgaagtgtgctggaaccatggtgcctacttggccaatcgtctaaatcggattgtattattcttgttcattgacattgtaatattgaaatcaccgcctcacgattctagggagacgagtatgtattgtgtcaccaaaagtccaaaacatgtcctacttgtttatttaacgtcataaataataaataataatatattcgtccaataaaaagtccaatcctgaagatgtatttagacacgcacgttgtcctggtacatcttcagatatattggggttttgtgggacagaggagtgggcatttaagcagattgtattctcacccttttgcttaagagaatgtgctatagctattaatccatgatgctagacatgtttgtcccagatagattcatggtgatggtttgtccttcatatttcttattgtaacccgggatcatattggaattgtgcacagcagatactgttcatgatattgtttgatcacaaaagtgaaataacatttgtattgccagatttctgtttttgggccatgtagcaaaatcttgtaagcgtctcaagcaattttagtgaatacttctcttgtggttctttctgttttgaaagtgaagaagactagcagcagaggtgtgctattcattatagctggaagaaatttttatttacatgttctgttatggctctgataagttcattagttggtattcattggcaaatcaaaaactagtaaatgcaacttaaaactcactgaga

SEQ ID NO: 7270 - DNA, 1087 bp, Oryza sativa
acattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgttacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaac

SEQ ID NO: 7271 - DNA, 1501 bp, Oryza sativa
gcctggataaaccttggcccggcacgcctgggcttcgggcatttgtcagcgaagtggccaagctcgtcacagttgaagcaggaccctggttttgctcccgtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctgacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcactgttggggtgcacaccatcagcgcgttcttcgccgttgctgccctcgcctgttgcgcggctaccagtcctggtgtagaccatctggagggaaaagcagacggggaaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagc

SEQ ID NO: 7272 - DNA, 625 bp, Oryza sativa
agagagttcgaatattgatatccacttggtaccctccaagttaatacaattgggaatcaagacagtgaaggtactgaatcatgtagaagaggatacggcgtttaagacttcacatcactgttagcagtatgaagtataaactccaacatttctactggcctttgtttaaccagtgagcatctggttcatgtagggttccctgcctatgcaatctagcctgtattatagatatttttatttcctcttgatttatgtgggaaattctagtctcgtagaattaatatggtggtttctttcaacattttgggctagtttggtttggttccaaattgtgccctaccaattcattggcaattttcaatagagtttctagttgtttggattggtgccaaattttaacaacacatctcttagatagtaaaagttttggccatccgaatttggtagtgccaaaagttgcccaaactttggcactaccaagattttggtatggcaccaaaccaaacttgccctttattttatatttgatagtagtactgcctttatatgatttatacaaacttttgtcttgatatatttactgaagttattgtatttatatgacactcttttactttctttcagg

SEQ ID NO: 7273 - DNA, 1022 bp, Oryza sativa
cgcgttcttgccttaccaggaacccgggttggctccaaccgaccccgccccggcgttccccaactattggcatgcgaggtttccctgaaccgactagttacttagctagggtgtcccattccaccttgtggttgcactttgttatgcttgatgaatttcccacaggaatcggtccttatatgcgaatacgggacagtgccacgcaggcacaacccctgcatcgcgagttttcacaatacattttatttttaaacacaccgacaccacaggtcgggttttcaaggcttctcaaacccatttcccaatttttcgacaatcaacagtgtatgtgggatatttggtatacgcgctcaaagagcacagataccgaagtaccaaaagggtggagcgacaaggaatcagggtagtacaacctataggaattagtgcgactactgggtaggtccgtcggtttggcacgcaaaccgaggccaagcaagttaagtgtgtgactctaataatgcaagttgcaaacaaaataataatgattttccaattataggagcaattggtcaaagggtgacttgccttgctcaaggtcttcacggagcttcacgaatcttcgagaaaacccgcgatcggcgaaaatccggtaaccgcaactatacgcaaacaaacaaaaacctaaacaaaagaccaagaaaaagaccctatttagactaaataatagtgccattaaatagatctcaattttacggaattactggaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaagaaaaatgattcatggaattttggaataaagaattttatttatggaacaaaggaaaaagatttattaaatcccttggaaaattaaaggggtgagggatgtgatttggacttatctcgggtggca

SEQ ID NO: 7274 - DNA, 1501 bp, Oryza sativa
ccctcgaatcctcctctcgtttcactaaacataaacgccgcactattgttgttgctcgctccgctctcgccgtcgccgttcgtcgccaagcaccggggaggccggtgcgtgcgaggacgcgtgacgcgggactccgagcaccccccttcttccccttccccggcctgagaacggagaactcactcccgcgccgtcggccactcgtcaccgtgccgtcccgactcggtagtgactccctccgttctccttcatcgttctccctcgccctctctagcttgcgtggtagctctactagcccctcgaacgcgcgtagacgccgccccgagctccgccgccgctcggcatggcctcgctgccattgccgcccgcttccggaggccgccgccgtcgctagccctcctcggtgctcctccgccccatccgatgccggaaacggatttcttaaccccggacatgctcccaccgccttgaattgaatccccgtcacccctccgccgtttcccccttttctcgccgccggcgtgcgccgccgcgattcgtcgtcgtcggcccctctccgaaggatccgagccgttggctcaacccctctcatgcttccctttgtaccgatgaactccctctcgatcgaatcgccgcgtcgtgctccggtgaaaccccgcgcgtcggccaccgttggttggagctcctgttcttcttcctcctctcgcccggcccgcgtggctgccacgtaggcgccacatcggcgccacctcgacgcgaccgggtcaaagctgacctcggtcagccgcctttctccgtcccccaccctcgcgcgcggtggaatcggtccaccgggccctctctttcccccgcgccccctctgttgggccgcctccccgtggccgcgcccggcccaatggctcggccgagcctccttcaaccctttgggccgcaccaatgccacccgagataagtccaaatcacatccctcacccctttaattttccaagggatttaataaatctttttcctttgttccataaataaaattctttattccaaaattccatgaatcatttttctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccagtaattccgtaaaattgagatctatttaatggcactattatttagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccctttgaccaattgctcctataattggaaaatcattattattttgtttgcaacttgcattattagagtcacacacttaacttgcttggcctcggtttgcg

SEQ ID NO: 7275 - DNA, 1501 bp, Oryza sativa
agtatgacacatgtatagtagtacaaagtgcatgcatctttcgtgtaatagaaataaaatagagtttacgatccaagttagtaaaccacgaggttttgtcacatggcataactccgctattatggttttgcataccacatcgctaatcaaattttagcacaataaaacatgcttacgttatggctaaatttattatccaatagattgaagaaataagtctacacaactcgcaaaagatatcaaatgctgaagtgacgccacttacgcccgattactacgtgcagctctccgagctcgttaacggataatccattaagtttctagagaaaaaaatataacttttatagcaaatactatttatagccatgttcagtctcaatttaaactagttaacccccaagatgattttgctacggtggcacactgagctggattgttaaagcgggctgacagatgggaccggcccataaacaaaaatacatctgatagatacagtaagtatatattttcttaaaaaaaacaacctataaaaggatatgacatcttctgatacaatgaatctggacatatggtctattcagattcaatatattcaaattcattgcatcaagagagataattgattttttttcaacggagggagtatatatagatgtaaaaccggtaaatacaccgcccgtccgccccaccactgtactgtacgtatacgctttcgtccagagttcccgttcccacaaaaccgtagccctggatcccttttacattctcacccctccactctctacactctcacatgtcactccccccaccccgccgagccaaaaaagttgagtcagcgacagcgttttgcgcctcgccccctcgggatcctcctattaataaccccgcccctccctcccaaatccaaagggcaagccccgcgaggcaagcggattcacgcacgcgcgccgccatccgccatgggtctccacgacgcgccgagccgcggcggcgccgggggcgggaagctgtcgctgctcgccagcgtcggcctcgccggcgccgggggcggggggagcggcggcgttggaggaagaagccgaagaagaagatgaggaagggggttacaaggagctgctcgtgatggcgcttcccaaggacgacgacctcgacgccggcaaggtcgccgacgtcctcggcttccggctgcccgacgtggaaggggccgtgagggtaaggagccctcgcccatccctgcctgcgtttcttggttgctcgtgcggcgaaaggtgggaaatcttggcagttttgctcggtttgattatttttttatctccaatccgattgagagggcgaatggcgctgttcccccccatgcgacgcgtttgcttcgtttttaggatttttgttacgacgattcgaaacattgctcgggattcacaggtttcgtggcatgaacgagctgttttgctgcagaacatgtgaaagatttcgaccaggatccatggttgattatctgttc

SEQ ID NO: 7276 - DNA, 1501 bp, Oryza sativa
atctatgctggagaaggtgctcatcaggggagatttcaacaagtacgcgggcgaccgccaccaccacggcacagcgcgcgtcattgaaaagcacgagggtgagtgacgatgagccattcttggcagaggagatgcgggtgctcgaggagaccaagggcatcaacctccccaatgtcatgctgaggtcggtgctccacaatctactaaaccagaagatcgagagcattgcacacgtcccgcacgatcttgtcaggcaggtgtgggactatgtagaggacctggtggtgaaggtgctgcaacaccactcgtggagctacccgcaggtgcagctgtcgtgtcgccgcgccgtgcagagcctcaatgtcatggacaaggcgttcacgggaacgatcggcgcagcacgtgtacgagccattggattagcttgttccttgagagggattggtttggtgttctaaatgagaatacaaccaagacctggggctcatatctaaccaatttggctaccaatctaggttgcttatcaaaaatgcaatcctcattcctatgagtagctttagcacaattgatgcagtaaactgagacaatgcaatccctagccacatgaccaaagctttttcatctattgcaaaaaaagtcttttgagtattcaggggcataccatcgtggggattggcctagatttggggttgttccacctagggatttgcttgcttgctttctgcagcatgggtgggcagcatctctatcgacgccctctgcaccagcctgtgctgcatccccctgtcttggatgccatgggcggagcttgacctccaccttcccctcctcctaaggctgtcgacgccctctgcactggcctgtactgcatcccccctgtcttggacgccatgggcagagcttgacctccaccttctcctcctcccgaggccttgtgctagttaccccagtccacttggtcatggccgccttgtggagatggctccgaaggatgcttgccgtcgctgcagaacgcctgcttgggctagaacctccctcgctatcctccaccctgatactccatgccttgccaccaacctcataccacattcgcgaagcggcgagaatcaccgtgaattgtgctcctccacttggatcccctgccaccaccgccaatcccaagcctaggccactcttctacctccctctcctcgtgtaatggttcacctctcctccaacctccacgaagccctagctccctcacatctatcccccacagatgttgtagacaggagtcaaggtgcgcgagttgacgcggtcggatagagaggccattgctacaggaatgggctgtgaatcgagagcccgtatcgccattgccgaccttgggcccaagccgagtcgatacgcgcgtggacaattgtcgaggatcgccgtctcccacgcattgcgcatctggtggggaatccccctcccgcacttgtgtttgctccggcgagatctccagcgagcgcaccaccga

SEQ ID NO: 7277 - DNA, 1501 bp, Oryza sativa
tttcgcgtgcgggcctcctaatctacccgcacagaaaaatagccttccctcccatcctattaaaaaaaattttgactttcttctctccccctgggcccccttctctcctctctctctcccccttatcttctcactttcctctcctcctctcattttcctctctctctctctctctctctctcaccttcttcttctcaccacatggccgacgcctccttcttctcctcccggcggctctcaacggcgggcccgacggcggctggcgggagcggcgggctcgcggcggcggtgggtgggagcggcatgcgcgtggcagcgggctcacgatgggcagacgtggggaggcggcggtaggcggacaggggccactgccgacgacgacgcggcggccgggagcgtcgtgcacacggcggcggcgggcggacgtgggccactgccgacgacgaagatgaagcagcgagctcggcggcggcggacaaacgtggggaggtggcggtgggcggaccggggccgctgccgacaacgacgacgaggtggcgggcgggagcagcgccgccgccgccgttcgacctagggttagggttaggattttgtaattttattttttttttggattttgattttcgtgattttcccagacgaatcattccagacgggcgaaacaaccgcacgcaaaaatttgctattgtagtagtggtggtggctatcgagaatggggggcgcgtaggcggcacttgggtagggtagcagagccgactgcggtgctcactattgacatggagaagagggacggtcgatcttaatctgaagggagggcgcttagcaagagtgtttcagtaaacaaattgaggagctgggtattcttgctttgctaggctccgaacttataacggttagagatactaacctctgttagagattagaatcaggcattgttacaggacactgcttgtgtgtgttttatctctaggataagtccaaactcacttttggggggaaaacactccataaacgtggtaatttgccagtggacaccgcgctgattaaaataataatttccggttgaagaggagagagaaatcgcgtaaaatatcaaaaatacccttgggcccacatgtcagctctcctatctcacttctctctctatcccctccttccagctcgtccgcaatggcctcgaagcacctcccgcttccacgacgccatgcggaccatccacgccgtcgtggcgatggctggcgatgaaggggcggcgcggcgaggcgaggttggtgctcgaccggacgtcggacaccgccggccgagggcgagcagtggctgcaggacattgaggacgtcgtcaccgccagctccgtcggtggcaacagcggcggcgcgcgccggcatatggaaacaaacgatccaacacatcaccggccgtcacgtctctctttaaagcatgcacacacacatatggatggatcagcagctagctgcacaagcaatagcaatacatcgccag

SEQ ID NO: 7278 - DNA, 1501 bp, Oryza sativa
gtttacggctttacgctgcaaaggctcaacttccaaggctcgtgcgacccaaccagtcaactttctccgtgcttaatatatatggttggaaagataattaagtctagtttcacctctaacaaacggctcataatttcaacttcccaataaggagttatggacaaatcattgagaactgctcagaagccaaacagacgcgtgagtcctctcgggaattcacttattgtataagtgacctttgagctagcctatgtcctggactcctgtaaactcccaagacctttcattcctatctaggaggattgttcctagtataaatatcccctatgttttatcatttagaggactttttgacaatgagaatatgaacccctttgtttagctgtgtgctagcaaattcagagagagatctctatccctttgcttttgtgatttccttgtgagattacagaagcggcgatcgacgccctccaattggtgcttctggtccttttgagaattttttcctcgattgattccaagttgtgttggttagtaacttagagtgtggttgggcgaaccctctattcaggttgccgtaatagagacggtggttggcttcaagcacgatcgttaggttgcactgttatcttggctgcttgcagccagttattttggtctctttgaggctagttatcggttcttgatcctacgccgtgaagatcgggacatcacccctaccgggatcgtatagcaatgtcttgtaggttgcttgaactatagagtgtggattttgtttttcaaaacaaaacaactgctatgcaatttatttttcaaaacaaagcaactgctaactcgcaaaggtgtcaccaagttgccccacgttagatcaatttcgctcgcatggattgttttggtccatgttcatataaagttataaactagtcaagttactgtaccaaaacaagcaatttacatactttaacatatttcctgatgaaaccagataagaatactttatgacataacaatttgataaaacttaaaaatcaactctcaaccataagagaagatcgaattttcatgaggaaaagtaagagatagatgaatcgtaagatttggaatcaaaaggcgaatccgtgcaacgcgtgacagcagcagaagagtagccctactattcgcttcctccctacgagcacgacccacccacgtcatcatccatcccccttcttcttcttcttcttctaggcttcttctacttctaaccccatctccatctccatctccctcgcctccctcctcgccgcgcgcctccgcctccgcccccatctcgccggagcgccgccgcggtccgatcccggtaagccccccccacctcgcccccctctcctactaccctgcgtgtgttcagatccgcccgaggaagcgggatcagatcgcggatcaagggagtacagaaaaaaaaagcctgatcccttcctcaattcgccgcgctgcaggtgcccgacgatgcagccgccga

SEQ ID NO: 7279 - DNA, 1501 bp, Oryza sativa
aaactaataggacccaagagatgttgtactaatggcgcgattggtttataaataaatctgtagttagatttctggttgtaccatcactccatcagaaataggatcatgtgtacttgactaagatagcacagcgaacaaaatcgttgttcagtaattatgtgctaagacaagtatgagttaattcaaccattaaatctgtggatagcatgccctagatccaaacatagcaattttgtttaacaacatacaaacaactcttccctttctcaggattgtcaagagccgccttcagaatccaaccatgctatttcccatgggtcaaatacagattctaaggaagaaatgtcatcgggaagtgggtatcgtaggcagcagtcttgcttttcttcatcaacctgttcttggagaagttcttctgaagtagaatcagtgtcaagtactccagacgggtcaggagatgtagttgggaacatgagcgtcagaagcaaaacctttgagcgaaggccagatcacattgcttcatatccttctgctagtcctgacataagaaggttgtatgcagcagaaggtaaagctgattttaccttagattatcattcagaagaacgctggtccagaagatccaatcaatctactgcctttcgaaccagcaatggtcaatctattgaacaccacagtgaggtatggttgtggatccctttgactacacaataaattttgtctatatatacagtttctgtatttggcatgtctattaaacgattaaagactgtatatgggtgtttactaattttagttttatcatcaaaacagatagttgacatacctagacaggccaattccatggatgagactacttcctcttcaagtcaatggagttttgacaattggggaccttcactgccaagagggatgcagtatggtgatgagatcccttctctgtctagtcagaactatggtgctagaatcccctcgctttcaagtagacaaagttatggtgatgagattccgtcactatctcgcaattgtaactacgcgagtagacaaagttatggtgatgagattccatcgctttcttctcgccattgtaactcgttctcaagtagacaaagttatggtgatgagattccatcactttctcgccattgtaacgcacgctcaagtagacaaaattacggtgatgagattccatcgctgtctaactctgactatcagtgctaccaagataggatacctttgcatcatcgtcaatggtgccatgatgctgaggcacatccacagctaaactacgggcgaggtgcttctcatggcaatcgttactcaagagacagttttgtcagtagtattgctactaatcagaggttcaagatgggcacaggcaaacatactgtcacaagatctgatcatcataggactattaagaacgataatgtatgcaaacattctgatgatacattggagcaagttcgtggtccccgtgcaaacaaattggaaaatgcaa

SEQ ID NO: 7280 - DNA, 1501 bp, Oryza sativa
gtgaaatatatagatagttgagccaaactccatgacacgtggcttaggtttttctatgcattttaaaaactaaatgcatatttaatcctatgaacttcactttgcacttagctgtgcatagttcaccttaaattaatttgtgcaataatattttgcacttatgaataatcaaattagggaaaatgttacaaaattaatgatggtcaatatttctaatttacaatttaggcgctgttgttataaattaaggaatacaatagaagatattttttttcagaaaacttatttttgaagggtggagcaaataattcatttcaattatctaatgaacaagctaaagggaacagtgtatttcttatttattttgatgctatggaatttcatggtctccaaggtgaactttaattttttcatacattttataacattatattaatatatactaaaatattgcataatggtgcttaattaaaaattagtaacctagctacttctaatatagtttcatgtagccaatttagataattttaggctgagtttgattctgttgctaggaggagctacttactcatttatcgtgacacatttttttgcgaaaactttctatactcaattaatcgtacgctaatcactcatcttgttttgcgtgccgcaatcaacgtagcctatcctctgattcaaatggaaccttaatcatattaattgaaggctttaaattatgaaagtttggagtagggatattaggagatcagataaaaatgacaaatatggaggttcatggttcatctgatcgatatatagaaattaacaatatatagattggttgctaaggtactgtccaatcaaatatagtttctcgtgtgcatttccagtccaacaacaaaatgagacacattgttgatgctgatctactgtgaatttaatttcttcaataatttacaaaggattccggctggtttgtaccccaagtataacccaccttggaaccatacatggacctagttacctatcttggaatcaacacaaaatgatttttgtaatgatgttcccaagtatagaaactttcatgcatggagtgtaagaaatttctatccgtataggtcggcgattctggacaatcatgcgagtggccgcttcccaagataattaattaagagcgatagccttttagcgcgtgccctatactcgttaacgccactaaaaccctagctaagctaggggtttgatattagtttataattaaccctccagcacaaagctttaagggctagctcaaaaggctaggtgatcaagagagaacacaacttccgagggcggtaaccgaccacggtgatgagctagctacgttgtacattgtgcaccatggcagtacacaagctttcttcttgtttaagcagtggatttcctagggcatggcagaggcagatggaggaacaccagctatagcctattgtgagagctcacttttccatggctgggattaatttcttggagatcacaa

SEQ ID NO: 7281 - DNA, 1501 bp, Oryza sativa
cagagtccaggggcgcacctacagcaccaagtgtaaccagagcttacacaaaaaaaaggcaccacctttgctcggtgctcgtgggggagagagagagagagagacagatggcgacgcggatggctgcggcggtggcggccatggtggcggctgtggcgatctcgctggcggcgggcggggcggcgcagtcgtcgccgagcacgccgagctgcgcgtcgaagctggtgccgtgcgcgcagtacatgaacgggacggacacgccgccggcggcgtgctgcgacccgctcaaggaggcggtgaagaacgagctcaagtgcctctgcgacctctacgcctcgccggagatcttcaaggccttcaacatcaacatctccgacgccctccgcctctccacgcggtgcggcatcagccagaccaccagcatgtgccccggtaaccaacttattttaccctcctcctcctccttctatcccttgttcttttaacagcaaaagagagagagagagagagagaatatgttgtttttgatagaaattatcaccgtggcatcgatcatgagttgttaatttttgtaatattggtatccaaaaactcacccaaatagcatgatttgactgttcctacactgaataaatatgaggccttgttcttgctaatgcattgtttgcctggttgatggaatgatggtttgcacatcgaagtcactgcactgtggttgaagaaataaatccggttaggatgttttaaacaaacggccgcataaactgttcttactgccatgtataatgtcatatttctagtgacaagtcgatgtaattaacacaaatttgtccggcgaaaaaaaaaggtaattactacaaatttgggaaagtaaaggaatgtttttgcctttttgttgcataagtcaataagtggcgtagggaagttggctttgcatttctgtctctatcagggcaaaacgaaacaaagaaaaaacatttaggtgtgaatataagaccaagctccatgatttgggtcgaccagaagtttgtaggcatccagattcctgttttttgcttccccagtcctgtcctgtaataatcgtagtttaatctgaagacgcaacgatgtcagattataccagttcgccttgggtataatactagttgaatgattagtctcagcctaccgttggatatagtattgtagccatttcacatttgggatgatgtttataaatcaactaggaaaatagctaatttctttgacctgatgaaatggaaccatgaaacttaatctagatttgtttagcactgttttgttgtgctggtaacttttaccaaacatcattacaaaattcatttttttttggaagtcacaccagttcgctactatatctgttgtatttggcaaccgtccttttccttagataattttaatacatatatttgtatggttttctgataagtgtcctacaataatattttgcagggaattcccctacgaactctcctccaggtaa

SEQ ID NO: 7282 - DNA, 515 bp, Oryza sativa
ccagcgtcgcatccggcgacgggttggggtggtcgggggattggggggtaggaggaggaggggcctatgctgttccccgggcttagagtgatggccggggaggtcgcggcttggcggtggaaggggtcgtcgacggcgacggcgagggaaaccgtgtaggcggcgggctgcgccggtggagacggggaaggcgcagttgcgcagctaatcgatcggcgaggggagggagagagagagagagagagagagagagagagagttcactgttctagaggtagaagatgcacagaacccgttggatcttagaaccaacggcccaaattttggctgagatcttgcgaagaaaacaaacaagtagcagcttaatttgttttgtaagatattagtattatgtaagatatagtgactaaagtacttccacttttgaaactttgtcctagatatgctatagtaggctgcctgatttctctgttcagacagatgtttatgtttctaatctgatttctctgtacagg

SEQ ID NO: 7283 - DNA, 1501 bp, Oryza sativa
gggacgaggcggcggagatcgaggcgagcgccggtttcctcctggtcgttgagatcacgagctcgccgccgccggagacacgagagaagagggaagggtggagcagcgagtgagctttatatatgggcgcggcggcgcgggggctagggtttgctgcggaagcagcggtgtccaactctcccgctgcaagtgggaccaggagtgttatgggctgggccaagatgttgtggacggcaattgacggcccaggttagcccatgctgtaggggcggatgggccaaacaagcagagaataattgggccggtcaatgtgtgcgctattttttgaacaaaaatttcatagagccacatctttacaccgataccaaaatttgaatctgaaacataattttgacgttgattttaaggtttttcatagtttttttaaccttgatgtttaagtcattaaaaataaatatgtaaatgtttaaccataatttttttatcagtaatgtaccgttgatgtatttactagcaattggccaaccatgcaacgatagcctcacgaatgattttagctgaatatgttatttacattctcagcaatcactataagatatacatatgtttaaccgtttgttttatttttttttctaaaaaagaacacgtagctatcattttgtctcattgcgagttgatttattattaaatatacttaaaacatgacctacattttttttcatatttacccaactatcgacgtacgtccaaaaggcaataatatcatctataaaaatcacttgtctcgctgttaaatagtcaccgtatatgtctgtgtcgtgtcgttgtcactgtgtggtgaatatatggtgatggatggaaaccaaaatgctctttcctcgtgtacgacggtgtacacgagtacgtcgccttcgtgcatgtgtgcccggcagttcacggcatcgcgtcgcaatcgcagccgtttgctccacaccacacaacacacattgtacggcgttgctccgtgcgtagcttaggtaacctaccctgggcggccggagcccgcctccaccgggcgccggacacgtcgccccggccggcgccgtcgccgtcgcggcgctcattaaaccgaaaaggcgccgccgcgcgccgcccactagctcgctggggagacgccgacgtgcgcgcgcgtgtcgcgcgctcacgcggcgcgggcgcgcgggcggcattaactccgccgttgaacgctagcgcgtcgcgtcgcggcatggcgcgccaacggacgccagccatgtgtgtgtcttgtccgcgtacgtgcgcgccgctggtgtcgcacagttgtgtgatccctatctcaccgtagcgtatgaactgtatgtacagtagctacctgctactagctctgtataaatacatgtactgcctcaagctgggcactgtaaaaccgtgcacacttaagcccacaaaaatcacaagctctcgcagtgtcactagccactagtgtgaggttacaaaccaaagt

SEQ ID NO: 7284 - DNA, 206 bp, Oryza sativa
  unsure (1)..(206): unsure at all n locations
ccggctttgaattttcanggtggattcggcttcgtctgcaagtagtccatcagctttttatactgcatttttctctcaaaaaatagatttcgaactaagtttgaagtaatctcactctctgaagaaatgtctgttaagtaagctcaggactataaatactagtgtatataagcggttcacttcacaagttttgagttgagttaagt

SEQ ID NO: 7285 - DNA, 1501 bp, Oryza sativa
tttcatggtcatctggctagtcgagctgagcgtgtaaactgggtaaagcaagatatcctgaattgaattcctgatgcctttgtacagcctccccaagacccgaaaaagctagggtttgctgcttgcctggtgctgcggagcgggcatgagcgccagctttctccctcgctgttaagggtgtaataaggggttaatttgtgaacccgcttataaatcaaaatcttctcatggctggtcgtcctcgctctcctgtcgtcggcttctcctccatcgccgatgatcatcactctatcatcagctctatcgtcaattcgtctcctgtgtttcggcctggccagattaacctaagcagaaagagcagtagttttatcagttggttatattgacccaagccagaaatagcagtagttttatcggttggttttataagtcgtaacaatatgtatctcacgacttaaaaaaataatatataaaaatatcatgttggaaatatcctaaaattaactttataatttaaaatcgactcaaatatctaaattttaagtttatcatacccgggaggttatcctcgtcgagagaaaccgacccggttgattttcctgtgtctatatatatcgaccgagttgaagcctcaagaggaggaaaggatcgaccccgacccgacccgaagttccgaccccaaccagagagaggcgcgcgcgtgcgggtgcggtgcggtgcggatcggatcggattgggccgagttcccgaccccacaccacacaccccctcctctccccgtccgagagggctccggcctctcctccctcccgcgatccccttcccctccgcctctagccgccgcgccgcgcctcgccgcgcctccagccatcgccgtcgaccgcgcgcgcgcgcgagaggttcgtctccgtcctcctccatcccatctctctccccttccatggatatttccttcctcttctctcgggtttcttctcttctacttgatgagattttgtatgcatgtatgtatgtgtgtgcgtggggggattggattgattggatttggagcgcgccttagaaattcgaggggtttcctgcgctctgtttgctttgctccctagatttgccactccgatttcaaactcttcgagtaccaaccaacccttgcggtatttttgctcttcgaatgaggttatgagatctcatgagccacttagttttcagacatgcagatgcgcgcatgtcgcctccatgttgccggcgtaccatctgttttttttttcttctgttatttttttcgtttcataagattaccatgtgctagtaattactgtgagtgattttatcagagacccactaattttttatgccttaatttgttttctctcattttttgcagagcggctgtacgcgattcacatgtgcggtaatttacctgcctactgccgccaaccagaagtggaatataccctatcctaattttctttcttcggatgaaaggtctgccagtctgcgtcag

SEQ ID NO: 7286 - DNA, 1501 bp, Oryza sativa
tcatgtcactaaagattgccgcatctcaaaaacatcttgttctcctgtatcagaaatccctaaaggagaaaaagtcttctgaggaactaagatttgaagctcacttcaatcttacaaaagaaagacctgaggttgaaagttctcactaggctcctattgaaccagagaacaccctcgttcttctcccagaggataccactgcgctttctgcaatagatgatatgctcatcgaatactgctcaacggacccacttagagatttattgtaatctcagtgcgtcccacttagagataaagctgctttaatctcagtgtgtttaagacattatattgatatcctatagtttgtcaaaacaatattggttgtaataagtagataagtacaaactcccttatattataaagttgtaagacttgatagtcattagagtatgtactattaacctatgtaaacgtcatactatgtatctgatgttttcattattgtatgtatgtatatattgtggataaagaattcttcactaagcaattcttctttcactatagatgtctaaggatatcgctctgaaattgtccttctctcatccattgtagcaatctatatcaagaaaatcctctaggcactacttatagaacaatatatttcaaaagggagagcttataaatgactaaatgaacactatcaccaccaaggtcgtgtccataaaagatataatgccccgatcttcagtggttcagaaaccagggtacagaaaaaaatcattataacagcatgcaggcactgctcttatttgaactcaacgggacagttggagcaaagctttccggtgcactagcacataatttggctttttcaaggacaaatatcttctagtgttacctgttgaaaacaaaacagaaaatgaacaaaccgaatcagggcaaacatataacgcaaatgtagatccaatcgtccaaaggtaacctaaattgaaaacaataattcactgtaaatgcgcattcacatttctttttttatatatgcaaggagcgtatctttatattaaggagtaataaaagttatttacaggcacattcccaaatttaggatagcattacgaatttagtaaaaaaaattcaggattccccatttcactatactttgaatacccaccaagcattcctggtaagaaacataaaatcacaccaaacaaaacatactccaaaatgacaaggactacgaaactaagcagtgattcatcccaagaaggtcgatcacacgacgattgatctggtgttctaggaatctaggctactcctataaaggaatcaacaaagaaaaacctgcagaatccattcatttatcaatccctggtagaacccgtcatactagggcgaacacccagctccccaaaccctacctcaccgtgacacagagctacaaatccagccataaaccaatcaaacaagcaaacaatttacccctattaggccttaaccgcagagatcatagccatgatta

SEQ ID NO: 7287 - DNA, 1501 bp, Oryza sativa
tggttgcatccgtggtagccatggtcacatccatggtagccatggtcacatcaactaatgtaccgtttagaagcctagaatcgtccgtgtctgcggttatttgtgattctgtgaatcttagcaaccaaacaaaaattacccaaaattaaaagtggcagtcttacacgatctgatcattacttgccccaaactcaaggcaaaagtttacaaggtagtagtacatgattgatgatacataagttttgctccataaaaaaaggaccgattagaacgcatgtgattttcacgaggaaaaccacttgattcgtatgtacagaaaaacggtggaaacccctgtagactgacccggcaaacaagcatcatcagtgcatggatactggaccaaaaacaccataagaaattaaagagaacggagcaagcgagcaatcagccagctagtactagtacatatatattgtacagccgtgatctggtcggagatgagacgatgacccgccggcggcggccggccggcgcggcggaggcccatcgatcgatcacttgggcccccaaagcagcaggtgcatcaccttgtccgtcttgccgccgacgtccgccgtgcgccgccccgccgttgccgccggcgtggccgcggtcgcggccgcgcggggtacccgcagctgctggccggcgtcgcgcgccagcgcacgcattgtcgccgggagctcccacctgctctcgcgcccgctgctcatggcgaatcaaccaccgctttctccttggcccttcttgctatgctatctagctcgtgctgctcatcctcagtccggtctcttctctctcccagccacctcacctagcctcttatactgccactgcactactcctggtcatgagtcacacacaattttacattttagccttttatgaacatttattttataaatagatctttaaaaaaaacttaatctttccatccagaaatataatatggtactgaatatgacacattccagcatcatgacgagtttggacagatatcttacaactaaaatatatccaatactaccttcattctaaaatgtagctatttctagcacagtactttgtcccaaaatgaagctatttttatacctaccttcccctctcaaccaatcacaaccattctttttcacctactttctcttttcaaccaatcacacaccttcttcaattattctcacatactttcttaatacccgtgctaacctcaaaaatacttacattttgggacggaggaagtatgatacaagattgctatatcatgtaacagatgaaatattctgtcaccgagctacaggtttgaatataacaatctaaagatgagatactagtactatatagttagaatagactcctttccgctctctcggagagactcatagctctagttctacatttttataatatgtaacgaagagattaagtccttggttagtttgggaaaaattttagatttggttggtatattggatatacggac

SEQ ID NO: 7288 - DNA, 1501 bp, Oryza sativa
tccaccgccgcctcccgcacccaccgccgccaccttctccttttgttacgccgccgccgccagcctccgccatccgccgcccaccaccgccagttgggccacgaggagaaagcccaccttgccgccggtgggcccacgtgggctacggcccaccaaccaggcccgtggcggctgtggggcccaccgggcggcgtgatgacgcgttgcgctgcttagagctgagctgccgtgcgaacgtggactgtgctctggaggcatcagagcatgtggctgcgacgcggagcggagatgccactcctctactaaaataaccaaaaaaaggtaattaaaaattaattaaaatattaataggctgtgcttgcaaataggtcaaagcgcagggcggctgcgctgtggctgcgccggcttggattggagcagacttcacctgagtattcgggatccccgcctctcctccgcggccagttcatctcaggttggtagtatcagccttggtgattgcttggttgtttttgatgtggccgcaaagagatctgcagctgatgttgtgctccctgcggtttcttggtttggttaggttatttgtggttgtgatctctgcggctaaggcctgagaagggtaaattgcttgttagtttgattggtttatggctggatttgtagctctgtgtcccggtgaggtagggtttggggagctgggtgttcgccctagtatgatggattgctctgctaccggggattgatgaatgaatggattctgcaggtttttatttgttgattcctttatcggagtagcctgaagtcctagaacactagatcaatcgtcgtgtgatctacctttttaggatgaatcactgcttagtttgtagtacttgtcattttgtcgttttggagtatgttttgtttggtgtgattttaggtttcttacaaggaatgcttggtgggtattcaaaatcatagtgaaatggggaatcctgcaatttttttactaaattcgtaatgctatcctaactttgggaatgtgcctataaataattttactctttaatacaaagatgcgctccttgcgtataaaaaaaagggaatgtgaatgcgcatttacagtgaattattgttttcaatttgatttacctttggatgattggatctacattcacattatatgtttgccctgattcagtttgttcgttctccgttttgttttcaacaggtgacactagaagatatttgtccttgaaaaggccgaattgtgtgctagtgcaccggaaagctttgcaccaactgtccggttgagttcaaataagagcagtgcctgcatgctgttataatgattttttctgtaccctggtctctgaaccactgaagatcgtggcattatatctttgatggacacgaccttggtggtgatagtgttcatttagtcatttataagccctcccttttgaaatatattgttctataagtagtgcctagaggattttcttgaaatagattgctacaa

SEQ ID NO: 7289 - DNA, 1501 bp, Oryza sativa
  unsure (1)..(1501): unsure at all n locations
agtaacctgtttcagatttattatcattaaatcacgttctatattgcaacattttagaatgaagaaagtagaatttatttcacatatatgatgtgaaaatttcatcctcggtatttttttttgattgaacgaataaggtctaatgtaaactaataccatatccttacgttacaataagatgtagaataatatttttcactcctttgagtgtgccggttctttttttatggataataggagaggttaaagtagtaaagataatcgtgaaaaattataatagagttttacgtaaatatactatcatgtactattccaccaagaattatatttaaacataatctaggtaaacgaaaaagacaaatgttttagtttttaacgtgagttgagttcagcatatgtggctaggctaaatttgtttttctttcttantcttttgcagtagacgagtagtagagtgcttccaaaacaaagttcaaaaagtatcagggcatatggtgtgaatgtagattgtgtggtattttatgttctcaatttgtttttaccacagttatgtgagggtacgtagaaaaatgcagtttcagtgtagaaccattttgattttttgtaggatacttggtgattgagaatttgtaggatatattattttttaaaaaaaagatatttagcgatattgtttaggctatagctccacagcatgacttttaacctaaagactctcgtgagttcagaatctaaaagctgcgttcgggacatcggtttgatcttagccaacacttgaaacgagacaaattattagcgtatcattaattaattattaattattataaacttgaaattagataatttgtttttcaaaaaacttatatataaaaaactaatgtttcggacattcacaccttctattatctgtgccttgtctaaatctccatgaagatactgtggaatagaatatgatacatcaattagttgtccgaatccaactcattttcatccttgactcacatcctaattatgtttcggcaatgctctttttttttaatttgaagttgataattcatatttttttaacatgtataatcatagcgtcattcactatttcactgataaaaatcttctctatcatcatttatcttctcgatatgtgtttataggtggcttatagcattgtacctgctctaagcggttgtatactccgttcaagcttgtcgctggtcactagctagccatgttataggttaaaaaatctagattaatttcgttttaaaaataaaaatactaagattaattaactcaaattaactgttgtttcacaggccaatttgttgtccttcaaccttattatcccgagccatgcaatcaaatagtggaagtatagtagtttgtaggtgaacggtccaaatcgtatttatagctatgtaatctcacacgtatccctctctttaatacgatattgtgtatatctgagacgtaccataaatcaaacctcaacatttaaaatcac

SEQ ID NO: 7290 - DNA, 1501 bp, Oryza sativa
tgtttcatactttaaatatgtgtccgtatatccaatataccaaccaaatctaaaatttttcccaaactaaccaaggacttaatctcttcgttacatattataaaaatgtagaactagagctatgagtctctccgagagagcggaaaggagtctattctaactatatagtactagtatctcatctttagattgttatattcaaacctgtagctcggtgacagaatatttcatctgttacatgatatagcaatcttgtatcatacttcctccgtcccaaaatgtaagtatttttgaggttagcacgggtattaagaaagtatgtgagaataattgaagaaggtgtgtgattggttgaaaagagaaagtaggtgaaaaagaatggttgtgattggttgagaggggaaggtaggtataaaaatagcttcattttgggacaaagtactgtgctagaaatagctacattttagaatgaaggtagtattggatatattttagttgtaagatatctgtccaaactcgtcatgatgctggaatgtgtcatattcagtaccatattatatttctggatggaaagattaagttttttttaaagatctatttataaaataaatgttcataaaaggctaaaatgtaaaattgtgtgtgactcatgaccaggagtagtgcagtggcagtataagaggctaggtgaggtggctgggagagagaagagaccggactgaggatgagcagcacgagctagatagcatagcaagaagggccaaggagaaagcggtggttgattcgccatgagcagcgggcgcgagagcaggtgggagctcccggcgacaatgcgtgcgctggcgcgcgacgccggccagcagctgcgggtaccccgcgcggccgcgaccgcggccacgccggcggcaacggcggggcggcgcacggcggacgtcggcggcaagacggacaaggtgatgcacctgctgctttgggggcccaagtgatcgatcgatgggcctccgccgcgccggccggccgccgccggcgggtcatcgtctcatctccgaccagatcacggctgtacaatatatatgtactagtactagctggctgattgctcgcttgctccgttctctttaatttcttatggtgtttttggtccagtatccatgcactgatgatgcttgtttgccgggtcagtctacaggggtttccaccgtttttctgtacatacgaatcaagtggttttcctcgtgaaaatcacatgcgttctaatcggtcctttttttatggagcaaaacttatgtatcatcaatcatgtactactaccttgtaaacttttgccttgagtttggggcaagtaatgatcagatcgtgtaagactgccacttttaattttgggtaatttttgtttggttgctaagattcacagaatcacaaataaccgcagacacggacgattctaggcttctaaacggtacattagttgatgtgaccatggctaccatggatgtgacca

SEQ ID NO: 7291 - DNA, 305 bp, Oryza sativa
tacccatcataaggctggtttattccaacgattcctccccaagaccaccccaaattatagagcataaaaaaatattccaactctgggagatcgtaaacaggaaaagaagaaaaataggcaccgcccacactccaatagctctagcttaaaacccgggaaaaggctagcattcgttccgaccgcttgctaagccaacaaaggaattcaagtgagatcgtctaaaatccattcctaacaactgacaccaaactctactctagccacatcttcgagattgagggaaagagtgacagagaagaatggaa

SEQ ID NO: 7292 - DNA, 1501 bp, Oryza sativa; identical to SEQ ID NO: 4091

SEQ ID NO: 7293 - DNA, 1501 bp, Oryza sativa
  unsure (1)..(1501): unsure at all n locations
aatttagagagggttctataggagagagagaaggtgataaggccgattctacgcattgcaagattctccctgttgaatttaagcatagtgacaggcatcagtgctagtgtagaaaaaagtatattggacccgcatgtcagatatcattgctcccagaaataaagtggccaatctctatttccttttttattcacgtgggtcccaattaaagaacacgtgggtcccaatttgatcggcctgagcttcgccacctcagcgccaaggcgtttggtgctgaccttcggctctagtacaccttcaccgcgagggggtgaggggctaagtccccaatctcagcgtcaaattgcttggtgttgaggtcgggtatgttagcgtcagtgtggtcggtgctgaactttgtcacgtgtgcagtttggccgcgcctccagggcggagctagagtattgggggcggggggggggggagggnnnnnncctnnnnnncnganaanaaaaannngaagcnataannaaccnaannaaaccatgtctacacccctcaatacaaatttagatacccacattagcttaaacttgatataaaacagagtaaattaaacaagtgacacccctatgcgcctctactcaacggttggagacgaatgtcaagactttgttatgttaaactaagttaaaataaaatttatttgaatataccttttttttcttaagttcagttcaattcttataaaattttgcaaaatttgtactacccctgtacttaaaataatgtcatttcgaaaatcaacaaaagctccattacacgtattttacaattgtttttccaaagtatatatctataaaaaatttaaaatacagccatagctttttaataacctgaaatcgaatgcacgggctgtaaaacagacgcgccaataagcacgtttatttcctacagtaacttaaaacttttctcatccttttgtttatatgaatgaaaatacaggtgggcattatcccaaagagagaaaacaagaagtatcattgaaggattagaaaaaggaaagcaaaagaattattgctcaaaaataatcactgctcaaaaaagtgcaacgatatttgttacacgagctcaaagaaggattatactccctccgtttcatcaaaacagaggaagtagaaaaaaaaggagcgaaagaaaaattccccgcaaaaagagccacacgcccaccgtggggctcgaacccacgaccaggttaagagccttgcgctctaccgactgagctagacgggcttctgtatatgacacacgaactagttttctcatcgtcgaccgaaccgagcgaccggttggatccgtcccccgccaccaccaacccgtagtagtaccgccattagaaccccacagccttgccgcggccggagatctcaccagccaattcatccatccatccaagctcctcgtcactcgcgccggcccacacccctcctcccgcctggcggcgatccggcagatcccgcca

SEQ ID NO: 7294 - DNA, 1501 bp, Oryza sativa
tactcgaacaagagaagatgccaagggaagattccgtggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaagacatcttgaatacaagagtaatcctcaaaagttgtgtttgctgttcgagctagtttctaaggataggcgggaaaacacttctttccggcctatccccgatcttgttcgtgacctaaggtcacaacaagctgcgacggcgaccgatcgatgccgcagcctcaatagtggcatataatcctgctcgttacgtttgatggccctctacagtggcgcagtaatttcgccactgaaatcaggagaaacccaggtatttgcttcgctatcatggcacggaacttttactgttgtggcctggttcaagttaatctcgtgattttgtcaagttgtttctatgtgtgacggtgctttttcttatgtgggtcatgcaaatgataaggcgttcttgacatagattttttctcttttaagaacatgatgaagcacttgatcatctgcactcgcgatagttcgttatgaatcttactctgctttactactagtactacttcagcaagagagtactcactcagaaatttggcgcacggtaaccatgaaagatccatcgatctgtttctttcagactttcagtgcaaattttgcatctattcaagtgatgccacttcacccgcccagtcatcaggtgcctctgtccgagtcatctcactctcatcgttccctacagcgccatgcaggtcctagctgtagctgtcctattttagcctttgctccggaacaagtgaaacgtgaagtgagttaagtgacatgaccgatgattaagctggctggattatacgatggattgcatccacgcggtgcgcccgcagaattaatctacggcagataaaactgccggccggtcgtcccctgtttctgtttccggcagcatgctgtcacgggctgcacgatcttcacatgttacacgtaccgggtggctgatagaatagcagaaccaagaggctctctgccgcaacaaaaccgaattcacctgccaatcacggggcgcgatctcgacgtcctaggatgggcattggccaggggctcctgcactcgacacgcagggccctgacggtaacacctgaaaaccgggtctataaatagccgaggcgcgcacacatgttcctggcaacacaggcaaagccgtaaagtgcatcagactcatagtggaacggactagtgattggttggcagagctcggaagattcgacgaccgatcagacgatgaaggggtatacggcgcgtttagttgacgaggaagtcgaactcgaggcccatacggtaagtggta

SEQ ID NO: 7295 - DNA, 1501 bp, Oryza sativa
cgcagaccagcctcccctcgaagcgcgcccggacgcggcggacgtatcccggggtgcaatcctccgccatgccgcagcactcgcaccgcacgctccgcgcctcctcctgctgctgctgctcatccacctcctgtagatcacaaacgatgcacggcacgatcggtatccatgccaatggatcggaaaagcagtgggataattagaatggcatggttaccacttaccgtatgggcctcgagttcgacttcctcgtcaactaaacgcgccgtataccccttcatcgtctgatcggtcgtcgaatcttccgagctctgccaaccaatcactagtccgttccactatgagtctgatgcactttacggctttgcctgtgttgccaggaacatgtgtgcgcgcctcggctatttatagacccggttttcaggtgttaccgtcagggccctgcgtgtcgagtgcaggagcccctggccaatgcccatcctaggacgtcgagatcgcgccccgtgattggcaggtgaattcggttttgttgcggcagagagcctcttggttctgctattctatcagccacccggtacgtgtaacatgtgaagatcgtgcagcccgtgacagcatgctgccggaaacagaaacaggggacgaccggccggcagttttatctgccgtagattaattctgcgggcgcaccgcgtggatgcaatccatcgtataatccagccagcttaatcatcggtcatgtcacttaactcacttcacgtttcacttgttccggagcaaaggctaaaataggacagctacagctaggacctgcatggcgctgtagggaacgatgagagtgagatgactcggacagaggcacctgatgactgggcgggtgaagtggcatcacttgaatagatgcaaaatttgcactgaaagtctgaaagaaacagatcgatggatctttcatggttaccgtgcgccaaatttctgagtgagtactctcttgctgaagtagtactagtagtaaagcagagtaagattcataacgaactatcgcgagtgcagatgatcaagtgcttcatcatgttcttaaaagagaaaaaatctatgtcaagaacgccttatcatttgcatgacccacataagaaaaagcaccgtcacacatagaaacaacttgacaaaatcacgagattaacttgaaccaggccacaacagtaaaagttccgtgccatgatagcgaagcaaatacctgggtttctcctgatttcagtggcgaaattactgcgccactgtagagggccatcaaacgtaacgagcaggattatatgccactattgaggctgcggcatcgatcggtcgccgtcgcagcttgttgtgaccttaggtcacgaacaagatcggggataggccggaaagaagtgttttcccgcctatccttagaaactagctcgaacagcaaacacaacttttgaggattactcttgtattcaagatgtcttgtcctgctacaggtttttga

SEQ ID NO: 7296 - DNA, 1501 bp, Oryza sativa
atgtactgtttatgcttgtttttgtactgttttgttgattttgttcttttgctttagtttccgacgttccggaggagagcgtttttgttgaggaaggttcggaagcgtttgcggaagctcaaggcaagtcacacagatcccaaacaaccctttgagcatgttgaacctatttaaagctaatgttttatttcaactcatgcattattttcgaatgtcatcgggtggtgagcctttcccaattaattatggccgaagatgactttattttcctatgggtaataaatttattagcttggaccttatatattggattggttcagctaaatgctatatatataattgcttagccgtgcttagaaacattagttcattaatgggatgaatcatactacattattatttatggttatatttaatggtagctcacgatggtcaatcgtgttatgataattaattgataattaaaatatgattaatggtgagttgtgagcacatggttttgatggtcgtgctcatgacaattaaggactggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgttttataagggagtgattatgatccaggaacggtgcgctgtggtggattgtgttatgcgaggggtactgtcacagctcctttccgaggtaccgtggtggtattgaggcgcatggtgacatgtcgtggagctgtgtcttgtgggtacagtggtacacctctggccagagtaaaactattcgaatagccgtgcccgcagttatgggcaggtctaacaatgtctttcgtgattagtttcacacttttcaccataataaatgatgctataactggtaataatttgattagctcctggtttggaatggtacatttctggtttggagatagatctatacagccgggtatggttgttcaggatggttgggcctgtgcagcatgggtgtgctgttcagtgttgattaatattgatgattaattactctactgttttacaaatctcaaatgtttgctaaatgctgcttttgcaaataagccctatattatgccattctttggtatccttgtgcacttgcatatttgttgtgtggcttgttgagtatgtcatatgctcaccttgcaataatcaatcaaacctcagtggaagacaagttgcgaaggagaagacgtttggcttataccccagttgagctgcctgtgggagtggagccggagcttcgctagaccgtaattccgctgttgttttcttttcttttataagtatgtaacgttattattatgatgaatatgtatattaaattgtcagtttgtgtacctcggctgattcctggacgaggatttcatgcacaaattagttcggaaattactagtgaatttctgg

SEQ ID NO: 7297 - DNA, 1501 bp, Oryza sativa
ttttaatacctagtacgtcctcaaagactaaacatcattctatggttaacgagaatctacaaaattattgttatctgacataccgatcgatcgagatgttgacaaactaattattacattggtgacacgcacttgagctatcaagatgtcttttgtcgatatatatcacgatttcacgatccgccagaccgccagtaaccttacaatattaattagagatacttttgagttaacctgaaagcggttcaatggtctaatcccgatatatatataggctatcacaattcacaacttaagttcacgtcgatcagtagactgtacttcgtgttaattagactgttagtagcatcattcatcagagaacatctggcgcgatactggctgtcgtcggtctgtcacgcacgtatcgcttacgtggcaacctgcgacgcgatcaaacgtacggcagcgcgcaacttcgtgtcctgccgatcctggcgccggcgccgccgccgggagctgcagacggcgaggcggagtcaccgctccggccgcggcagctgatcctgacgatgtcgcgcatgccgcgcacgaggcagagcgccgggttgacgcgcacggtggcgttgaactcggcgcacagcgccgcgtgggacgccacggcctcgcgcaccgccagcgccgggtcgcgcctccgcagctcgctcaccgcctccgcgcatatgccgcacacccacctgccgtcgaaccgctcccgcacgcggccgatgtacgtcggggtgcagtcctccgccaccccgcagcactcgcaccgcacgctccgtgcctcatcctgctgctgctgttgttccgccgctgcgccggcggccgcgcctggatcagctggcagtagcgcgtcgtccgagagtatcggcccgtcgccttcatagcgctgacgaatcacgcgcgcatcctgacaatccatagacgaagaaatgacgacgtgagtgagtttcaaagattagacgaagaaatgacgacgtacgtgagtgagtttcaaagaatgagttgcaagactagtagattgttggcccattcgttagtacatgccatttcaggcgtgcgtgagtttcaaagattagtcgataattaaacagttaattccatttcaggcgtacgtgtgtggtctgcactgtgctgtgcacgattgcacgtagcgtgtatattggaggactcaggaggggagattaccgtgggggccttgagaccagcggattcctcttcgctagctgaactcatgaacgccatggactaaaatgaagtttaggtaatgataccgtgataccctgaactaaaatgaagtttttgttgcttatccggcgcgggcggacgcgtatatataggcagaatgaggaagcgggcaagcctaccagataccgtccctagaaccggccggcagggttgggttgctgcaagggggatggaccgatgtaatgatgcacacaggtgcaatgcaacttgtgttcggatcacgcccctgcca

SEQ ID NO: 7298 - DNA, 1501 bp, Oryza sativa
tcctacttgaactcttcttttgttttcttttttgctaatttcggattttatttttatttttattccggatattaattaatcttgtattgggctcttatatggactcttctttcattattccttatttttaattcctaatttcggttatttttaaattgtatgcttacttggactctccttttattttataatgtcagattttattttatttttaattctaaattttgattaatctcgtattgagttcttatatggactcttcttttccttttctccgattaatgtgggaatttctagccccacagcgaacgtggtgcctcctttcaaggctgttttaatagataatagatagatagatagatatgcatggaacaagtatatacccacgcgagtgaaaaaaaaaacacttccaactctttatttctgttcttgctcacagttttcatgctctcactgtcatagtgtcatgattccctcaagataataatacacttaagaaaatgatatcagtgccaatattaatttgaactagttagcaatatatttattttttctgcaccactcgagagcaatatgctgcagacgtgacctgccaagtaggcatcctcaaccacgaacactgtaatgatgataagaccatgcaatctgccgatacgcatcccgtgagtccgctcgcaactggcgaccgagcggagggatgtatcacgacgctggtcggatgtgcctgtgcgcgcaactgacaacgcaaatggaccggggtgaaaacctcggactactgatcggtgcattgcatctcgttcgacgttttattaataacctcagtcaacagtgcgcactctgcagtctcagaaactgaggagatgctttgtagtctgtagtctgtacacttggccgccttttgtctctggcaggggcgtgatccgaacacaagttgcattgcacctgtgtgcatcattacatcggtccatcccccttgcagcaacccaaccctgccggccggttctagggacggtatctggtaggcttgcccgcttcctcattctgcctatatatacgcgtccgcccgcgccggataagcaacaaaaacttcattttagttcagggtatcacggtatcattacctaaacttcattttagtccatggcgttcatgagttcagctagcgaagaggaatccgctggtctcaaggcccccacggtaatctcccctcctgagtcctccaatatacacgctacgtgcaatcgtgcacagcacagtgcagaccacacacgtacgcctgaaatggaattaactgtttaattatcgactaatctttgaaactcacgcacgcctgaaatggcatgtactaacgaatgggccaacaatctactagtcttgcaactcattctttgaaactcactcacgtacgtcgtcatttcttcgtctaatctttgaaactcactcacgtcgtcatttcttcgtctatggattgtcaggatgcgcgcgtgattcgtcagcgcta

SEQ ID NO: 7299 - DNA, 1501 bp, Oryza sativa
atggtgctagctacctacctcaagtatgtttccactgaagacttgttactggcgccgtaaaatggaagagcgagaaacaccgatctaatgacagaacgtcagaaccgtaccaatgcatgtcgctgggctcgctactaatttaatttatcaattagaaccgaccacatcgtgaaagattatatgtatgccctggctagtaaattagcgcacgtctgctattccttggtgctgaccccatgcatgttacctggaaggctggaactgaacgagccggctgcctgcttctaggtttctagctagcttggctgcgatgcaacgctgccgggaggctgctcctgctcgttcgcacttcgcacatgcgaaccgcgaggcgcggggccctgcgtgagaaaaccgagaaggtcaccacctcgtccctccgaccgagacggtaaatatctcgcgcgcgctccgttgatatgagtttgtgattggccgatggaaaccgtgtcgcgcgcttctctaagccgcggagggatattttagaaccaaccaaccgagccgaaagatgccttgatgttcttgcgaaaacgcattcctgatatagaactgctcctgtaagcgtgttttttaagcggtgtgatctgcatttttcccgatgcccagtaggagagaaactaagcttgggcttgcgtgcgaggagcactgcttgaatctttgcgagtcactcttcgtccaaccttactcgccgtgcagtgagagatccatcagggaagtcaaacagtactctttcagttccagagatcaattaacgtagcatagtgagatatacagctcggtgcagtactagtatggcatattggcatgtatagcgaagccctaaactatgaccctcaaatttgtttgacaagaagcaaatctgaattttaagttgtgtactgtacgtgtatatagctgtagcaaggtcggcagcataataagataacagtttaccgagatctaaggcttccctacctttgacataagaaacaaatcttagttcagttctccatctagctaggtaccccctgatcctcctcaacctcagtataatctatcgtgcttccatgtgcacagatcgatcaaactcgcatgatgagacgacctgcacttgtaaaatgcttatatacgtagaaacggagactaacaccaatgatcacctgtgcacagttccagtgtactagcactagctaacaggacgagggattggattccaagggtagacttggtttcccctcgtctcggccagcctgacattcgattcctcacttgccttgccgccctcattttcctcaccaccttcgtctccaatctcattccattacctctgctatatatacacacaaaccgctgacccttctaccgtggaaacaacaagcagccacacacttcaaactaagatcctagcccggctagctgcagggctagctagctagaagcaggcaggcatcgatggcgccaatgccgcttgcttctagctcct

SEQ ID NO: 7300 - DNA, 545 bp, Oryza sativa
aaaaatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccacctcctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcagg

SEQ ID NO: 7301 - DNA, 1501 bp, Oryza sativa
tggtatttactttaacttcatcattgtttttgtttggtttagtcaccctatgatgctatggaactactttttcttatagatgcaatagattataaattcatgatagccttttgttccagctttgcctatttttttagactatccaggaacaattatgcttagcctcttgtgttggatgattttgttgccaagaacagttaacaatcattccatccatgattacatatgttgacattttttgtgtgtgagtcagtaataatcctttggtcacaaaatgtattttctgtgagatcaagtgtccaagccataataaatattggaaatagaatgcagtgaggatactccttttgtccaactccacggaaagccggatctacatctttcatagaaattgacatgcttgatgttgtgaaagagcctttcctgattttgtctcaaaacgacgctaacatcatgctggaactgcaaacaagtttttttttttaagaaaaagatgaatgatatgatcatagttcaaacatcacaatggtcacccaaacaccaacaaaagctcattatgatatagttggcaacaaattacacccgagaacacaaaaggatcataggaacataaaaaatgtcattgaatgaaaaataaaagaacacaaatgcagatagaccctcttacctgaagcctgtgtgttcttgatggcaatgaaatttagaaaatccttgtggggagagaagcgacgacccagagtccggagagaggacaagaggggaaaagtaaagggccatccgcgcaaaacgggttaaggcaaagaaaaggtaaatttgtgagtgcatgcacttagtgtggtaagcggatggggaagtgggttgtttgtggatttgctatatatagcaggggcatgcgccattcatacttttaccttttcttccaaatgatgttcagacctgcaaaatcaccccccccccccccattatacattggaactgcaaaaattgttgtaaatagactaatcctaaaactatcaagactaggaaaataggtgctagtaggattcctaaactagaatatgtcctcatgaaagattgacagtcaactgatggaatggataagaaccaaaactcttgtcatgagttttatcaaccttttctcctgtaatgaattgtttgtcaccattattttcatatattcattacagaattagtttacttcattctgggcccatgttcttgaggtatctcatgatacccaactgatctggggcaggaggagtgtctgagcataacaaaaactttcaaaacaatagaaaagttccaaatgcttttgaaaattttcattcagaccgaaacactcaaatcgaaaaccttcaattttttctgaaactttctgctctctttttcctcctcggggcaaagaatgaaacaatctcaatattccagtaaaatcttcaaaaaaggaatattgattcggtacatttcacgcacttctcacatgcataccgagccacctcta

SEQ ID NO: 7302 - DNA, 1501 bp, Oryza sativa
taataatacgagtagttaaacagtgcaaacaaaaacttaaaattacttatattattagacggagggagtagtagacgtccctatccagctgacagaaaaaaaacgagaatggattaaggagttacagtttggcgtttagagattggtttttggttggcgggtaccttcagtttagtacgttttggttggtcgctgtaggataagatttgggccttggctttcgagaggtaggtagaatgggccttcgagctgtgggtgaaagtctagtggaaaaagtccactttgactcccttaaaaagtcacccgaatctaatccgtgaccctcaaccgtaaaaccggataggatgactccccgaactattcaaactagtgcaatttgactccctgagcggttttgctgacgtggcggtattgacccggtcttcatcccacgtggcgcttatgtggcattacaatgaaaaatattttgtgggacccgtctgtcatttacacacaaaatatattgtgggacccacatgtcatcctttctctctccaaccttcttcctccccctctctctcccttctctctcttttctcttgcagccgcacccgctgaacatgccggtgcagttgaacccgtgcgccacctcgccggtgccggacaccgcgatgagcccgatgaacccttcgtccagccgttccttgacgcagtagtcgatggcctcctgcagcccggcacccctgaactccatcacggcggcgacgtcgcgcgccagcgtggagcgtatgatggccttgccttcccccgacccgatcaacggcgagtcgccgatgcacccggtcatcttgttcatcagcccgcccgtggacatggctgccgcggtgtggccgtttgagtgcaccactgcgcaacccaccgtctccggcgcgggatatggtagtcaaactgcttgtaccaattaatcacaggatgtcacggttagatgttagcaattttcataggcgaattggtaacatgagtcgatgcgctgatcaacgaaccaagatgccgttggcctccttggtgagcttcagcatgccaacgttgtcctcggtgatgaagtagctattgtccacgacctcaagaccttgcaaacagtgaccacaaagaaaaaaatcagaccagtccacgacctcaagatctgcaggactcaggtggaccacgctggtaggacggattcgtcctacagctgctggtcctgccaaaattcgactggattccatggtggctgcgccttgctaccccacgctggcactgcacttgcatctgctaggcaacactgtgcacatgcatgttctccgggcagaaagaaacagaggcggcacccccttccggcgcagaccgggaggcacggctagggccggcggcgtctcaggcttcgccgtctgcattagccctctccttcgtcccagcctggcgcggcaccattgtgggggaggccacaggccggacgcccccgccttctccggcgagctgaggc

SEQ ID NO: 7303 - DNA, 1501 bp, Oryza sativa
ggatcctggttgacaacatgccgatccggcaattcaagaaccacttggactccggcgtgccgttcccgatctaccagccgatgaggctgtttggctgcctgtgggacgccgacgactgggcgacggagggtggccgcatcaagaccgactggtcgcaggcgcctttcgtggcatacttccggaactacaccgccgacggctgcgtgccgagctcttatgcgtgggtatgcggccagggcccggccagcagcagtgactggttcgaccgggggctggacgacgtcaagcagcagcagcagctgagggaggcccaggacaagtacatgatctacaactactgcaacgaccccgagaggttccccgatggttatccaaaagagtgtgggttgcagtaggatagaggtggctcggtatgcatgtgagaagtgcgtgaaatgtaccgaatcaatattccttttttgaagattttactggaatattgagattgtttcattctttgccccgaggaggaaaaagagagcagaaagtttcagaaaaaattgaaggttttcgatttgagtgtttcggtctgaatgaaaattttcaaaagcatttggaacttttctattgttttgaaagtttttgttatgctcagacactcctcctgccccagatcagttgggtatcatgagatacctcaagaacatgggcccagaatgaagtaaactaattctgtaatgaatatatgaaaataatggtgacaaacaattcattacaggagaaaaggttgataaaactcatgacaagagttttggttcttatccattccatcagttgactgtcaatctttcatgaggacatattctagtttaggaatcctactagcacctattttcctagtcttgatagttttaggattagtctatttacaacaatttttgcagttccaatgtataatggggggggggggggtgattttgcaggtctgaacatcatttggaagaaaaggtaaaagtatgaatggcgcatgcccctgctatatatagcaaatccacaaacaacccacttccccatccgcttaccacactaagtgcatgcactcacaaatttaccttttctttgccttaacccgttttgcgcggatggccctttacttttcccctcttgtcctctctccggactctgggtcgtcgcttctctccccacaaggattttctaaatttcattgccatcaagaacacacaggcttcaggtaagagggtctatctgcatttgtgttcttttatttttcattcaatgacattttttatgttcctatgatccttttgtgttctcgggtgtaatttgttgccaactatatcataatgagcttttgttggtgtttgggtgaccattgtgatgtttgaactatgatcatatcattcatctttttcttaaaaaaaaaaacttgtttgcagttccagcatgatgttagcgtcgttttgagacaaaatcaggaaaggctctttcacaacatcaagca

SEQ ID NO: 7304 - DNA, 1501 bp, Oryza sativa
gagaagcgtacagacgaaagagctaaaccctttgttataaaatataataaattatagcatttagaatttgtttaaaaatatgacaatttatctaccaacatttcttcctaacaaattataacctttcatcgtttaaattcctcacatgtctatatttttaacccatcataacatttttttatttagttttatctttttatatatgtttttaattttttaaaacactttaattatgaaacggaggtagtatttttgttctcttctttcctcacggggaaaaaatgaaaggccgcacagccaatcagccatagaacgcagtgatacaacttgcacaggatgagctctcaaaagcaaatactcaactccatatatgggtgcaggagcagtagcgcgtcaatcgtcaaaataagagtattgttgactaccctactccatttatctaccacgtgccactttaaaagcctcatgggttatgggctgcgtgggccgagaaagaagcggggtctgatgagacgtgtgttgtgctcacatgttctgaacctcctgatgagatggtaattcgtcattgtaatttttgcaatgaatgtcaactgaatatctcatgtgattttcttgcgctccaaatagaatttcacaagagctcccctgcaaatttgaatggtcatcacagctcacaataattccacctgtagttagcatgtatatatatagcctttgtcccgtgttcttcaaaaaataatattagaccttaattcaattgaagataatttctgaactgaagctccaaacacgcacccagcaaaaggcacggcataaaagtgatgttcataatgggttttattgatagtagaaatcaattgaaccatttatctattctgataggaaaaaaatattttattgctctaactattctacctaattacttaacccctaaactctttcatgcttattttataatctgagctattttgtactgaaattttgatagaatacatatgcatttagaacttacgtctagtcctctcttttttttttgaaaattttgaactattagcgtagttcgaaagcactaaagactaatttaacatcaaaaatttaaaatttaaagttcaaacaaacatccatggaaaattttgaaaatattcttgaactttaataatgatgtcatatatggcttaaaaataacagttttaaatacagcttgtataaagaataaaaaaataaatgttatttaaacattaaagtgaacgatttttattagtttaggggtaaaatgagccaaaaaaaaatagttcacgggttaactgatccattgaattagttcggataagtaaaatggatttattttcattaggggaagtaaaatgaatttattttcattataatacaatggattatttattgtcacattgactatgggtaatagaatatcttgtatatttcatcaccgattaagatcaatttttaccagagttagattagaaattagcttaaacgtatc

SEQ ID NO: 7305 - DNA, 773 bp, Oryza sativa
ctgggattaaaacttgaacagtctatgctaggttttaggcttaagaaaaaaaattacaaaccttgctttgcgcaaaaagaacaaaagccatcctttgaattcctctgtcatgtgcaccattcttgtggtggcttgcaaagaacggttggtactcacccctgcaaatataaaattaatcagaaccaggagatgaagcctcgaaggatccctatgcctactaccaggagggagatgaagacgatggcgctcagtaggtcttagtacggtcgttgcctgtggcaatggcatgccgctgcctgaattccgctgccttatctatttctgcttttgggatgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattcctgttataaaaacgggggtccacagagctggtatcagagccatatgactgtaggaaaagaccaaaaggcgccccaccccttttctaagttggccaagggagaaattcccatttagtaatactttcaaaaataaaaacgctatatttacaaaactcggtacaattttcatcttactcttaactattttcttcacaaaacaagttttactctcaattgactttgggtttttcttaaaattagatggcagattcggattcacccgctacctgagagt

SEQ ID NO: 7306 - DNA, 1501 bp, Oryza sativa
acacatgttacttttacttatcgttatcgtagtatacttctacagcaacgcacggggtttcacctatagttggccataaggcccgacagcccggcccaggcacggcatggcctgatcgctgtcgggcccgtgccggcacggcccggttgttgggccatgcctgggcctatgccttggcacggtgggccggactggcacggcacaaactttagggaggtgaaataaacttattttaaaccacctataagacaaggcacaaagaatagggaggataaatagacgtattatttggcacggcccaaagtgtagggacattaaatagacttgttttagttatatatatgtcacaacctaaagaggagggaggggaaacaaacttatttcaaagaaagcacaatggactatccgtgccttcgggctggtccggcacggcccgacccttattgggccgtgcctggtccacaggtggagcacatgggccggcccggcaaatcttggcccgggcaagaccgggaccaactatagtttcacctagtatatatagtatatataaaaggtgactgtccaaacataccggaacgtgtctccgtcaccggcggaggcggcggtgggctcgatggcgccgttgagttgatctccgacagtgacccgatcttcagcttgggctccccgccgtagaacttgtacgtgtcgtacctgtaaccgcaacgggcgccgatgttgcgcacgccggagaccgagccgttgaaggtggtgttgccgacgaggtcctgcaggcactgccggcagtcgccgccggacatgtccggcgtgcactgcatcagcgagaacagcggcggcgtgacgacgtccatccgcaccgtggtgtaccacctcacggcggcggccccgccgcccgtggaattgtacggcacggcccactgcatcgtgtagctcaggagcgccctcacgagggtgacgaagtcggcgccgccgccgccacgccgggtggagcgatcgacgtcgtagagcctcacctgggccgggttggccggagaggagaggaagtcgtcgccggagaagtagaggaggcaggggtcgtagtagacggccacctccttgctgtaggggcacacgctctgcgcgtcgcggaaggcgcgggaggcgcagtcggcgcacgacgacgacgaggcgttggcgaagacggtgtcgcctctgcagagggtcagggcgaacaccctgtcgggctcggcgtcgccgccgccggcggcgtccttggcgaagagtgcgggggaggaagacgacgcggtcgacgggagggtcgcggcgagggcctgcaggttggcctggtatttgctcccggccgtgtagttgccgctgcttccgcagtagtgctgccatggtgggtcgccggatgcaattgcagccaacggaagcagcagcatcaccaagaccagcggtagaacggtcaaaatggccattgcacagtgactgacacactatattactctatagttggcca

SEQ ID NO: 7307 - DNA, 1501 bp, Oryza sativa
acttcgtcaccctcgtgagggcgctcctgagctacacgatgcagtgggccgtgccgtacaattccacgggcggcggggccgccgccgtgaggtggtacaccacggtgcggatggacgtcgtcacgccgccgctgttctcgctgatgcagtgcacgccggacatgtccggcggcgactgccggcagtgcctgcaggacctcgtcggcaacaccaccttcaacggctcggtctccggcgtgcgcaacatcggcgcccgttgcggttacaggtacgacacgtacaagttctacggcggggagcccaagctgaagatcgggtcactgtcggagatcaactcaacggcgccatcgagcccaccgccgcctccgccggtgacggagacacgttccggtatgtttggacagtcaccttttatatatactatatatactaggtgaaactatagttggtcccggtcttgcccgggccaagatttgccgggccggcccatgtgctccacctgtggaccaggcacggcccaataagggtcgggccgtgccggaccagcccgaaggcacggatagtccattgtgctttctttgaaataagtttgtttcccctccctcctctttaggttgtgacatatatataactaaaacaagtctatttaatgtccctacactttgggccgtgccaaataatacgtctatttatcctccctattctttgtgccttgtcttataggtggtttaaaataagtttatttcacctccctaaagtttgtgccgtgccagtccggcccaccgtgccaaggcataggcccaggcatggcccaacaaccgggccgtgccggcacgggcccgacagcgatcaggccatgccgtgcctgggccgggctgtcgggccttatggccaactataggtgaaaccccgtgcgttgctgtagaagtatactacgataacgataagtaaaagtaacatgtgttataggtgctagttttagataatctatagatgccggtttaaaaaaatcagacagccacgagccgagccgaaccaagccaacgccccaccacacgataaaaattacgccgctgcccgtatccactcccctcgctcacaaccaaatggggtattgaagttatttcatcatgtgtaatgagaatataaaataaaattatgagcaatgtataattatttttggagatgagatttccttgcagggagaaagaaggtgttgacagttgctttgcttgtgccactgatagcactttgccctgtcgtcatattctgttttgcatggataaggagattaagaaaccgtgagttatagaaatcaacttatcaaatctttaaattgtaatataattattgtttctgagttctgacagactactcttgtgttattagccttttaataacgtatttgttgctttagacaaatcaatgttgcgaaaaaaggatacaatggccagagaagaagtattaaagctttggagactagaagaaagcgattcagagt

SEQ ID NO: 7308 - DNA, 1501 bp, Oryza sativa
atgtcaccgacagctacagtaacccatatgtgctaatcacgaattaattaggcttaataaattcgtctcacggttttcaggtgagttatgaaattaattttttcattcgtgtccgaaaaccccttccgatatatggtcaaatgtccgatgtgacactcaaaaattttcttttcgtgaactaaacacaccctaactattttcgcttaaattgggtgtcatgcatccactgacacaaaagctttcaaaatcaactagctatgctactgctagattaacccagttacaaaaattttcatgatccaaaagtagatcatcgtctgcttccaaaatcagcacgatgccttctaagttctattgacctcttcaaatgaacttttaagataagatgacatcttcaacattaatagaaccctagggaaaaaaagataatatccaaattaattgcgtgtgatgtgcggcagtaggaggtaaagtatgcttcccatggtagaattggcgccaattcttacttccctctcagacttttccctccaaaacacatctgctcgagtcagagagtagttgaatagctggggggaaattaaacaacgaatctaaaccatcccttgtgtgctggatggttggatgatggatactgctaaagttacagtcacagtagtgactgcacctgatccgaatcccatataaatatacacaatagacataaaaaagataagaatacccttactgtccttcacagtctcgggatcaccgtcttgatgtgaaattgagagtgtgggaagaagagagggtaagggaaggcgagatggacctattgccgccagttggcaaatggcagcaaccgcaagttacatttgtattgtgagcacctgccacagaatctgaagtctgaactcgatctacgtagggagaaataaaataaacaaattaaagtcagttataaatagtaccaacaccttctctagatcacacaataaattaaacttctagactttgaatcactcagaaaggttacggcagtttttaatagaatcttgctatacgtatgaccgagccattcgactcactgagcttgtttcttgtcatctggacccaaacaagtagtatttatgcctatatatacactaaccggatataagttatagtatgagttggaccgacgcagatttagtgacattcccccgtgacattctcggtgacaggagtcccacacgttagtgactcaatgtcacgggaatgtcaccggagcaatgtcaccgaatcccaatccaagttggaagcatagcaatttcgtttttaatacgcccagtgaaatttgctgtctagagactcgtccaaaattttctactaataccattttttttcagcaacttgtccgtagaaccaaccattggccaaatggccatagatgagatcgcctaggcgcctacaaggaaacgacgggtcaggttggacgagagcgcagtgccgtgagtgagacgcccgccgcgcgagcggacga

SEQ ID NO: 7309 - DNA, 1501 bp, Oryza sativa
aacaatactatagttgggaaagtgtttttctttaaaatatcatcactcggagattgaatagctcgagttaagcttgtatgaactgtccatcatgctgattgctgagctccttgatgaacccgacgagccgctcgaactccgccgccgacgagccgccatcggcgacgtcctgcctcacctcgcgcgccagcgcctgcgccgacgccctgatctcgccggactccatcgcctccctcaccatcctctccacgacggcggcgtcgcacacgtccttcatgtccagccccgtcccccacacggcgccgacgaaccggctgttgatctgctggtcggcgaagaacggccagcacaccgtcggcacgccctcgccggcggcctccagcgtcgagttccacccggcgtgcgtcaggaagcaccccacggcgcggtggcgcagcacgtcccgctgcggcgcccaccccacgacgcgcgccttgttgttcttctccgccgccgcgacggcttcgcggagggcgccggcgctctgactcgccccgaccatgtccggccggagcacccagaggaatgggtagccggcggcgacgagcccgtggaggaactccgtgaactgctccagcgagatgacggcgaagctgcctaggctcacgtacacgactgatcggtccggctgcccgtcgagccacgccacgcagccgtcgtccgcgcgccacaggctgcccgcggccgccggcaccgggaacatggcgtggagagggccgatggcgaagacgtcgcgcatgcgcggcgcgacgtgcgcgagcgctggcccctccatggacgcggccgtgttgagcacgaccgcccgcgccccgcggctgtgcgcggtgacctcgatgagcatctgcacgatggggtcgttctggtcctcggtgcagttccggaagttgccaggaagatctcgccggcgcaggaagctctccatgcccggaacgccgcgcaccggctcgtcgaggtcgccgtcggccgggaacaggacgacctcaccgagctcgaacagcctgtcgactgacaagtaggccagtacgctgcacgcgctggccgtgcggaagaccagcgacgggacgccgatctcctcggcgacgtcggcggcgaacggcatgctgccgtcggcgacgacgcaggtcaccggagggaagccgccggaggaggcgccgtcgtcccctgcgcgtacgagcgaagcgagcaaggagcggtacgggacgctgccgttggtccgcagcgactcgaggagctccacgatgtcgccgacggcgcgcgggtggtcgtcggggaggccgtcggggatggacatgaaccggagccgcggcgagtcggcgccgccggcggccgcggcgccaccgaggcggcggaggctgtggtcggtgtggaggaaggtgacgtgaagaccggcgccgacgaggccggtggcgaagtgcatcatgcagttgatgtggccctgcccgggcgccgggaagacgagcac

SEQ ID NO: 7310 - DNA, 500 bp, Oryza sativa
ctctagaggatcccccactcatcgtagattttttcaatggatcaaatctcgaccaattcattattttcatacctggaagtttccaagatagcattggtaacatatttgcaaaatttaagcctcaactaaacattctgcaaggatgcttttaggtcgccagatactttgtgagaatatagctctgttactctatatcttcccttttctttttggttgatccaccatctagatgcgtggatgctgtaatctttactgctcctgcacattctctctaaataataataataatgggcaatgccactatgagcagactctgggtacatactagtaatggagaagcctatacctaccatattttggaaaatttggatgtgcttgctacaatgctacagtgcttattgatggcagaaatatgaagtttcattttgttataaaatgaccattgtttttttaatttaaatttcctgcaaaacaaagttcacctgatttccttttgcagc

SEQ ID NO: 7311 - DNA, 1012 bp, Oryza sativa
ctttcaagtcaacaaataggtcatgtgttgatatgtttgataaaaaaatctctacctttcgttttcttggaaaagatgtatactcttttgatagcttattgcgtgtgctctcaaggaagaagagcactacaggaagtcattccttgatattgatattaggtatgccactcatgggtggtatgcaggcatggcatcagctacatttctgcagtcaaaggtcagaacaggatgttattttgccaagaactacgtaaatataattgacagagtgtgatgttcctgtaaatttctggttggtggacaggtcgggtagacatggtattatttgttgcagtgttcaacattttggtttattcaaatgtaccctttaaaatgtacaatgcatcaattctgaatggatagtaatgcaaagagtctaccaatttgttgttcagaccttaggggatctagctttgctaatttcctccccccaattcaagtaaccactatgtagaacgaaaaaaagtctgaatattgtgcattataaaaggataccagagccggcatcgtaatcaaaaatggaagaattatacatgtttttgaattttgcacatgatacctataaaactcaaataaacaccatgcctgaatcccgattgctaataatcgaagtaaacagctgatataacataagttcactggcgcatgtatcaaattattcacacaaggacaatctgtgacaaaagttaggcataaacttatccctaaaaaaggtaaatacttagttttcccggtcccctcatttccactttgctttacaaagtctgtccaacctaggtttcctatgcttgtggatttaccagatatcttcagaactgcagcataaactgttgtctaagctcctaagtgtaaaaagcagacatgccagagcattcagtttgtttcacatatctgttcacattgccttcagacagatatgatcagatacgagaacacaatgatccgttgattcccatggtagactctaacaggc

SEQ ID NO: 7312 - DNA, 1501 bp, Oryza sativa
atgcatgaaagagagatgacacgaggttacttgcatgtacataacacacttttagcaaacttgaaaacgatttttcttctaaattactcatccaatctacgaaccattacaccattgtattcgttacaattaaatctttataacaagatctcacatgattatattaaataaaaaaacacatatgtttcaaccaattaaaattaatgtttcacatatgaaaattagatgtttcaattgaaattctattatgttgcacatatttatttattgtcgcgatgtatatatctttctttaatgtatctcatagtgctatttgtatgtttcagtaagtagtttattgtgtttcactggtttatttgtaaatgttgcacatatgttggtcgagtgtttcaataagtatccactagtgtactcacaatgttccactaaaaatgtttcgcctagtgtactcacaatgtttatgtatagatttaatgttgcagtgaattgaaaaaaatcttttgcaacaaatcacccacatattatgtaaatcatctattaagagaattcgtttcattttttgttccacaaaaaaattttcactttatatcgatcaaatgttgcagtgacttgaaacattctttcgctatttgctgaaacattgtttttatataaggcgaaacaacgtccgatttaaacaattgaaacattttcgatctacctagtgaaacaattccgatatacttggtggaacaatgtgcaacatttaaaaataattcaataataagctttttttcactggaatatatccatgtgtggttcctttttaaaaatttaactgcaacgaatttaatggcgaatttaatggtgtaatcggatcatgacttggataaataatttaagagaaaaagtagtttaaaatatttttcatgcatgcatgcttcgtgatgttggatgtctgatggcatgcgcgtggatcggacggctcatgaatgcaccgatttttcgtctcgtgccgtacgtccgacgcgtagcgctctccctgcaactaactcctccacctccacgagttatcaaattgtacggtttcgtatagttgatgggctaagtttcctgtactgggaataagggatgttagttaaacttgaagtaaagttgagaggccataagtggactttatattccatgcacgaggccaccagtgtcagcaacagatttgatgggctcggtgtctgcggattaactctccaaccaggccaaggcctagactgcggtccaaaacagctgctgtgatgggagatttgggctttgttcggcccaatgtacaagtgggtacgaggttcttccaagtgtctcctgatctttctcgacgcgcgacagcgcagcgaactccgcgccatctcgaaccttcgcttccgctcgctttatacccattcctctcctccaccgccgtctcgccattgctgcagtagcaagaaggagagcgagagagcaaagcccaagttggtagccatgacggagc

SEQ ID NO: 7313 - DNA, 1501 bp, Oryza sativa
acgccggcgagccgatgaccatgccgatggtgcagaacgcggtggcgaagaagcccatgaccagctgcatctccatcaccagcgcatacgtgacggcgcggccgccggcggcggcgtgcttgtaggcgagctcgacgagcggcagggtcggtccttgcagcatatactaaacatagttgacagcatgctgtgcatgcatgtgttgtgcagaaaacaaaaggagccaatcaaatagatgagctaaatagtgtaatagagccttgatttttgtttctagacgaagtcatctgcgccggtgaagacgccgagccccacgcccgccagcagcacgcgtcgcggcgtgaggaacagcggcgcgccgcggcggaggtaggacgccgacacgggcactagcagcagtgcgagctttggagatacaacgacggtgacgacgctggctgcgtcgtcgtcgggagtagcggcgtaggtggaggcggaggctgacgctgcggctgtggtgcccccccgccgctccttctccgcccggcctcgcgcttgtgcgtcgtcgggagcggcggcgaatgtggaggcagaggctgacgctgcggctgtggtgccccccgccgccccttctccgcccggcctcgcacgtgtgcgtcttcgggtgtgggcgtgtggccggacggcctcgacgcgccccgcctccgccccgccctgccggcctgcctacccagagaagactgagagagtaggaagggagagaagaggggaaaagagaggtgatgacgtgccaccctgacatatgggtttcatgtgggtcctacgtttattcatctgccacgtcaggtaaaacccaaagtgatccggttttgtaaattgagagcatatatccggttttacgttcgaggacgatttcgtaactcgatgccaagttgagggaccttcggtgtactttttccactcgagcaacaaacatatgggcttcgctaaaagcccaaacaggccggcaatatgttgcaccgtgggctcgcggcccaaccaggcagcctacgggccgagccatgcgtgggctcctgaagctggacgacaagaacctggccggctactgggtcgaaagtttctagagggaagtggaataagtccacttggctccctcgaatatagatatcttaataagtgaaatcaacaagctttctccaaggagaatgagccacatcattaaaattgcaaggaccgtcagattcaattggtaaaacgatatagaccgttgaatcataggagactcatcaatgatagtgaaatccataagatcagtcatgaagcttctagacgaaaggccctttggcagagaactcacgttcctagtcaaaatagcctactcaaataaaatatataatttttcataaacataatactatacaatacacaaatatagatggagagcaccagcagctcatctaagtgacccaaatgacagaacaccatccacccgtagcgccaattttgttactcccttcatctc

SEQ ID NO: 7314 - DNA, 585 bp, Oryza sativa
cgttgcttaatgagctcgatcaataggccgtgatctctctttttgtgaccatgtgctacctacacggcatttgcttagcttaatgtgctcatcttcgactgcattaattaataattaagcaatcggttttgatggtgatctacctatagcgacaacgacgacaacagagagagttgacgacgacaaaagagcacccataatagttatctataggctatctataagagatccatatcagcatattatctaacttggaagagattaaatgaagagagaacaaagctatctactaacctagagatagtctatagagaaaaacgagacaatgaattagagagctataaatacacatgtagacacattattgaggtggtttactattaatctagtctattactgagatatacatattttatagagagcatcttactttaccattgtagatgctctctaagggaggttcactgtaatttgatcgagtctagcttgcacgagtacgcgaaaacaaagtgatttaatacaccactgatgattcacatgcgatataaaacacacgaacgaagaacaggtagacgacaaagacga

SEQ ID NO: 7315 - DNA, 1501 bp, Oryza sativa
atggagcgtaacaccctactcctgtgtttgggattatggatgagttttacaaaagatttcttgactctagcaagcgcactcgcttcctccctcctggagtttaggtttttttctctacccccccttctcagtgggcagggtcctccttttatagctcaaggagataccacatgcaccgcctctacctaccctctatcggagagggatcccactctacttttcctgggctttaaaccgtgccttctcccggaagctaagcaacaaccggttctcgagtggaaccaggcgccgccccccgcctgactcgggggacagccctgtcattccctcataaatgaacgatgacctgtgatagcccttcctcgagtgacgctcggacgtgacgggtcatacccacccccactccgccgggtacaagggcgacgtgaggacatggttgccctatccgtcggatgtgacggtgccaggccggtcacaaaccggtcacatccgttagacagaggttagctaggcgcgccgcacgtctgcccttaccgcattaaatgcggtgagggacagttggtgcgtcgcacatttatggctgtttagcctgtgctctcgctctttccctccgccgcgtggaagccgggtgagggcctcggggcgaagccgcgggatagcccgagggggtgacgccatgccccgagccccccccccccccgcggcttccacgactcgcgtgacgcgcgaatgaggctaacttgcagagtcacgtggccggagggaaagtaattcccctctacttcacataccccctagtccatatctccgatagtagcccccggcgctatatcaggtatcgatttcctgagatcgttctgacatggtgcctcacgactcctcgagctggggttgtgggcccggtaggggatccaaaaggatatcgccgcgtggccaagttggcatgccaaccataacagcggtttgaccgccactgatcgcgctcatgatgaagatgcttgaggcgcgataatcccggggggtcagtcagaccacgcctcgattctcccgctcgctactcctgcggaggtagtggtgatggtttgctcagcctgcgctcatagccgttgtgcactccacctcgaatgcgccactgacagacgcactaaaggcaggaacagatagaacgggcgacgtgatgagtgggcgcaagatgcgaagagacaaatgcgggcgcgagaatcgtgggggcaagtatgggagcacgaaacgaggaggcaagtgcggatgaagcgaggataaaagggggcggaggcagagactctgcccctttcctttcgccaactgcccactcgtcctttcgcttctcgaaccctaacattctcgccacctcatactgtctcgcgctccacgctctccgccacttctccgccggttgccatggcccaagacaccggcgacgcagtgctcccttcctcccgcatcacagcagacatgcaccttagcctttcccgcaagatca

SEQ ID NO: 7316 - DNA, 315 bp, Oryza sativa
aaatcttttgtaaaactcatccataatcccaaacacaggagtagggtgttacgctccatagcggcccgaacctgtataatccgtttgcgtgcaagctcgtcggtgatcctagggacgagcgagtgatttccaagagatgagcctccgcccccggccgaactcacaaatgggggtctcacgattccccgctattgaggatctctcctcgacagctagcgcgccaggtaggggcggttgcgcattccgagagtaagtcgccttcttctgtcccaattttctccaggccttagccgaccatggtcgaggtcccggaaa

SEQ ID NO: 7317 - DNA, 1501 bp, Oryza sativa
ggcggcaaccattgcggcctcagtggagaactaatgttgatgttgccagcctactactatcaaagaatatgaaaacacatacgatagctatgcgctcatgcctaggggcggaccctggcccgtggcaccctaggccatgggctagggcttggtgtcaaaaccccatggaccacaacaaatttccaccatatatgagctagcttactgtgagagcactaaagggcaccgcgggccttagctgtgggctaggtccaccctttcccatgcccaaagaagaagtagccaattgagctatgatgtgcactgatgatgaattgtttcgttctccgaagcctcaattgatgtgcatctatcactgatttacatgaagcattgttaacccttatgggcatgttttggctttagattcagcaccatgtgccacctcccacttggtatgctccatgctcgtctgcctctagcagtctcatcatgccgccactcagaagtcgaaacgctccagttcggagttagataatcatgtcaaggaggttttggatgtctagataataaaaaaacatttgaggaagaaaatgaataacatccgtacaaaataaaggacggttaggattatcctaaatccacccagtggagttgatccccaactctaggggatccacacccgagcaagagagagtgtgcattaggcttaactaaaacatataaaacaagaggtttgtgctcatgttagaattcctataaaatagggggtgtggaaaagcaatccttacaaatcttccagtcccattccttggttccaaaggtcgaaatttttttccaatgattctaattttttccaatgtttctcctttgtcccaaaggagccctcacaaaaattcggccattttcgctttgtcaacagttcaacacccactggccacgggcacacaacccaagcccagaatagttggcgcgcgctgattgggcggcggatgaggcgcgtgtgagccacgccgcgccacccagcccctcagcctgcgcgccgcctccctccgccgctcgccgccgctctttaaaccccccctcccccttccctcgcgctcaccatccatggcgcccacggcgccctctccggcgtccgtgcgcgccgcggcgtcgccccgctgctgctcccgctcccgcccctggtccagcgccggccgagtcgccgccctcccggcggacggccgcggcgacggcgcctccaccgccgcctcctacaaggagctcggtgagtccccgcggctccctctttgggtcagccctctgctattgtgttaggttgtggaaattgtttctgagagcgtggcttatttcagtggcaatgttactaatatggccgtggacatacctgttcttgttatcttgtattgagtaagaactgtcctgaatgttcatagttcaagttcaatcaaatgcaaaatctgaatgcaacgaaaatacaagctactagtactttgattatgttgcttcatgcggataa

SEQ ID NO: 7318 - DNA, 1501 bp, Oryza sativa
tataggaagctttactttgtccaaatgtagggaaattttctgaagcacatcttgcaacaaggaattaagcaatcaccttatagcgaaggtctttgagatggtcgaccactctgatggcatcagccagagcagagagtgtctcgtgcgatttagctggattgtcccacaagttgcgccccctcaacacctcttcctgtctgattctccgcgcttcctccatctccagtgcactggatgcagtcgtttcgacccggacaacggcatcttcgatcctctttttcaaagagtacaaaccttggtacaatcaacaagtaactgtaataagtctgaaaattctgcggtttcaattttaatgacttctgctcaagttattctctagtgctgtcactatgtttggcctgaaaaattcccttctcttttaacactttagcatgatttccacaggatttatccgcatgaagcaacataatcaaagtactagtagcttgtattttcgttgcattcagattttgcatttgattgaacttgaactatgaacattcaggacagttcttactcaatacaagataacaagaacaggtatgtccacggccatattagtaacattgccactgaaataagccacgctctcagaaacaatttccacaacctaacacaatagcagagggctgacccaaagagggagccgcggggactcaccgagctccttgtaggaggcggcggtggaggcgccgtcgccgcggccgtccgccgggagggcggcgactcggccggcgctggaccaggggcgggagcgggagcagcagcggggcgacgccgcggcgcgcacggacgccggagagggcgccgtgggcgccatggatggtgagcgcgagggaagggggagggggggtttaaagagcggcggcgagcggcggagggaggcggcgcgcaggctgaggggctgggtggcgcggcgtggctcacacgcgcctcatccgccgcccaatcagcgcgcgccaactattctgggcttgggttgtgtgcccgtggccagtgggtgttgaactgttgacaaagcgaaaatggccgaatttttgtgagggctcctttgggacaaaggagaaacattggaaaaaattagaatcattggaaaaaaatttcgacctttggaaccaaggaatgggactggaagatttgtaaggattgcttttccacaccccctattttataggaattctaacatgagcacaaacctcttgttttatatgttttagttaagcctaatgcacactctctcttgctcgggtgtggatcccctagagttggggatcaactccactgggtggatttaggataatcctaaccgtcctttattttgtacggatgttattcattttcttcctcaaatgtttttttattatctagacatccaaaacctccttgacatgattatctaactccgaactggagcgtttcgacttctgagtggcggcatgatgagactgctagaggcagacga

SEQ ID NO: 7319 - DNA, 1501 bp, Oryza sativa
attggaattttctagttttcaatatataatgtacaattctatagtagtacttgttaacgtagaaatacaatgcaatattctgtacgtagtactagtacttgtcaaaattaaattaaacgatacatttgtcaaaaagcacaagcctacgaaggctggatatatatttatggacaataatccttaaattaactggctgatttatccaaaatcttaattaagccaacgaaagatcgatcatatcgacggacacgattacttttttacttcaccattaattaattaactaatgcgtgattaacaaatccatgggctccagacgtcatcgagggccagattaactaacctctatacgtacacctactcctcaaattcatatgctttttatactttatttcttaattaattcctcttcgtgttttttgttaagttaaatgacggaggcgcatatacatacgcatcgatcgtgtacgtcattgtttaatttaagccctgtcagcctatagctttgtcgtctctctctctctcgtgcactcaacacaaacttaaacagtacacatatagtctagtgcaaccggtactacctaatataacgacctgcatgtatatactccctccatcccaaaatgtttgacaccgttgacttttttaaaaatatttgaccattcgtcttatttaaaaaatttaagtaattattaattcttttcctatcatttgatttattgttaaatatacttttatgtatacatatagttttacacatttcacaaaaatttttgaataagataaacggtcaaacatattttaaaaagtcaacggcgtcaaacatttagagaaggagggagtatatggtatagtgtgtactagcctttctaatctcaaaatagttagcatatataaatacagatatttaaattagttatcatgcatatataataatcatcgatcgatcgcttgtgcactgctacatttgtagctgacctatatatgtctagcttttgtgatatatatatgccgtgtatataattaaatagtgtgtgttacatgcatatatacattgcgtgtcatatgatcatatcatcgtctctgcttgatcaatatatcgatatgatcgatggacaggccacgtacgtaagagctagcaagtagattagcaaggatatcagagctaggatatatattaaagctaacaagatatgtgtatgctacaaaagggagaaacttaattgtactcgatcaagctacaacttaatcattactaattaattaacaatgtggtgttgcatcatatcgttgcagcttgacacttggagctcatatatcctgaccaatggctgcttagagctaagctaattaagcacgtatagtacgattcactaagtaatagcacatgatacatatatacaagctaagccgaaagtaaggcggctaagacgcctctcgtgacagcaataatccatttaatttgtctatacacacgtaatgactgattcatgtgtgtgtg

SEQ ID NO: 7320 - DNA, 644 bp, Oryza sativa
taagccgatcgaataggtaaagctaaaccgaatagagctaggtgtgatcatgctctatgagtcatcatgataggccatcacgataacaagattgtaaaaatttggctgtcaaattttagatcccattatgtatttcgcaccagttcctttaattcctagctattgccttggtgtttatataaggaaaatagtttaatcaaatataattctaatttatatctagtttcacgtcaaatagtgcggaaaacctactagttaattaatttgctacgattgatcaataaaactcaaattgcaggaccaaaagtcaataaaaattaggattactagaaaaaaatgcccatgtgttgcaacgggtgaagtttattttaatcttattattgttatatggtttagttaaaatgaaattgggagttcgcttggatatatatatttttagaaaatcatgagctgcaattaggagtccgatcgtctcaagttagcatgtgaatttttttaaacggatttgtcggagatatggacccgggggtatgtgaagtagaggggaattactttccctccggccacgtgactctgcaagttagccccatttgcgcgtcacgcgagtcgtggaagccaccgggggggggggggggctcggggca

SEQ ID NO: 7321 - DNA, 282 bp, Oryza sativa
tgacggttatggtcgttttcaccggtagaaaccgttatcagctggacacttgccaagaggagaagggagatgctttttggatgcttaagcatctccacattcccaaggcacctctaggcctataaatacccctcctctctctcatttacaacacacatggagctgaattacatgagcctctattatatcttttgtacattataaaataggtagagagtgaggggaagctctggaggagtacccgaaagtttggcactctctccaacttctaccttttctagg

SEQ ID NO: 7322 - DNA, 1064 bp, Oryza sativa
  unsure (1)..(1064): unsure at all n locations
aggagtttagctgctttctanatacctggacannggatactttggggtatcattacgaaattgttactgacgcagcaacgttgtagggctagccgggcagcggcatttttttcccgattgcagtaaatgcaagtgacgagatcgaggcaaacatgagccggaactcttatcttttcgctatgcttatactccctccgtacttagagaggcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttcttcatttcacagcatcaatatggatgtgagaaatgttagaatgacttacatcattttacaaatatagcgtttgggggggccgctggattctggaagtaaccgaagaatgatcaagggaaaactcgtcaagttcttggcactggtcagagtgaaattgcgaaatactatccccctgataatgcgattactagatttcctgataattacccggacggggcaagccgtgtcagggaattcggtttgtgcttccaaggcacgaaacggggtgaagtgaacagagcggcacgtcggggcgacaagggcccccccgttcagtttcagtggcacaaaccgacgcgacgcgtgttcgcataacccaccgcattccgcggccgtgcaaaaagtgtgaacggtgaacctctcccctggccccggggccccaccccccaatcatcttctcctggccttcagcctccagctgatgccaactgccatgtc

SEQ ID NO: 7323 - DNA, 498 bp, Oryza sativa
  unsure (1)..(498): unsure at all n locations
ttttgggttcccccccaagagttttttttgtggggggagaataaaaaaaaacagccccttggtgggccctggggcttgaaaaatttttcggtaaccaatttggaaaccatccctctagagagaaaacccccccccccacnccggcagggttgttagagaaggaaagggcataccaacggcttcccgcgcgtgggattcttaatcatggccaccgttttccgttgaaaccgccatgagccacccattattgtattagtccccccttaggcccccggtcttactttttgctccggttgtaatttgtgtgatttgtacggtatccatttcccccagaaacagttatgcattattcgccaaccttttagggtgccttataaatacccaagttgcatgcctcagttgactctaagaatccccataaggttgtagtgacacccattactcagtaggtgaattgaaagggacaagtccagcnttacctacttcttttaccaaagg

SEQ ID NO: 7324 - DNA, 1501 bp, Oryza sativa
  unsure (1)..(1501): unsure at all n locations
gtagttaaacgatggtacatagtgtgttgatgtcatgtattgaacattatagtcagcgcgaacgatagtaggtagtctattttcggtaggttaacagaggcgtccgcgaaaattgagcgatttatgtaagatatatagcagaagaaacagccgcggnttagtaataattgttgatgaaaagaagcagacgagacggtattggaggctatggtgagagagctaactagcagcggcatattttgagatattgatagaagtgatagagggagctagcgaagtccatattattgaaagaggaaagcacggagggttagtgatatttttaataagggaggattgagacgtgggcattgagattggataagtgaaacagtggtagcgtttatctgtttttgacgcgaaaggtagttataatttgtttaagaaaagatgacaagggtcgatgtattgtttttcttggcatgcgaaagattaccaagtagtttgaagtaggtgagaagtggcgaatagagaatttggaggtatgcagacagcattctttatatgaaaatgggatcaagcgcgctctataataataagcattaacccccatcagatagggacttttattatgtcaaggagggaatttagcttcgagaggatggcacggacaccaaagcctgacaacaaagaccaaacccagggggcggcgataacggcaaggaaggggagagaaannaggcctccacatccatcctaccaccccatacttccactgccccaaccccttcccatcgcccatcatctctgctctcctttcaggttgtgaaaaccacctttcgccgcaaggcaagtgtctcctttttccagatccagatcttgattcacacccggaaagccatgtggccggccgcaccaggttgtgctagctcacctagccgtcggcctcctgacagcactgctggtgtgttggataagtctttgtggtccttggtcgtgatttttctttttgcttttgggtagtttcacctttttcaggacagcatctaccctttagcatatttttcagttgctaggacagctgcggttagtaggacagcagcagttagcatcttctttatgcctcctttatgctttattcagtttggatgccctctaggacagcaccccattcaaatttcgaattttagactaggagggtgcagcaataggctagcagccagctatggctatatatatatgtatccaacctctctcgggtaggtatggcttttgtgttttgtgaatgaagaaaaccagaaaattgccccatctcgagtgccatcctcttttcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttccctttcccccctccacgcagcagccccccggaggtgcgcca

SEQ ID NO: 7325 - DNA, 750 bp, Oryza sativa
  unsure (1)..(750): unsure at all n locations
cagagtggctttgcaccctgctctgnacccatatatatatatatatatatatatatatatatatatatatatatatatatatatatatatatatatatatagccattgctggctgctagcctattgctgcaccctcctagtctaaaattcgaaatttgaatggggtgctgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgtgggcaagttgggccatcccgatcctggagcagagctcgaggaacttgatcctcccaagaggcttggtgagcaagtccgcaagctggtccttggtattgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccggggagatcactaagcagtcgagcaagccagagcgcctgggtcgaagcggcggaggccgctatgtactcggccttgtagctggacagggccaccacttg

SEQ ID NO: 7326 - DNA, 970 bp, Oryza sativa
  unsure (1)..(970): unsure at all n locations
tgggccgtatataagtgtggtttgtgatataaannntgcctaaacgcggccgcgcttacccgggncgcgtattcctcctnnnnnaacnnccccccnccaaggggntttgatttgcatatcactggcacctacangcataaaccctttnacagaaagtccggcaccctaaataagtaactaaatttaaaaccaatcaatactcacagttaacaattctataaaaatatcccaactcactaacatcatcatatcaaactaatccatctcagtaccatcatcatatctatcatctacaaactccaaaaatcatcatcattgaagtaatcaaactaactcactaacaaataacaaataaaccaatgatactcatccaccacatgtacaacattcacaaataattgacttaaccaaccaattattcacccatcacagcagtagcatcatcaatacataaaccaaaataaataggatgaaacaaaaattctcaccagccttaggtcctcatcatgtgtgtagtagagtttgaccctcccgtcatcaccagcttggggtgggggatctggaattggcagctagggatttggcacttgggggtgggaatttgctgaaaccctatggtgctggcaagatcttgagccccttgtgctgctgcccgtgaattcactactagaggggagggggttgagtgcagaatgcacgaaactgtgaatgagcataggggaacatgaactggggatggacaaaggcaggttggctcgaagatttgccaagattggtgaccagatctgggtcattgaacatgttggggaagccagtgggaggattcggatccatgtcgacctgcaaacagattgttcttagaaccgcaaaggaaaaccaaatcaacaaacaaaaatgggggtggcgactagggtgtacagacctagggttcaggataaaaagaactaacctttttgggggttttctctga

SEQ ID NO: 7327 - DNA, 624 bp, Oryza sativa
atctacacgctctcagactaaaataatttcacaagcaagtatcttcagaagcaaactagaagtggatttcaggtcatctgacaactacattacagtggggaaattggagaaaggaccctataggaagagaggtagcagcccgtaccttgtcggccgtgtagaacccggcgggcccgctgccgacgacgcaaacgtggagcggctcgcgcgagggcgcggcagcggcggcggaggagaaggccctctgccgcgggaacagcagcagcagccttctcgccgcgtggtggagaggcctcacgcgccccatcgaaggcggcggttggagtcaggtgaggggctcgccgacacacacctcttctttgcggcggcggcggcggcggaggcgcttctaggagggagatggaggcggcggtgaacggccggaactgagcacgtctacgaggtggaggggggttgggggcggagctaagtgggctgagctagcaggagatggtgggctcggcccaacgtaaaagaaattgctcggactgggctgggtgcaaagagagtgggagactgatgaacttgggctttgtcacatacatgggccatgctcgtaacacacgcgcatcatgtgaccgtgat

SEQ ID NO: 7328 - DNA, 891 bp, Oryza sativa
attgaatacgccctcctccttgacaaccacctcggcaagcgcttgaccgccgaccgccggcgcgcggatgctcactcgtcgcctgcgcccgctcgtgtgccgctcctcccccgccgcctccgcttcgccggttgccgcgctctcgcctgcctgccgccaccgccactccactttgcttcaccgaccgccgcgctcgcacgccgcctccgtcggccgccgtggcggcgccgccctccgcctctcccgcttcgccccggccgccgcgttcgcacgctgcctccgtcctccggcttgtagagacagtgagagagagatgaggaagggagagaaaaggggaagggaggagaggaggctgacatgtggggcccacgtgggtcccacactgactcagctgccacgtgggataaaaccgggatcaaggtgaccggttttgtatagttaagggacctcgtatatctggttttgcggttcgaggacgttttttaatcacgctgacaagttgagggaccttcggtgtactttttccaatccacatttgcaacaatcacggtcacatgatgcgcgtgtgttacgagcatggcccatgtatgtgacaaagcccaagttcatcagtctcccactctctttgcacccagcccagtccgagcaatttcttttacgttgggccgagcccaccatctcctgctagctcagcccacttagctccgcccccaacccccctccacctcgtagacgtgctcagttccggccgttcaccgccgcctccatctccctcctagaagcgcctccgccgccgccgccgccgcaaagaagaggtgtgtgtcggcgagcccctcacctgactccaaccgccgccttcgatggggcgcgtgaggcctctccaccacgcgg

SEQ ID NO: 7329 - DNA, 210 bp, Oryza sativa
  unsure (1)..(210): unsure at all n locations
cgcgtgaagggtgagcnccctgtcacangcccgcacgtcgactctagaggatcccctggaatttatagtaggaaaaaaagaataacgaattaaaaaaggaaaacaattttagtttcctctttttctaattaccaattgaggtggcgaagatttcactcggaatttcaccaaagccgaccgattttcataagtttatcggtaaactctagg

SEQ ID NO: 7330 - DNA, 379 bp, Oryza sativa
  unsure (1)..(379): unsure at all n locations
gggggnnncctggnnggnnnnaannnggngcntatgncccctggccccttnnnnnnnaagggggngnnnnngggggggggnaccaaaagcttttcagttttgagaattcaccctggtacaacctcccccggagaatttgggtgagtgcgcccatttggactccgtaggttgtaagaatattattcctcccttttcccaaataaatcttctattttttaaaaaaccttctctgtccacttaatgagtcagccccccccaccacaggaggtgtgggggcgcacaaacaaaaaaaaaaaaaaataatatttttctcccccccacaaatcccctccgggagaaaaccgcgcgccacagtgtccccccctttttttttcccagt

SEQ ID NO: 7331 - DNA, 1501 bp, Oryza sativa
ctctaaactcatctttcaatattctttaatttttaatttcgaatttcatttacttctaaattgtattcctatattgactttaaactcttcttcccatgtttttcttaattttcaattttagttatttttaaattgtatttttatacggactctaaactctactttaaattttattatttttatttcaaattttagttagttttaaattttattatgtttattccaaattttagttagttttaaattcctatatgaactctatactctacttctaatatttcttattttttaattctgaatttctattttttttccttaattgtatttctatatgaactctatactctacttctaatattccttatttttaattccacatttctattgtttcctaattatatttctatatggactttatactctatttctaatattccttatttttaattccgaatttcagttatttcctaattgtatttctatatgaactctatactctacttataattttccttatttttaattccgaatttcagctatttgtaaattgtatttctatatggactctgctttttctttttgtcagattaatgtgagaatttctaggccatgagagcgaacgtggaggctcatttttctattcctttaataatataataatagattggtttttaaacatgagatcatttgttccattaaaaaaagatactatgcaagcattatttaattttctctaatatataatattttttaataaaacgagtagtcaaatgtcatatccaaaagttacaatagtaatgtgtttgcacaacattgagttaatatttttttaaactcgtgactatctttcaaaatacttactccatctgtttcaggttataaaatgttttaactttggttaaagtcaaactgtttcaagtttgaccaagtttatagaaaaaaataataatattttcgaccaagataaatttattattaaaatatatttaattattaattcaataaaactaatttgataatgtaaatattactatatttgtttataaatttagtcaaacttaaagcagtttgactttaactaacgtcaaaacatcttataacctcaaatggagggagcagctaaaaaggacacacaatgatatatatagatttatatatcttataaatactttcatggtctcataaaaccatcacattttttttccaaaatcgtataagatggtaaaatggcaaatataagttttgactggagggaatagtgcctttatacaaacaagtctactttttttttaaaaaaaaaactgaacaagactaaatttgatttacacggccgtgggaaaattgtaaaaagaattgttaattttcatttatttttccgttggttaactggataagagggcaggctggaagctgggcgcacagccagagtaccatcaccggagatcagagaaaggctcaaggcaaaaaatgagtcccgccaccgcagccacggccggatgcc

SEQ ID NO: 7332 - DNA, 1501 bp, Oryza sativa
aacaaaaaaaaagtgccttggagcccccataagagaaaatatgagggcaaggcccctaagaaaggcccctcaagcccctaaacaaaaaaaacgccaaaccagaaatttgttcggaggccttgggatcattggaaaataagtgggggccaccaattcaaataaacgcccctctaataagaaaaccctccgttcctttaatataaaaaaagggacccgctcccaataaatatgggttttaaccggggacccccttgggaggggaatacccaaaacaatttagtccccaagctatgggcaacagtaagggtcataaaggctttgtgtcatgacagaaacacaccaatgatttggtcgggttgaaaccgatgaaaaattgttggtttcctgcaaccacctcacgattaataaagtatctctaccttttttatgtgcacaaaatataattctatcagtactactgcaatttattctagttaactttatttaggaagcatgacccgtagtacacacaaataatattgaaatcccctcacagagcttgtccacaataaagacaaagggtaatgtcaagtgattgtgttccaagtacgttgtcaattactatctagcatgcatctatctgttcatatgtcaactatagtacagtggtgcgcacatatttgttgtatgtttttggcagctaggctaagttgttgggaaaaatatatactgatagaaaaaacatattcgtacatatagtaggttgttttgtaattaaataaccacacaccacgcataaaaccttttttttttccaacaagaattctcttttaggaaaaggctacattagacggtcatacacaaatttttagaccaaacttcaacctcacaaattttagctagtataagtttataaaatgtgcccacaacttcaacctcacaactattttcatgtagcacatacacttgaaatattttatctaaaattatggctttattccaaactatgttgcctgcacaggtgttgcgtcagtacattttgttaattggagggttacgttacttcttcatgtactgctcaatataatattattctgatccacattgacacatgcatttgagtctgcacactgcagaacagggagtacacttgctattattaattaatctaatcattgcaattttattgtactggtctcaatagactattcttccgatccatggattgacacatgcactgatctttgcacactgcaaaaagaacaacaaaactaccatatgcatgggttagctagattagtttagattaggttacgtaatggcagaacaaactttgcacacaataatcaagaataaaaagcttgtgcttatgattttattcagagcatcgtatctctgtgagatctttcgataaaagtattgacagaaactttatgcctgacgaaccaaatgagtatatatatgctggtcgataaaaaagctagctgtttgattccctttaattgctgtttaattttatagg

SEQ ID NO: 7333 - DNA, 1501 bp, Oryza sativa
cgccgggtcattgcttgttactcttggaggttgccgcctcctagacggcttgtggaggagttgcccggtgacctctccgagaagattgtggaggaggcccggcgccgatttgtgagtggtctggagtacaccaccttcggagtgaaggaagaactaccctagtgatcgaggcttgggtagtcctctccatgggccggctcccgccttgcccaccccttgacgaagggggcgtgcggtggcttcgaggttgagcactggagttgggatcgcctcaacggggagtaggaaaccggcaagttgccgaacctcggtgaaaaatctcttgtctccttgtctcatttacttgttgcatttacatttgtgcaatttacatttctagagatcatttcaccctaggattgctaaacattgacataggagtgtgatttactttcctagagatataatagagccactatcaccctaggattgcaaaacataacttagttacttagttagagttgaccctcaccaagcctagcaacttaggttagtttcgattaggtgtcatttagttttaaatcgcctattcacccccctctagtcaacatctcgatcctacaataattacgaccatgaaacatgggtagatgtctcgagcacgcagctcgtcaagaaactaaatgtctaatgatgtaattatcccattttgtgagctagtggtaattaagcaaggctaagcatacatataattctagcaagatcaacataagtatcacgagctagataaattatcacccaagggttgagaaaggacagataacaagtaaacatggcacaagcgagcagataggtaaaccctattcccatgtaattggcaaaacatgcatatttatttgcaaacggtaaaacatttataaattgggatcaacatgctcaaggggaatgtgtgacttgccttgcttcttcactttgatcttccgaacacttatcctagcgaccgcggacttccgaaatggcaaaagctacacgctggcacgcaaaacaaggaaaaacactaataaacaccaagaaaacagtacataaaaagtaaacaaacatgtagatctatattttagatgaattttgcaagttgaatggctcaattcggagttcgtatgaattagaaatgaagtttagatgttttgagccatttaaatgaatttatagaattattaatgatttattgcgcaattattatttattttctcaaaggacaagttaagcgctgacgtcagcaaagggccggcgtcgacaggcgggcccacacatcagcggctccaaggggaggacacacggtggaccaagcccaccgcggcctaggcggcaccgtggacccggaccacgggactggtccatgggaccgacggctcggatcggccaagagccgatccaacggccaagggcggcccggctagggcacggcacggctcaaagccggccggcgagtggccaccggtgacgtgggacgacgcgcggaggg

SEQ ID NO: 7334 - DNA, 1501 bp, Oryza sativa
gccctcgccttagccatcgccgcgttgctccgccctcacctcttgcctacagcgccgtgcagcacctcggtcaccgttgttcatcgccggaaacccaccggagctcggtatctctcggccaccggtgagccccaccattcctcaactctccggcgtggtattctcgccgctccggttgcctattttccttcctaaccactccatcttcttccccaggaaatcccggcctccatccgccgcgggccgtcgttgaagcaccgccatcgccaccaccccggggagcccgcggccgcctaatccttgccgctggccgcctcctcgtcttcgtctcgccgccccgttcgcacggtgagaaccgcctcctcctcctctcccttttgccgccctccgcgcgtcgtcccacgtcaccggtggccactcgccggccggctttgagccgtgccgtgccctagccgggccgcccttggccgttggatcggctcttggccgatccgagccgtcggtcccatggaccagtcccgtggtccgggtccacggtgccgcctaggccgcggtgggcttggtccaccgtgtgtcctccccttggagccgctgatgtgtgggcccgcctgtcgacgccggccctttgctgacgtcagcgcttaacttgtcctttgagaaaataaataataattgcgcaataaatcattaataattctataaattcatttaaatggctcaaaacatctaaacttcatttctaattcatacgaactccgaattgagccattcaacttgcaaaattcatctaaaatatagatctacatgtttgtttactttttatgtactgttttcttggtgtttattagtgtttttccttgttttgcgtgccagcgtgtagcttttgccatttcggaagtccgcggtcgctaggataagtgttcggaagatcaaagtgaagaagcaaggcaagtcacacattccccttgagcatgttgatcccaatttataaatgttttaccgtttgcaaataaatatgcatgttttgccaattacatgggaatagggtttacctatctgctcgcttgtgccatgtttacttgttatctgtcctttctcaacccttgggtgataatttatctagctcgtgatacttatgttgatcttgctagaattatatgtatgcttagccttgcttaattaccactagctcacaaaatgggataattacatcattagacatttagtttcttgacgagctgcgtgctcgagacatctacccatgtttcatggtcgtaattattgtaggatcgagatgttgactagaggggggtgaataggcgatttaaaactaaatgacacctaatcgaaactaacctaagttgctaggcttggtgagggtcaactctaactaagtaactaagttatgttttgcaatcctagggtgatagtggctctattatatctctaggaaagtaaatcacactcctatgtcaatgtttagcaatcctagggtgaaatg

SEQ ID NO: 7335 - DNA, 239 bp, Oryza sativa
tctactctctgttgaggagctcactaagagttgggtcttagctaaccctttcctcaagaggttgcactaagcactcctccttccactaagggtatctcttccctttcggaggtgagatctgaccatcacaaacttctcccggccaatcacaagtagatcgggggctcgggagcgacacctagccgcctaggagtcctcagcctccaagagtaacaaatgaagcaatgaactcctggaga

SEQ ID NO: 7336 - DNA, 1501 bp, Oryza sativa
tcctctgctcgtgccgcaggcgcgggcggactccctctttctctctcggtaggcaaccctaaccctcttgatttgcccccaattctggtcgttccgtggaattccaccccatccgatccgtcccaggcgcgcttggggccttggattaggccggaaacggatcggttgctgccgtagggttcctggacgttcgtagggattggattttggtttgttgctcatttcggtgtgggagagtggagtggaggccggagggttgagatcggtgtgctactacttgcgggggcagatctgatagggagaatcgggtggatagtggggattttgtaactttctcgtttgatatcaaggattgtggattggcgtttcctgcattcagagtttactcttcatactacgtggttgatggcgctaatcatgtttctaaattgttaaagagttggatgataacgtttaacttccttgttttactgttaaaatctgcatatgttatggcaccgacttaattatccttaattggactttttaccgttaaaatttgctagtatgttttatggtgtgatgatttacttctaggtttgttattggaagactggtgtaatcaatcttataccgattatttacccctcttgctctctgtgcttactcgttggtttattattataaaagacatataaatgtttggtcacccttggagtcatacatactacatagttttagtgatctagcaccttctgtggattcatccattttgttcaaactacttacacatatcattttctgtttcagattggaaggaatagctgcttactgttgaatattgacttgcttttgttgctgtcacaatgtcgggcctgctgaatgtgcgtgcttatccttacaactgattattgtgctttcgcttgatatccctattttccatttcaaactttttacttgatttctctctgactagtttgttcatcaaatagtttgcttatgctgcagcttcgcgtggataacgagcaatagatttgtcttttatcacctgataaagtgataattgtcctctgttataacatagtgttgatttatttatattttatacacacatttatttcttacaactgcggcactgtcctcttccattctttgccatccttacgtgagttttctgtgttgagatgcttcatatgaaatttgaagcctgacacttccatatgagaactgtgatggcagggaatattagcattgattgcctaaataagctatgcatgtacaggcactgcattatcagctactccctccgtcccataatataaggggcttttgtctatgcaaatgcgtagccacaatcccttatattatgggacagagctaatatatctgtggtggataatctgtttggttgggcactatttattcttttatgctgctgcttaacccaacatggtatttgcttttgaagataatggcaattccatatgacctgctttgttctttgttttgacaacttgccatt

SEQ ID NO: 7337 - DNA, 694 bp, Oryza sativa
ccattttatagtcggaccagattgtgaggtataacagcgaccacaaggaaagagcgagcaattccactaggagattttgattcagtggtgtttatcaagtactagttccttgactcctagacgaaatatttaggtttagataggtgtaggagccgattcaatgtgggtgcctaccctctccagacctatagagcaccctgcaccccctaaatatttcaccatggatgatagagtagggagtgtatgctaaaaatctatgaatggttggaggttgaaaaaatcgtgaaattagaccagtgaatgcaattggactaggcatacgctattggactttcaacctactcacttagaaaataggccacaggcctacaaccaggggcggagctagaaagaaatggagaggggtgccactcacttgctttactctacattagactgatataagtgcctaaatttggattgagggggtgcatatatggtgaaaatagatgaactataactaaaaaattttcttaaccagattcctaggcacccccacatctcctacctagctccgcccctgcctacaaatagccccccagcccaactacctaattccccaatacccatccccaaatccctggcagccaatgcatcgaggtagtgagctcctgaacccgttcagctacgcaagaggtgagtggcgccggcgagc

SEQ ID NO: 7338 - DNA, 1501 bp, Oryza sativa
ttcgtttccttttcaagctcgttcttctatctctctgcccttagctgtatttagatccaaacttttaacttttttcatcacatcaatctgtcatatacacataacttttcaatcatgtcgtaccaattttaaccaaaacgttcaactttagaagaactaaacacagcccttctcgtctcccgagtcccgacgtgtgattccgaatccggtgacgacgatgccgacgacgcctcctgccagagggagggggttccgttttttttttttacgtgtgggtgacagcacgcgcgacgtcaggatcgttcgcagccgagaccgccgacgtggaataaattaatgatttccggcacggccacgcgggcgaaaaaaaaatgagtgagccacacggccgcacgtcgtccactcgtacgaggggtttctcgcgcagcatgcggcttcagcttctgcatgggcctatcacaagctgaagctggatgttgatcgctgttcgcagatgctccgtgggaaatactagatcatctgcgattaatattactactctctattttactctaattttaaggcctatttgaatcaaaggatttatgtagaaatttcataggatttaaatcctatagaaaattttcctatttggctatttgattcaaaggattgaagctttccaaatcctataaaattcctatggaatggcatactgcatgtggattttggaagaaatttagcaagagctccaacctcttggaaaatttcctttgagtctatctctctcatctaattcctacgtatttcctgcgctccaatcaaacgatcattcctgtgtttttcctgtattttgcaatcctctgttttacacttcaattcctgtcagaatcctgtgtttttcctattcctccgttttttctaccctgcgattcaaaggggcccttagatggtggctcaatcctatagcaagagaattcatacgtcactgatccagttcagcaggtagaattagggcaaatactataataccccatatattgcctttaaaagtgtcacattggattgagtgatgaggtggagaagagaagcaggggcggagccatgtgtggggcagcttgggcttgggccccacacgtggcaaaaatttttaatggagaaacactgaaatttacgtagaatttgcacaaaaaatttatagctatatggttcagccctactcttgctaaaatgctgcctccgcccctgaaaagaagtgaggagagagatgatgagccacccctaaatcaagaggcaacctccacaaaaatttcaagaaaggtgtgagagtattagatatattggtatttgtgtactagaggtgatacattatatgggttgcctcttagttcatgagtgaataaaatagataaatttggaggtgatagtcacatctaccatagcacttgcccttacataggctgtgtttagattcaggggtgtaaagttttggcatgtcacatatgatatatggacacatatt

SEQ ID NO: 7339 - DNA, 1501 bp, Oryza sativa
  unsure (1)..(1501): unsure at all n locations
atattttatagacgaacataatgtttaaaaaaaataaatgtttcattgactgtttattttatttcactatatatagcataatgttttattgtgatcaactaaaatatttgaccgtcttatacttaaggtttgtttagcacatctccaactccacctttcatagagctcagccaaatagtttcagttccatttaaaatagaagcaaagctaagtagggctctctcatagagtgagtggaactgggtttagtcagctccacaactccactccagatccaattcctttatttaagggcctgtttggtatagctccaactcctaaatttaactcttggagttgggcctggagtggaattgtggagctgtctaaacctagctccacaactctagttcattttgtgagagagctccacccagcttaactcccaatttaggtggagctgaaactgtttggctgaactggggtggagctggagctgaagctgtgtcaacatgccctaattttatgagttagagctctacgtgctcttattatacagccttaaaagaaaatcgaaatcgtacacttgttctgtagcggatccgggctggatggacgcaaacccaccaccaccaggactgtaccggtgtagccgttaattaattaacacacgagacgagagtacgagacgagaccgccgcgaacctgcgtgccctgtgtgcgtgtgctgnnncgcccgtggccgtgcgtttataaaattacgcgctccgcctcgccttctttttccacacccacaccaaccccagccctaatcaccaccacccccccatcccaccatcgaaccgccaccaaaaaaagccgaagctcgctcgccgccgccgccgccgccggggacttcgccggagggaggagaagccaacccgcccgcccgcgcgcgcgtacgtacgaggtgaggcattccctcccgtccctctcgcgacgtgtcgggttgggttcggcctcttgtgggtggagggctcgagatcagggagctcgtcgtccccgggtgcccccctgtttcggccgggatgttccagatcttagcgttgctgggttggaaatttttgagtggttcggggatggtgatgtgcggtttgctgatttttttggtgctctccggcgtttgattgcaggcctgctccttccgtcggaagggaagcatcgggatggcgtcgatttcgccgacgtcttcatcggtcgccgccctccgcggccacccgtgagttctctgcttcctctctctctcgctgctacgccttgattgtgcttgcccgctgcctttggagctggttacacttccggattctttccggctcgattatgccttttgctaaggcctcacttttttcttttagtgttttggttgatttgacgactggtacactagtttcatgtcagaatctgtttgaagtgaattagtaacgagcgagctgttgagcgaactacataatacagttgaaatccggtcgtaagaacctttgag

SEQ ID NO: 7340 - DNA, 1501 bp, Oryza sativa
acatttgaatttgtttggttaatttcgttttgaaaaaaaactacaattaaaacttcaacgtcgaagttcacatgaacttaaaaaataagcacaacttagcactttactttagaagaacattaagagcctttctatctttttacttttataaggattaaaggaggccttaatcgttcgaaaaaaaagactaaaaaatccaaataaccgcctaaactttagatggaagtccatctagcaacctgaactttaaaaccggacattccacccctaaactttacaatacaatttataaactttacaatacaatttatataacccactaagatggttttgcataatggtttttatctaatttatatataattagatgagtttgatcacgtgttatacgctttagacatacatattaaaattttgatttaaatacttctttttgctctttatttactctcactcacaaataaatatcaacatgataatagtatgatatcaatgtgtaagaataaattaatgacttataactgatgatatgtaaatatgttatattagttattcaaaattgtttgtttaagcttccaaaatatgcaaaaccattctccaaaaccaccttagaggtaatatggatggtatgtcaaagttcagggggttgaatgtccggttttaaagttcaaggtactagacggacttcatctaaagtttagaggatatttgaactttttcctaatccatatgcagttgcatgtatatgtacaattccaccatttaacggccatccaagattatagaaaaaacctgctatacatgccactagtgaacattattgcccagcaagaaataaaatacatacatataggttccacactgccaaggtgcttgcttcatcacctatgtattggaaagtattagcaataattaatagtagtaactagtagcagtgcattttattcagaaagataaaagggacctatgcaactgtcaaaaaagaaattgaagcataggggtaggtcgcagctgcactcacgctcatcctgtcgagaatgggtgtgttattttcttttcacgaacgcgcaaaagatttgcacgtcaatatattagaaaaaaatagtgtttgtttacacaacgtaatcagccagaccagagaatgggtgcgttatagtacatcgccacttattagcccatgttatcacactaatccatgtggttaaacagttcgttaagcagcaagtcagattcagtcgattcggaaggtttgcctttcaaccgacaacctgggcagattaattgaaatattttaattattacttgtgagggggcattatattatatatatatatatatatatatatatatatatatatatatatatatatacctctagctttagttgctataatgcgattccattgatgaaagggtaaggtttctgagtcaaatccaatagattacaatgcgcagctttgattaattacactggtgtatgaatcgacaggagatccgtttg

SEQ ID NO: 7341 - DNA, 1501 bp, Oryza sativa
cctttaatccttataaaagtaaaaagatagaaaggctcttaatgttcttctaaagtaaagtgctaagttgtgcttattttttaagttcatgtgaacttcgacgttgaagttttaattgtagttttttttcaaaacgaaattaaccaaacaaattcaaatgttgtttatttcacacttgtttactgatagagttcaagttacccgatagaattcaagttttactatccacaagcattacatacacatggactcttttcaataggaatttagttatgttagggatttgctgatgtctgtctctttaagcactcgcaagtatgcatatgtgacgtgtgtacgtggtggtgtatatgcgtgtgcagcttccgtataatcagaaaaaagatataaatggagaatagtcgacattgttaagttcgtgggacttgacaagaccactgtagattagtcagacatgtaccaagacttgtagaaatactctctccgtacatacgtaggtttatgtcgatatttgaacattcgtattatttaaatttttttattgtgattaacatttttgttgttattagatgataaaacatgaataatactttatgcatgacttttttattttttcatgaatttttaaaataagacggacggttaaacattggacacgaaacctacgtctgcacttaaaatgaaacggatagagtaataaacacgacacatagatgtgacccagcagaatataacatggttagaattggtcaaccttagtaccattctacaatttaaaccacagagacgaatgtctggactaggcatgcaataagcataagctatgatttcgcttcaccgtatcaggtgaagaggcctcagctcaccgaccccacctgtcagtggccaaagctggagcccctcaagaatctatccatcaatcctgatttctttttcccactgagagaaaaacaaaaggagggaatattgtggggagagaagaaaggccaagaggagagggaaggggggggggggggcatgagataaatggccaataggaaaagttgagaacaaatccaaaccaaccaatcccaatatccacataccacctctccattggaccacagtttctctctccccacaaccaaaccaaaactaagaaacccctgctgctctctgcaagaactccatcaaattccccagccaaaaacactcagataattttttttattagaaaaaaagaaaggagattagccagccagtctgctgctccatctcagtgctcacgcactcactctgaggagtgaaatccaatccagcccactccggagttcctggaaaatcctcgcgaagtccaagaaaaaaaatattaccactgccatttcttggtttcttgatagcttctcctagctgctgccgcccaatcatccgagagagcgagcaagtaagaaagattgattgattgcttgattgggagtgtcctttgggcgagctgtggtgggatttagcggcatgtcagcgt

SEQ ID NO: 7342 - DNA, 1501 bp, Oryza sativa
ctcctcggcgaagcccgcgccctcggtaagcgaggcggaggcggcggcatccgtggcagcggcggtggcggcacggcaccagcgacgatggcgcggcgggggaggcgggggatccggctggcgtcggccgttcccgcacggatccggcggcggcgggcctctccgcatgggtccggggggcgggccgcctccccccgccacggatccagggcgggaaccgggtgccctcccctcctctcccctccccggcggcgacgggagcgcgcgggcggcggatccgacaggcggggggggtgacgacaggcgggcgtggctcctcccctccccagcggcgacgggagcgcacgggctgcggatccggcgggtgggcggccgatgactggtggtcgcggctcctcccctccccggcggtgacgggagcgcacgggcggcggatccggccggcgggcggttgacgacgggcggccacagctcctcccctcccctccctggcagcgacgagagcgtgcgggcggcggatccggcgggcgggctggtgacgacgggcggcccgcggccgtccccgcacggatccggctgctggccgccctccccccgtgacggatccgacgtgggaggccggcgggaggcgatgtcgccgccaccgccgacggcgacgaggcgggagcagcgacgccgccgccgacgacaacgaggtgggagccgcggcgatgacccgatctagggttttcttttttttttgaaattttattttttttggttttttgtttttccgtgcggacgtcataagcaaccgcacgcgaaaatctgtttttcgcatgcgggtgcgccacccgcacacgaaaatcatgattttcccagacgatttgttccagacgggccgaagctgtgcacgcaaaaatccgattgaccgcctgggaaaacgctttgtagccgacctatacaaaaagttaggttttgtcaaaacaaacaaattgtttagttagaatttcttgctgcaaacaccaacttaaacttgtcactatggcaagcttagggtttcgatagttttttgtatgtcccaaatttgttagtaatggtagccattgctggacgcaaagtatatatattataactgacttttgaagagcactcagagtgactaaatctctggcctgcaatgtgtggtccgttatttatatgttgtgtattttctttaatttgttctactgtactaccacaagacaggcctattgtaacagatatctgtaacacgttaagaactgtgtaacgatagatagcacagtacatgatatgtgctataccaggacacgtttgtaacacgtttagtcagagagctgcataacggtacttcaaggacacaaaaatatgcgctacaaagaatgtgttgcagatatgtagtaccaataagaaataataaagattagagaatatctttattaaaaccatcaacaatgcaagtgaaaaaattctcatggccaagatatatttactccatgtt

SEQ ID NO: 7343 - DNA, 1501 bp, Oryza sativa
atcctgtcagtgttttatttctcattcagagctctatagttccgatcgaggttaaatgtcactttcacacgtgacaatctaacattatatacaaattctcacatagtatatacgtgggcatatatatgtatgtgtgttattgatacgcagttgtgataagaattctattggtttgccacatagattgtgaatttcgcaatgtttaaatacacaaaatggatcacaatcatatattaagacaacgttggaaacacatactccctccggttccattttaaatgacgttttggacaatgacacggtctacgagatatatctttgaccttatttttctattataatatatataataaataaatacatgtttacttttattatagtgctttaaaagacaaatctatatattgttctatatattgttctagttcctttaaactaaatatttttaaagttattgatggtcaaagttataaaagtttgacctaaaccttgtctaaatcgtcaattaatatggaaccagagggagtatatatactccctcctttttttttatgttggttagcttaaaattaaaataaccagcgccaaacatttggaggaggacacagaatattcaagctctccaatacacataaatataaatatataatagctacaagagacatatatataatttatcaaaattacaatttaagctagtacacagctgcttttcatgtttagaaatctaatagtacttataaaacatcagaaacaaataaataatatatctatcagctgcatgctttgtaaaatctgacagttttagacttgcatcattattgccagtaaatctaacaaagcaagaattatttcagaaaccatgggtagcagatcgatacatgcttgtaactaatgaccaacgccatcgcttggtgctgaccacagcgctctactgcgcccagcgccgcccttcgccggcgttggaggcacctgaacatggatcaactcatctgaacatcgaggagtagtactcctgctgcttacatgctgggtatcatcgtttggcaccatcctagcatgtgaaggtgatggtggtgaggccacgaggaagatgaacaagatcgcaatcgcatgagaaaaccccatgttgatcaattgagatagctaggctagatatatcgacgaactaattaactcaagctatgtggatatggttgcttgtatggttttagtatgtttattgcgtgcctgcttgaacttgagcatatatttatagggagaaaaaggtcgctactatgcatgcatatctcagatgcgaaactataggagaattaatgaaggttaccggccgggacagtatgtttgagagtcaagttaattaggctggccgagtcaaccaacttgttgtcacaggtctgcatcacatttcccctaattgtaggcacaaggtgttgaaattagaaagagtcagtgtgcacaattgactactgttttttgtggattggattgagctatacct

SEQ ID NO: 7344 - DNA, 1501 bp, Oryza sativa
atatgcaattatgcatggctctcatcatattcaaaaatatactcctagccctaggagcatgagattgtccaatggtagtcctgttcttgtgtagatgctacatcatctcggtttccagagacggtgccctatgcaactatgctatatatatataatagtagtattgatgtatactgatcgatcatatatgcatgctaatttgctgtgttcaattcaaagtatgtagtcagtagctagacagctatttgttggcgacttggcgtcaatatggcgaacttgcggcgtgcttacagggctgatttgagaacctttgctgtactgacgatagatagaactgttttgttaggcatctctagttaagattcagaacacattatcgggcggtctgactgaccgacctgcctgcagtatacctacctgtaggtcagtaggtggaaacggtatatacgtcgcacgcgtgcgtgctttatctcgaaataaaacctgtgacaaaatcgcacgctggctgatcgagttgcttgaaacttgtaaacataggctgtgtttagatggtgaaaagttaggaagttgggaaaaagttgatagtttggagaaaaaattggtagtttttttgtgtgtatgaaagttttcgatgtgatgtaatgtgatggaaagttaggaatttgggggaactaaacacggccgtaggtggaatttgctccgtccaccctttctcagtcgttcgatcgggcgatcggctcagtacaagaggggaaggagaaagggtgatgatgtggtcaccctaatatgtgaggttcatgtgggtctcatactgagccgtcacgtcgaacaaaaccgcggttaaaatcacctaaggatgcagagtgatctggttttgtaaattgagagatatcatatatttttggtttttggttgagacatagacaattttataattcggtgataagatgagggatctcatatgtactttttcctattatatactccagtatgcaggccgtagctgcaacgtgaggtactatatgggccgtaacgggattgagacggacgttcagcccatactagatggaccgaaactgtgaaaacgggaagcgcttggcccttcttgctaaatgtccgaaacggtatttgcggcccagttccagatgtcctatgtgcaacgcaatatgagggccgtggcaatacgtaacgtgctcgacgtgcccgtatattgtgcccaaaatgtcgcaatccatcgtgcgacaaaatctagctggctttgatatgttagacatggacgcaaatcaaattatgcatatatagcttgcttggactttatcttgcttagttatatatgcatgccaaccataatcttttttttttgaaacaaatgccaaccattatcgaacatgaacgccactccttcagccctggcacgcactttcccagccaaaaactctcgtactccagctcgtataaatacgaacgtaacacaaacatcacgcctgatctgatcgatcaa

SEQ ID NO: 7345 - DNA, 1501 bp, Oryza sativa
tttccaaatctgaaaaatctatttttgataggcaaatttcaatccaacaatctatcatcttaataactttctcggatttaatgtatgactctccattcttccacacaagattggttgcatggacatcgagaaatgtaaatattaatgaatcgcttgtttacgaggaatgactagtagcatgtttaaatagatgataagtagaatcacttattattggtctatgtgtcaagatgaaatatgactatcaaaagtagatggagggagtacatcattaactctcagacacaacttatagaggcttatgccttatggtgcagttagctataaattagtaatctgctactcttctctttcttatttcttatactctcttctccatcttagcacaaatctgatgtgacaattcttacatcccacccatatatcatctcattcttagtcgggcacctccagttgtcaccagggctcaaattttcggaatgaaatttctaaagtttcggtcttttcggaaccctcctcccccgatatgatattatttcggcctaaattttaattttttttatatatatttttgtgaattttgcaatattttgtttaaatttgactaaaatttattcaaaactttcgttatatcggtaccctccgatagaaacatccaaaccgaaatattaaatcctagttatcacttgccaccacactggtgcctcgatcgctgccccgagatcccgccgagggaagaccatgctattgggcacctcgtcatcttgccgcttgcgatgctggtcaacgctgcaatgcctcatcatggccatgcaagcgcaccatagcatcagccgcgccgctgcaccgtcgctcctacccttaccagcatgtctcatccgttttttttacaaattggtccttttcaaaaacttattttaaaactagtcccagcaaaaaaacttcaaccaaaaataagccgtggactcagcgccatggacattggcgctaagttataacgtatcagcgccaacgtcgttggcgctaaattcagcatgaattcgctgaggtccatacgatttaaatagccacgcaagcaacatatagaaccaagactgtgatggtgtggtggttgtgacttgggctgtgatccatagagtgttaggttcaaatcctggtatccctcatctcctattttcttttgtatttttgggtttttccttttctcttcctcctagcattttttagaattaatgtattttacaaaataagttttgctctcttgactactcactcttgttctttacaaaatgactgttccgtttgtaaatttgttttattttgaatttgatttgaaatttcagtttaagttctcatttgccatataatatagcactttaattttttttcaaataaaaaaagttgcatattttcttttgtatttttgggttttttccttttctcttcctcctagcattttttagaattaatgtattttacaaaataagttttgctctcttga

SEQ ID NO: 7346 - DNA, 1501 bp, Oryza sativa
gagggtaagggtgctcgtcggagccacccagcacggggcgcgggttgccactgtctggctcgccgaggtcgttgtagacgtcgtagcggtagacacggtcatggtccttgtacgggcccggattgtcgtcgcctctcaggttccggagctcttcctccctatacggcaccagcggcgccggcatttggtttggcaggtatggctgtgcaagtacatgtatatgtcagttggaaattgcttaaagttctcgcgaattttttaggtaaaaaactttcaaatgtaataacactataatgtacattacattgtaactatagtataattacctaatatattgacgtgcaatccttttgtgcgttcgagaaaaaaactatagtgtaattacaccacatctatatctaactatattgttacctctacataacttgagtataaagttgcatatattttttaaacgcttatatataagtcccaattgaaccgattaactctctcaaccacaaaattactagaaagcccttttcaattttctataaaatttataattttgcccgtctatatactgctggtatagaaatatactccctccatcccataatataagagattttgagttattggttgaactgtttaaccactcgtcttattcaaaaaacttgtgcaaatataaaaaacgaaaagttgtgcttaaagtactttagataataaagtatgtcacaaaaaaataaataataattctaaatttttttaaataagacgagtgatcaaacagttcaaacgaaaactcaaaatcccttatattataggacggagggagtattgaattgtaaaagtatactgttacatagagttttgatcattaatttatattatattatttcatcatatataacgtttgtaaacaacttaacccacgatcatataaacaattaaagtgccaaatccgacgttgtcatttcaaaatcacaaaaatgggtataccagtgacgatgtacggacaattctcgatcaaaattcacaaagtacataaaacatgaccggtagaatatttcaagacgagcttacttggttactgaagaagacacgggggagatggtcgtatatctcgtcggggtaaacccacgactcagcggtgaagacgatggttccatagcccggtacaatgtcgagggtgatggtgttgacgaagaactcctcgtcgcaatagttcttgacgatgaccgctccggggacaccctgtttcttcatgtcccagatgaactcgaagctgaatgtggaggcctcgtagggagttgggtgtagctccgagttgatatggacgcatgcctcctggcccaacatccccctgttgccattgtctaaaatgtatgtaccattgctagcgcgttatactctcttcgtccatatatacaagggattgtaggtttaaaatagagttgaaaaatgagttgaaagaatgttgtttttttataaaagaaatgattatattgtagtgatgagc

SEQ ID NO: 7347 - DNA, 1501 bp, Oryza sativa
ctactctctctctaacttttagccttgaattagcccatggatccaaatataccaccctaggctaatgtttagcctaccaattcatgactaaacattagctcttaaaattagccttgggctaatcttccaaacatggcccttgtactttcgcttcttaattactatggcgtaactttccctgttctcaatatatgcggcgacaaagctcctataccggtttaagaaaaacaaacatcctgaatatcatgaatggcacatggatcgagcaaccatattttgatccatgacttgcagcttggagcaccggagatatattactggaggacagtaatgaacgtgaactgatggtcaactacagatttgagttgggtactcatccacaagtggatttgtcagtcaaaactcaaaagtcagtcgctttaatccgaagattttgggttgttcacatgtgatggggctgcttaattgtactccatgtagatattttgagtccagaaccacaagctgcaatgcagcaatgtgctaggcattttatttgtcgtactggatatatagtttatatagctagtgtccgaaccttcagcgtgtcgttaaattcagtgacttcataggccaacttggcagttggcactagaaactcacgtgtatatatacctactgtgtgcttaacaccacgcttctggaaatctggataaacatttaaatttctctgactttatattagcaacagttgttaaaatgcagcggaaatctattcaactctgatcttgtttttcttcccggaattttggcccgccaatttattttagttttcacattatggaattgtgaaccctggaagaagtggttgtgcatggccgccttcaattcatctttgttcgttttaaaccctttgggccagctataagctagtaggtattaaggtgttgatcgatgatggataaaattgagtttgtaaaaaaagagatggatataactgagtttatgataattattcgagagcaccaaatgaatgaattaaataatagagcatcaaaatgatgatttaaaaagaagtacatactataagaaatgctagtgattttttttaaaaaaatcatattaattaagtttaagcccacaataattcgtcgtccattagctcagcaattctccttctcgttcgttcttcctttcttcttaagacatctcatgcatgaccttctgttgattggtccatcatattttatggaatgtgccaatgtagtcgacgcatatgcgtctataaatagctggctcgtctattgatttgtgcagtcacccggcccacaggccacagctactagcagcagcagcaagactgcaagagggggggaagaagctaggtagctagtagtacgatgcagcagccgcaggcgagcagcatgacggcggcggcgaggaggcggcagctgcagggatcggtgctcgccgggaagatggtgctcgtgcgcaaggctctcgacaccaacttgaactccgg

SEQ ID NO: 7348 - DNA, 1501 bp, Oryza sativa
ttttagatggaatttcagcgagaatgcttctcatcgggcatctgggccgacgcaaaaatcggacggtagtaatggtgcctcttcacccgagacaacagaagtcctcacatgcatgcagggagctagtacacgtcagcacacgtcaagtgcatgcgtccatgcatattcaaatattcaaaatttaaatacatgtttctctacaattatttatccgacctacgatttaattataccattagattcgttataattaaatctttatataaaagatcttacatggttatatccgatcacaccgttgtattcgttgcaattaaatttttacaacaagaccacacatgattatatttcgataaaaaaatattttagcttttctattgatattttttttaatattgcatatgatctcttttgatgtttcaaccagtagttttacgatatttctgctagtgtgcttgcgatgtttcactatgtacggatcaaatgttgcagtggattttgatattatggaatgcacggttgcaacaaatcacccacatattttggaaaccccctattaagtgaatttggtttattttttgttccaccaaaaatgtttcacctagtgtactcataatatttccctatatataaatctaatgttgcggtgaactaaaatattccattacaacaaaaaaaacccacatattttagaaaccccctattaagggaattcgtttcatttttcgtttcaccaaaaaatatttcacctagtgtatttataatgttgttgcagtgaaatgaaacattctttcgctatttgctgaaacattatttttatataaggtgaaacaacaccagatttaacgagtgaaacattttcggtttatttagtgaaacaattccgatatacctggtggaacatcgtgcaacatttaaaaataattcaataataagctaaaaaaatttcatcggaatatatccatgtgtggttttgttttgaagatttaattgcaacgaatttaatggtgcaatcgaatcatgatttggataagtaatttaagagaaaaatcagtttaaagtagtttttgcacgtaaatcgggtgcgcccgattttccccgaaacatcggacgtcccagccggagttgccttcgaatttcagattgtttttttattcagagtccgattcttgtccttttgttcggccttatctttttcttagcccagctattctttcttccccttttcaaggccatcggaggcttgtttgcagcctagccggacctcttttttattttgggccgaatggaattcagcccaaaagaaataattagtcccaaaaatttgatagcacgattttcatttcaaaattgatccgggagcatataagtttagaccacaacttgatttttggtttgagatgcatttagatttgattggaggattagaatgaatatatgacgaatttgaatcgcatttgattaggatcgattgagattaccaaatgaactccaaatccaa

SEQ ID NO: 7349 - DNA, 1501 bp, Oryza sativa
tttttgtaatggtagagatttgccgaggtcaaaaggggtcagagttttaatttaggagcccctgcgatcattttctttttaccaaaaaatatgatttggaatgagggattcaaagtagagttattctaagtaataataggtgtaaaatggttttgataaagtaggccagatttggcttaggagtggcccattgacgctttaaatcacactagtgcaagtaataatatgtgtaaaaaggagatgaatgtgggaatgaagagctccttccttagccaagtaggcaaactgctgtttttgcttggttgttacatggaaaatacatattctatctgaaccgtggttttggagtagattgaaaagtgtttgatacatctaagcagattaaaatcgattttgcgtacgcaagtggatgacggacgaaaaaaaactttcgaaaaccttacgtatttttttattaggtatatatagatatagatatagatttcgttgtagttttttcgagatatgatacgttcttttaaggtaatggaaatgctatatatcctcggcctgatcgatacgagatttacagtgtggttcaccgctttactggtaatttaagatatttgcactagtcccgaattagatcataacgactgtttgcaattacctgtaagatgcagatatatgttggaactcgatctaacaaaggcagcttgtctgatgcaatttttcttttatcacatattgtttatgacaggacttggatcagtgcacccccaatttctttattttcgttcctccctaataccatgcacagaaacacactgcactaatgaagcgagtaatttatcagggaaatttaactatttgccacttcaaataccacttctatagttcttctctataaccactgtgattgtatcgatgctataggacttatttcatctgcattttttttcagttcttgcaatcttcttaaagacacagaagtgataatctctacctgttatttccgtcctgtagacaatgttgtgctgaagatatttctgttaacccagaacaccaatctctctaggaacatgaaggtaaacgccttttgcttcagtgtctactgtcactgtttgagtatagaacaaaatgattgacatttaaaaccaccataccatgttcatctgtgtcacaactttggtttgtttttttgggaatcaggtacttcaccattgaatcttgcaaacttacgtaccaagtcctttaatttatacaccatgaacaaaaattccagatcagataaattggacaaaaattccacggtggcgatggcacatttagctttgcccgtcgacttaccacatgatgtgagcacaagaatatattttcccaggccataagattcctcacactccatctcttggcaactcgatcgccccttcttgagcataagtaggagcagaaggggctcatagcacaagcaggagcagcgagaggtgccaagaaatggggagggaggaatatggtaaaa

SEQ ID NO: 7350 - DNA, 1501 bp, Oryza sativa
caacttctccctcaatttgattgtttgctgccaccttcctcggatacgcagagagtggaaacacgttttgcctctgacatcaccgcctcccggctacaggagcgccgtcgccttgctcaccctcccctctccctcctctctctgaaataagaaagaagaacggaaggaggaaggagcagagaacgagagataaaaaaaaaatactgacaggtgggtctctgtacagtgcacttttctattttctctatttaattgaaattccattatttagaagcactatatatacctgtaattaaaaaaatagaaaagtttgtagaaaagaaaagttttttaaggcttccgtaaaaaaatttcctctgttttttcgccgtttttcctttttttccatttttctttttcttttctccgttcgttttttcctttctttctattcgtttttttatctttctattattttttctttctttccgtccttttttcttccttttttttttcttcctttttctgtttgtcgtccatcaatcttttcgctgtttttttccgtcttttttcgcttctttttccgtccgcttttcttttttacttttttcgtcgccttttttccaggttttttcatccacttttttcttcaaccggatttgacgagacagacactagattgtcttccggaggttgaagacggtagtcaactatgcgagttggacatacagctccacttgtgagttaggtcaagaggcaagaggcaggcttgtgggttgggtcaagaggcaggccaaatagagcgaagtagcgggctcggctgagactgaatagtgaggaaggatcgaacttttggtccaaaatcaaagagtaaaatatacagcaatccaaaaatggttttacctgttgcaacacacggatatttttttcagtttatcactaagaatattatatactattcagataatttcctcagctaatcaaagaacagccatatgttcgcctgtgatcgatatgctctcctcgcttgtgcgtatatatatgtcgatcagagatgatttgtctcgaagatgactcggccagaacttaaacgggctacattagcttttactactttgatcagtttcagttggtcccatgccgcgaaaccaccacaatcttgtccaggatgatgcagcgattgtgtattcatgtgctgggcggacattactagaaaaagcagttttcccgacgtgtggatctttttttgcatgcggacataacccttggagctaaataaccgcctataaaaatataaattgaggtgaagttcactattttcgcagacggaccacttaaacggcgcatgcgaaaatgattttcgcaggcggacgtacctacccaaaaaataaacttaagtctaccattatcttctcctcccaccactcatttcctctcaactctctctctctccctcaacactcagtctcccctcaacactcagtctccctcaacactcaggcggacacggcggggacgagga

SEQ ID NO: 7351 - DNA, 1501 bp, Oryza sativa
ccatgacgctactgcgaaggattggaatttaagatatcacatatttatcattgtcttttgtctttttgtatgtgccaaagcaaatataaataaagtaaataaaaagaatattgttgggacataaaatctaaacataacctctcacgtgttattgtttttacaatgtggatttttcattgatatcatagattaaatattttctataaaattacagttagctgttatagtttatttactctccaaactgatcattttttcaatttttttcagctagcttgcagtgggcatgaattagtgcctaccatctttttgcttctttgtgttacataattaggcatttttatgttcgtggtaatttattatgtgtactacaatcatgggtgaggctaccgtgcgggtgatcgctgggagcgatcaacccgcccctcccccctatactcctctcccttctttcctttcatcacaaaattcaaaaaaaaaaacacaaagttagtaaaaaaattagaaaaaaaatctaatactctcattcatgtgcatagactttataccataaactttgcacgcataaactttatttatagaaatattatatatataaaaatatttgaatccgaatttgaatttgaatcgggtatataaacttttcacatataagcattcgctctacaaactttacgtgtataaacttactaaaagaggaaaaatatataatttttgaattcgaatttgaatttgaatcgggtatatatacttttgacttgtaaacattcgctttacaaactttaggtggataaactttagatgtgtaaactttatatgtataaacttactaaaagaggaaaagaaaaaaaaaagaaaaaaacgatcgctggcagcgattgatcgctccttaaccctcactatgtatagttaatgttatttttctagtctctcaatttctagcacctcgatgattaatctggtcgaaaggtatatctcttttgtttcttctcttacaaagccatatcaccttagtttttgcttttgatgttgaatctatatttgatctaaattttcaaagcacatcatcttaattgtgtttatagtttttttggatgattaactaaagatgcaaactatacaaagtacatagtaacatagaagattatgctgtttagcaacgaaataaatttattttgtactatgtttctatcattatcatacaatatacttctgcagtaacgtttccttatacagggttttatctaattaggttagttgtgacctaactctctcgattatatctcgtactatgttaagccatagttcctctatgcatgatacgatcaaatttccttgttctgttcgtttaggtcatgtgaaactttgtttatgcttattccttgatgtttcaaatcttaattttgtctacaatgaaattaggccggaagtttttatctgatgtacaacgcctcgcttttctttagtgagccgagtcaaaatctctctctctctctctagc

SEQ ID NO: 7352 - DNA, 761 bp, Oryza sativa
ccactgggagctcactccgccgtcgccgtcgtcggtggcttcctcctcctcctttgcctcctccgccacggtgagctcggcatcgccgttggtggtagccatgctcgtgctcgtcgaggcgccaagtcgagaagcgcgtggagaacacgaggcctacacatctcaggtgatttctgcggctatttttatatatggagtacaaacaaagatgaagcttaacaagttggataccttttgtcattgtttcttactccctctcttctaaattaaacaaatctaatatgtggtgtaatatgtgaggtaacatttgatatatgatatatccagcgaagtgaccgtaactcaacaagttagattcttattggtggaactagcatttatggctaattattctttcaatgttagaacaatgaggtgtccgtggtgactttgttaacctcaatatacgttggtccagtctttcggaggtgctcatagaagtagggtgtgcgtgtgtttatagggatgagagtgcacgtgttgtgagcgtctgcatttgtactgtgttactataaaaaaaatatgttctatccagatttgtagatttgtaatactaagatatatgttatgttctatattaggtttgtttattttgtagcgcgaagtcatcagaagggtgtgatttgtcaatgatgctccctaggaagctgagaagagggcacaggctgctagtgcttgcaaccaggttggtaagaacatctctattattatgtttaaaaaga

SEQ ID NO: 7353 - DNA, 1295 bp, Oryza sativa
cctgttgcaacgtggggtagcgttggacagtgtttggttaacattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgggttcatgaaaaatgttctatgcataaaaatcatcatgttcggttatttatttgagtcatttgttgctttgtttaagttggatttgagcatgaattgattcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagaaagattagtttctgagccctctgtttttcttccttttctcatatttctacctatccccttcaga

SEQ ID NO: 7354 - DNA, 1501 bp, Oryza sativa
cgcatggaggagaaaaacagtgctccagcagagcctccattgcacacgctatttttggaggtcctccaaaccgagccattcccaagccaaatatggcgggtctctctcctcacgcaatcctaaactgctcacctcccaatcaaactcgcgtcaccatttggacaagaaccggcgggagagtagaggtaaagaggaagtgcataccggagtagaggcggagaggtggtggatctggagggggagagcaccggagtgtccacccgcgccgccgctcctctgaccgcgtcgccccgctgctcctccgaccgcgcctcctctccgcccggccgctcctcggaccgacgccgcccggccgcccccaccgctcgaaggaccaacgccgcctggccgtccccaccgcttctcaactcctccacgccgcgaccgcccgcgaccctgtcgacggtgccgcggctcctctgcaccgcgaccccaccgccgatgccgtggctcctccgctcagcgaccgaccgcccgcgccgctccccgcccatgaccccgccaccggtgccgtggctcctccccccgcgaccccgccgccgatgccgcggctcctccgccccgaccgcccgtgccgcgcctcctccgctcggtgagcaccgcgccaccggtcctcctccgcccggcgactccccgctgttcctccgcccaacgagctcccgtcgcccaacctcttcctcccccatcgaagtagcagtagaatagaatagaagagaggatgagaggaaatgtaaatgtatggtagttgaaatatacattaaaatatatatgaaggatgtaatatggatgatctgttggagcgaagaaaaatatggagtgagaatctttttagatgaccatctaaatgtgaatatagagaatgaaatttatatgagctaccggggatgctcttactaccgtctaccaatggtacctcagtagttttacaaatatacccctcttgatggaattacacaaaatgatcccttttacgatcgttaattcgctatggcaccgatccggagctttgcggaaaggtccctatcatttctacaaattatcctactatagatggcgctttttgtacgtttagccctcgcttcccttcatcccgccgccgccggtcgccgggcggcggcggcggcgaggtttcctccactggtcgccccagaattttaatagagtgctggatcaagaagaaaccggcgtaaaaaaaaaatcagtggagaacgtagagagagatggatggccggagaggaagaaggtggtttgacggaggcgagcacggtggctgcatttctcggcgttccctgggattctcatcggaggccgccggattcagtgttcgctccggtcaatcgccgccgcgcccccaggtgagtcgacacctctggagctttggatctcgctctgttcatcttctttggctggatcaggatttaaacgcattattccattattccttcgttcttgataaggtggc

SEQ ID NO: 7355 - DNA, 1501 bp, Oryza sativa
acacttattagatacagacatagaggacagacacatataccagtttgacctgaactatctgaatagcttgcagtagtggtgagaattggtgaataggttatctgagagagagagagagagagagagagagagagaaagaattggtgaaaggcacatccagccttttgcagtatgaggtccgtcaattgtcaaagctgtaattccttcatttacgaaaaggtaaattagatatgatttaacagctatgttccttactttcctgtgaaatagacatgaatttacatgcattcaggtgtaaaatagtttgtgctcaaccttccaagaggaagatatttttcaatgtgcttacaaacagtaccatttgtagtgaggttcaaagtgcttacaccttgagtaaattccttaactttgtaacagagtaaatggtaataactccttaagttgttcaagccaccttatcaagaacgaaggaataatggaataatgcgtttaaatcctgatccagccaaagaagatgaacagagcgagatccaaagctccagaggtgtcgactcacctgggggcgcggcggcgattgaccggagcgaacactgaatccggcggcctccgatgagaatcccagggaacgccgagaaatgcagccaccgtgctcgcctccgtcaaaccaccttcttcctctccggccatccatctctctctacgttctccactgattttttttttacgccggtttcttcttgatccagcactctattaaaattctggggcgaccagtggaggaaacctcgccgccgccgccgcccggcgaccggcggcggcgggatgaagggaagcgagggctaaacgtacaaaaagcgccatctatagtaggataatttgtagaaatgatagggacctttccgcaaagctccggatcggtgccatagcgaattaacgatcgtaaaagggatcattttgtgtaattccatcaagaggggtatatttgtaaaactactgaggtaccattggtagacggtagtaagagcatccccggtagctcatataaatttcattctctatattcacatttagatggtcatctaaaaagattctcactccatatttttcttcgctccaacagatcatccatattacatccttcatatatattttaatgtatatttcaactaccatacatttacatttcctctcatcctctcttctattctattctactgctacttcgatgggggaggaagaggttgggcgacgggagctcgttgggcggaggaacagcggggagtcgccgggcggaggaggaccggtggcgcggtgctcaccgagcggaggaggcgcggcacgggcggtcggggcggaggagccgcggcatcggcggcggggtcgcggggggaggagccacggcaccggtggcggggtcatgggcggggagcggcgcgggcggtcggtcgctgagcggaggagccacggcatcggcggtggggtcgcggtgcagaggagccgc

SEQ ID NO: 7356 - DNA, 1501 bp, Oryza sativa
attttcatgccagccctggctgatgcgacaggctctatgtgctgggccagggggccctcttctactactaggccaacgcgtcaaaagcttcgttgagcatatggcccttgcgtctgcataagtggagtagagtatatgtcctagtgtcccaacatgagcgaacaaatccagccggacttcgtctccgatgcagcatctgtctcaaacatgtcgcctgcatctaacctgttggtgtcctgccttttaggtacaagctgttggcgaaaacagcaaatgaatggacaaaagccaagctaaacaaaggtgttcaatgaaccaagttaaacagcttagccatgaaaaccgcaggaagctcggtggttttcgctatgggcatcatccgacaggtctcttcttctgctctgctgctgttgcctgcaaggccaaacgacactgatacagtgatgctgtaatactacagctgacaagagttcctgcaatcctgcagatgatacactgaatttaacaggtattccacttgtttctgcagaatgctgtaagtgcaggtcatgccagctcgaaaagtgttacggagaagtattactatcctgtaatctagagcacgtgaaaaccgtgaccaaactgtccccgaaattgaatggaacagggcactcgagcagggtaaaattcgtgatcacatccaagacgagcattactgaagagctcgtgcaacacgttgtgaagcaagtgtagtataaagatgggccgtgtaatttgttgggccgaggagatagacaagacgagcattcctgaaaggaataagttcactttaggtccctcaatttgtcgctgaatttgaaattcgtcccgtaatactagctgccacgtcagccaaaactgagaggaatattgcattgggaccaaatgtgacccgatttttaagctgagagacaagttatatctagtagtattgtggtttagggatgaatttcaaattgagcgataaaacgagaacttagggcttgttcactttgatgccattttcaaccttatcaaattttggtaaagttgccaaaaaagtggctatatttagtttgctgccaaattttggtaactatataagaaatcctgctaaaattttggcaagttgccaaaatttcggcaactatgccttaccaaaatttggtaagatttattttggcatcaaagtgaacaggcccttgttccttacggaagaactcgtgcaacacgtcgtgaagcaagtgtagatgggccgtgtaattggttgggccgaggagaaagatgggcctgcgaagaggcaatgtggaccatacggtggttggtgggtgaacctcgtgtggtgggtggttcagggggctcgttttcagtcacggtcgcggatccggcccgacccggcccatattccgtctccccatatcccccactgctttgcgggaggacgaagcgatccccaatcggccaatcgcgagagggtgaagaccccttcgttgctcacctcgtc

SEQ ID NO: 7357 - DNA, 1501 bp, Oryza sativa
tctggctcgcactcttgagtgcccatgttctctccccatacttgatgattcctgaaataaaagcaaagatggctgagactacaaactgattgcctgctgctgatttccaaaacacatacaaggccaagcaaacttggactagaagattgagcagatgcctgagccacagttcattgtcctcgacagagaacgcagtgattgtgtcctgcccaccaagatgaatgagaaggaaaggcgtccagaagaatgcaaacttgtgaggttgcccagcttcacttgcatctgttttttgccgtgatagttgcccaagggcatagactgcaatgaaatcagccaccaaatatgctaaccaaaccagaatcctcaatgacgagttggtgctgcgctgtcgaagaccaccggaaaagaagacgaacacttgcaacatgaagcttaaaagcaccagcacctgtaactcccaatcattccatagttggatcaacgctgccatctttacatgcgtttcaagtttcgacaatgctcaattcagtttctgcagtcctgtatgaaaccagtgtttactcaagataatcaatccaagagatattatgcaagaagatcatttgtttcatccaacactgctagcctgtaacaagcatttgtgtgttcaaagccagtttgtttcttcattagaaatatgctactagtgttgttcatattaaaataatatctcagaaacattagaaatctggacattctgaaagtacttcaaatgatgcagaaagagtagacaaaaagaacctacaatatagcataagtgcataacttgaagttaatttgtccaattggaagcatttgtatatcagcatatggaaaactgatagtttgcagctactcatatcggtgctgttcaatttgatatgcctcatgtcctattttgtaacaccacgaaatttccagtttggtaaaaatgccctttgtttattgtgtagttattgctggacagcaacattatttatttctacactttcttaattcttgtgagtacttctctaagatgatctacagttggaatcagaggtagcgacagttatttatccctaattgcaaatatatgcttctacattattttgggaaccattttcatcctatgagttactcaaattggtcagccaaacatgacattctagtcgtccatggaggtatcaattttgagaaacaactccggggttgatgccttgataggaatggagcgacaatactgaactatataactactatgtgtattaatcctcattgatatagctgtttaatcttttccattttgcatgcagtatttcgaatttgggggattcaaacaataatagctacttttagaatttagtatgtataatgtttatttgagatctgctgcaactgaaaaaaaaagaggcattgttctagttgctacaaataactcagcacaatcagttcaaataaatccgaacactttctgaaagagtattattggtgggattctccc

SEQ ID NO: 7358 - DNA, 1501 bp, Oryza sativa
tgcgtgctagaccacatcttagatcgaaaagatcagtcggcgaatacgtcgaagtttcgttcgtttcctgctgctgttgatcgatgcagcattaaacaatgagcaaaaacagtggcaaattgggctggatttcatactcatactatattcatcgttttgagaaaataaaacatgtacaaattagtattacctccgttctaaaatataacaatctatgactgaaaggatcataccctagtactacacgatcttaagttactgtattttagaatggagagaatactataattgtagagatttgctgcaaacagtgcctactatctctctcttaaaaaagtactattgttgaaaacattactactctctccgttttacaatgtaagattttctagcattgtatacattcatatagatgctaataaatctagacactattatatatatatatatatatatatatatatatatattcattagcatttatatgaatgtggacaatgttagaaagtcttacattgtgaaacggaggaagtacggtataacaaaaagagaacatttgtgaatgggactgtctagacatctgtcgtgtaatttttaagaaaaaatcacccaaattttttctcccctcatatctgcatccaacggtaaaaaaaaaagtacagatagcctgtgattgtgcttgttagtacagtagtattcagtaaagattaacacaaatgttacatttataactaaaattacagtgttttataactaaaaatacatttgtaaaaacagtagatatgacatgtaagtacactgtaattttagtacaagtgcactgtaaattttgttaactagaatatttgtcgttttagtataaatacattgcttgagaaaccgtgcagatatttgaagtgttaaatgttgcatttataactaaattacagtgctttataactaaaattacatttgtaaaagtagtagatatgacatgtaagtgcactgtattttcagtacaagtgtattgtaattttagtacaaagtgcattgtaaattttggtaactagaaaaagaaagaaagaaatagagcgaagaaataaatggctactgatatgcgtgatgtacagaaatccatcaatacaaagtcaggttgactcggtcatggactcaactgaccctgcttttgcgcaaatcttggaaaacatcgtgcggctagaaaaacgtcaaatcctatgaaaaaaatcactcgacaaatatttagcaaaatcgtttgtgaattggactggatcaatctctgatgggcctttagcccattactaccaaacccaagagtccaatacacctcaagcccaatatctcgtagcggcccacgcaataattcaatgaccgcgaaagccaaccacccagtacgccccagtgcatcccagccgctcgatgcgaatccaccatccaatcaccaccgtccattccaccaaaaaaaaggtctccgcgattcggaaccgtcgatgtgggccccaca

SEQ ID NO: 7359 - DNA, 1501 bp, Oryza sativa
tacaaacagaattactgatttgatgttcatactcattctaaaatctgctttctaacttcgctcacaccgtttgtccatctgacatggattttcctaggtaaacatatgtttcatgctctctaataattgacattatttgccatacgttatttagcagtttctagtacacctactgaacaactaaaaggccagcatttgaacatgtaaaactatgtacattttcagaatacaaagattacaaccgtcagttgagctataagaagcaattcaatgcagaagtgtagcagacactccagtttcaattgagcaaatattaatcaacataatctgaacacaataaacagaacaattctaataattgacaaaagatagaaatgcttgatgaattagcacaagctttaagaagctaaggcgaaggcattacaaattggatgatactacccgagatgtgtcatgccgaaatggaccacggactcaccttcttgagccataccctctcgcggaccgccaatccgtagatgtcagatacagtaggcccccaattctgagcgccagcaacgccgccctgatgtacgcggcgtcgccgccgaacgagtccacgtcgatgacgtcgaagtactcgcggcggaggtagcgctccgagagcagccgggtggcgtcgaggtgcgacaccgcccacctcctgtccggcgcccgctcgaagcgggagaggttgccgacgatgacggggcggagcgcctcggaggcgtcgttggcccagacgaagtcggcgccgacctgcgccaggtagcggagcgcgcggacgccgcagccgcacatggcgtcgaggcagaggaacggggcggaggggccggcggcgcggcggtggagggtgcccgcgaggaccgcgaggtcgcggcccgcggcgctgtcgctgcggtagaatgcggagcccgggtcgaaggtgaccccgcgctcggagtgcgcgcaggcgggtggctccgcgctgcgccggcggtggcggtggcggccaggttggagtgaaaaggggagcgctctggggaacgagagcgccgctgccgctgccgcggcggcggagatggccatggcgacgggaagagaacagcagaatggtttggattggggtacagggcgtacagccgttcgggttcacttcagcgaggccgacatttcgtgtgaattgttttttcctgagttacgggtgtaatttttgtagcattgcacgtccttaaagaggaagtcattaataagataagtccttaaaaatgagagagtatatatacgagggatctgtttgacaggattttaaggacttgtttaacttctaaatttagttttaagtgttgagtctcgagtgaagttgtgaaagcgctctacccaactccgttcctattttaaattgagctaaaactgtttagctgagctttaactccaagagaagaggagctgaaactggagcctgagcctggagctgtacctaacagtccataacttctaaatt

SEQ ID NO: 7360 - DNA, 1501 bp, Oryza sativa
ggaatggaaacctctcttgctgtggctttgcgatgtgtttgatggagcctcttgagaatgaaactcttcttttgtcatcacaaaaaagttctgatgatgcttattcctctttactggttgatgcctgaagctatgatgaagcaccggcgttgtctagttttgaatctccagatagcattgatgaggctctcagctgtttgatctatctgtcggcaggctagtgtcctgaagatagcaagatatcagcactgaacattgtgctctgtagcagtctgtagtgttagactggcaatgcagaagcgagacatagtatagttttgtcctggaatggccggttgattagttgaattacatgtaattaagcgtatgtaaaacatgatttattatctgagattgctgttgattggttggattcaatgtaactgacactattgtaagcttatattatctgtaccgactgctcataaacactgttacactgaaatcttatattcctgttcaacgaaatatattccctatttaattcattgctttgtcaaacttcttgagtcgtacatattcaatgaaaattttcctttcgttcaatgaagtgctaactctatatgattggaaagtcacaaatatcctaaaactaatcccaagagaacagagtacagttgttaatacttacactattctgaagcaaacagttagttcagtggcccattgtcctgacagtgatagcacaacattgtgctacttgaattgaaaataaagaactctagcatgttttgctccttcaggtttactcagcatggatataactcttcaagaattgacgacaggctctaaacagaacactttcaggtttacaactacaatgttccctcaacccatacaaaatatttctgaacttctctgaattctgaatttctgacggatgaatatttccatttctgaacaatgggtcctcctgacaagggtaaaacaaagaaaactgctgacaatgttgagaacaagaaaacctattctcaaacacaacatctggaaatatttttgaaattgaacgaacacactctcaacatcaaatctgtatattcttgaagagatattcccaaaaaaaaaatcatcaaatatactctgttatttgttcttccccttcagttcccctgtttttagaagtaaacaataccctgctttcctccatttagttaacccaatgtccctcaggtaaatccttcagaagtccaagacatggggaaaatgccaaaatccttcaaaaaatgaaaaattcagggatttgcacctggaggctgcacatagttttagaatcatcaattcaccatgagcagtaaaaatacatagcatgagcaatagagcgatagctcaaatttttggaatttggaactaaatcgaaacaagtgccaaattcgaagtcaataacgttaaacgaccctcaaccgttgctcctgcgggaggaagagcgcgtgcagacaacgctgactcgcgctgacgtcaccgc

SEQ ID NO: 7361 - DNA, 1501 bp, Oryza sativa
ttgttaacgatatcatcatcatgtgatcgatggctatctctgtggacttatggactatggacttgtggactgtagactttggttgcttgcttgaggatgttgtagtatactggagggagtattatatttctgcatgcatgagttcgttgagtctgggccaattgggacatgtgtggggatttttgtagcagcctccttccatttcgggattatttgctcagaaagagcgtgcctaactttcggaggaaaacaagataaccgtgctgtctccccccacaaaaaagaagttaattggaggctttaacagcaaaacacactcgcgtcttctactagtgtttgactaccggccgggggtcccacgtgtaggagtcggtgggcacgcaagcaaaaaggtcaagggaagcaggtggacgactggacgtgcgagacgagagaagagccgcgcacactggaagtcaccggtgtacaaacgtatcgcgttccacgcgttggtccaaattagccggtggaaaaggcgcggggccggccgccacactccggccggctgagccgcaccgcccgcgcgcgcgctcgctgcgtacacgtctccgctaccgcgcggggagctagcggctgcctgccaattggccggcccgcgcgcgcgcagccgcgcacgatcgtgccccgggtgcgcgcacgccgcacggttgggaaatcgtgaaatcgttggctcgatcgaactggaaaggaggggaatggggccgtggcgtgtgtgtacgcgtgaccgtgtccgtttttatctgtgcaactgaacaaaaggagggaatgcgcgcggcaccggcaacctttgaatgggcagacacaggctactatctttaggtagctcgaaggattgacgcggtattttcgcggttcgttgacgatcggggtacggcgagccgaaagggtggttcggagttaacgcgggcaccggtcgatcacctgtggtggccaggtaggataacaaaagacggtcagcgactcagcgtggtgtgaagtggtacggaaggagacgacgtcggacagctcgtgggcagcctggacccaccgagcgggtttgccattgaccttttggcccaaaagaacagcccgatggctaaaaaagggcccaataactacaattagtaaaatattaaacaattacatagttttaaactaaaataacagcagaatttagttcattaaccggtatatatctagtactaagtttaatgaagcagctggaacgcgcgaggcgagacagcgcacactggacggccggccccgccgaacgtacgcgttctaccgtccaaagccggtggaaaaggcagcagatcttcgtggggtcctcggttcgcgcggcggccgatcgagtactcgctgcgtgcgtctccgctcgcgtggcaggggggcactggctgactgccaattgggcaaaggaatatgaacaaaatcttcgacttgcccgacctgttcgtctctcatccagaggaatatgaacaag

SEQ ID NO: 7362 - DNA, 1501 bp, Oryza sativa
aataaatgttacaccgttaataatgtgtcgtagccgttttcagagtgtttttatatgatagtagtgtatttaataactacacgtatactttctcatgacgctatgtttaaaagttggcgccaatcgcaactaaaagtaacctcacccaattatctattaacttattaaaggaatagaaaaaggatcatccacgttcgctctcacggcctagaaattcttacattaattgaagaaaaaagaaaaacagagtccatatagaaatacaatttagaaatagttgaaattcgaaattaaaaaaataaggaatattggaagaggagactagagtccatatataaatacaatttataaataactgaaattcggaattaaaaaattaagagtattagaagaatagtatagagtccatactattaagaaataatagaaaatcagaattaaaaataaggaatattagaaatagagtatagagtccatatagaaatacaattaagaaattatagaaattcaaaattaaaaataaggaatattaatagagtccatatagaaatttaaaactaactattcagaataaacataatagaattaaaagtagagtttagagttcgtataaaaatacaatttacaaataactaaaatttaaaattaaaaaaacatgggaagaagaatataaagtcaatatatgaatataatttagaagtaactgaaattcgaaattaaaaattaaagaatattgaaagatgagtttagagtccacatagaaatacaattagaaataatagaaattcagaattaaaaataaataatattagaagaagtgcctagagtctatatagaaatacaattcacagagaacaaaaattcagaataaaagaaaataaaatattgaaagacgagtctagagtccgtataggaatataatttacaaattactacaatttgatataaaaaataattaataactaacatgtatataaaatacaatataaatattacacattagtagtttcgtaaagttagtacaaaatttaaaattatgttgttattttaatatattagattgagaaaacatacatgctattatataggagaaaatataatgatgctagccgcgtaatctgcgtaggaatcctgctagttttttttacaccaaaaagaaaatttaccgaggtccacaaaacgttgaactatcacttggaacacggcaatacgaaacacaacaaaaactgactcgtctgatttgtaaaaccagagagaaaagaaaaagggggaaaaggaagttataattttcttgccacccccatcacggcttcacttggcctcgtctataaaaaaacactcctctgtctcgaatccttcttcctctccctgcccccgatcggcctcgtcctctccacgccgcgagcccaccagaaaacgcacacgccgacgcgagccaatcaacccgccgcgccgcgcctcgccgccgtcgcgatgcgaccgggcgggccgccgagcttgc

SEQ ID NO: 7363 - DNA, 1501 bp, Oryza sativa
ggcggcggcggcggcggccatctcgagattccgcggctgcggctgcgccccggccccggcggcgagctcggggcctggcccatcgcggaggcgggcccccggccgcggccgcggcggcgaggcgaggcggaggtggaggcggaggcggcggcgagggagcacgtggcggaggaggggttgagtctggaagacgcgggcatttccggttggctgcgaggtgtgtgtggggcccacatcgacggttccgaatcgcggagaccttttttttggtggaatggacggtggtgattggatggtggattcgcatcgagcggctgggatgcactggggcgtactgggtggttggctttcgcggtcattgaattattgcgtgggccgctacgagatattgggcttgaggtgtattggactcttgggtttggtagtaatgggctaaaggcccatcagagattgatccagtccaattcacaaacgattttgctaaatatttgtcgagtgatttttttcataggatttgacgtttttctagccgcacgatgttttccaagatttgcgcaaaagcagggtcagttgagtccatgaccgagtcaacctgactttgtattgatggatttctgtacatcacgcatatcagtagccatttatttcttcgctctatttctttctttctttttctagttaccaaaatttacaatgcactttgtactaaaattacaatacacttgtactgaaaatacagtgcacttacatgtcatatctactacttttacaaatgtaattttagttataaagcactgtaatttagttataaatgcaacatttaacacttcaaatatctgcacggtttctcaagcaatgtatttatactaaaacgacaaatattctagttaacaaaatttacagtgcacttgtactaaaattacagtgtacttacatgtcatatctactgtttttacaaatgtatttttagttataaaacactgtaattttagttataaatgtaacatttgtgttaatctttactgaatactactgtactaacaagcacaatcacaggctatctgtacttttttttttaccgttggatgcagatatgaggggagaaaaaatttgggtgattttttcttaaaaattacacgacagatgtctagacagtcccattcacaaatgttctctttttgttataccgtacttcctccgtttcacaatgtaagactttctaacattgtccacattcatataaatgctaatgaatatatatatatatatatatatatatatatatataatagtgtctagatttattagcatctatatgaatgtatacaatgctagaaaatcttacattgtaaaacggagagagtagtaatgttttcaacaatagtacttttttaagagagagatagtaggcactgtttgcagcaaatctctacaattatagtattctctccattctaaaatacagtaacttaagatcgtgtagtactagggtatgatcctt

SEQ ID NO: 7364 - DNA, 1501 bp, Oryza sativa
acgacggcgacgcggcacggcggcgtggggcgcgacggcgacgggacggcgataggtgacatcgtgcagcggcgcggggctcggggcacggcagcggcacatggcgacggacgagcggcgcgcaacagagagaggcgacggcgacgggcgacagtgacgcgcacggcgcggtaggggcgcggagcacgaggcgggggcgacggcggcagcgcgcgcggaggggaggggctcgagacaacgcaacagacgacggggatgcgatggagtgcggcgcggcgacaggacggcgcgcggcagtggagtcaacgggacggcgatggcgcgcggcggggtggagactcggcgcggcatcggcggcacggggctcgaagcggcgaggggacgggcgcgcgacgacgggatgggcaatgcgacggcgagacggggctcgaggcgatggcggcacgcgcggcgcggcagcgggatggcgacggcgacggcgcggcagcggcggcgcgcagctcggagcggcgacgcgacgggcgggcggcgcggcgcggggctcggcgcggcttggcggggctcggcgcgacttggcggggctcggcgcgacggcgacaggcgacgcgacagcgacgcggcgcgggcgcgaggtggcgatgggacggcgcagtgtggcagaggagggggaagggctaggggaccacatcaagcagatggcgtgcaatgaatagtgacggcagtgaataaaaaaaagaatttaggtttttggttggttttaaaaattgagaataatagctatttgaatttatattttcaccaacgcatttgagtgacattattaagtgttcaaatgtgaattttatttaaagttaatgttgtccaatacttaatactcgtatttattatagtctttgtaatttcctaatgagacaattacagagaggcagtgatattatacactctatttatttatgtgagtgaattttatgcgaagatggttgcgttaaatattgatttaaatattccagcaaaacactcttttatagatgggatcctggtaacgatgtgatcattatttcgtgtgaacaaattattctatctaattgcaatgtatgagctaaccttgttcttttaaaattggttttacctctatatggatccttataatttaatattcgtggttcaatacaaattatgtaacatctaattaattattcccagtaaaactattctatagatagagttccatttatttgaacgattatcatttcctaagtgtctatatttcatggcacgcatcacaaggttcaattatttaatgtttgatccataaattaaattagtaattaacattccctttgtctggctttgtttcctggtgctctaattattcgtagggttaacaattaaatattctcgtaaatttatctattacttaaattttagatccttactttactttccttgtgatcatttacggtttggcaagcaataatattcataacaaccatcatgatgc

SEQ ID NO: 7365 - DNA, 1501 bp, Oryza sativa
cggcgcaagccgtgggggggtggctcgccgaacaaccgcggtacaactactggagccacacctgttacggcggcatgtgcgggccctacacccaaatcatgtggcgcgccacgcgccgcgtcggctgcgccatggtcgcctgttacaacggcaggggcaccttcatcacctgcaactacgacccgcccggcaactacgtcggcatgcgcccctactgactacccgcccacccaccctccgccgccgctgccgtcgccggtgatggtgacggtgaccgattctttccttggtccgctctgccggccggccgggagcaccgcggcacacggcagggcgacgcagcgcagcaaccaaccaatcttgctgtctcattcattgccatatgatgatgatgatgatgttacaagagtactacaactgtacaaaataattctttctttctactgcacgctgcaacatctttttttttttgcttttttaccttttttcctaccaaaatatatattatgatgttattggtaggatcggggaaactacaatgaaatatgatcagctaattgattggtctgttattactctgttctgtccaacaaaatgagcctttttccccgtccccttctcgcacatttcacgtgtactatgtactccacttttgaacacattttacagtggcaaaatgtgagttatgcagagctgctgcaagaatggaacaattgaaaaggattaaaggaagaatggctaggtggtacagaaatcaccttttctctctctgcgtgtgtgaggcttttaggtgaagagattggtcgcctctgattggtggttggtcggttggcagagtattgcaaagcgaaaacgaccaacggatgagttgttaaatgagtgctactgtacgtatttggcgcatccatgtgcctgtaccgaagacgctcagagcctgggcctcctctctctctctctctctctctgaagtctgaaactctgaatctctgaggtgtgtgcatcatggtcagttggaatccgatgcaatgcaatgcgacccaaccggttttaatctccccctctaactctgcggcgtcgtctagctgcaaaaacttcgcgcattgatcgccaaaacggtcgagttgaatgcgtagctgaagtatagtggagtagagtagtatcagtggcagctgatgagttaaatacgcgacaatgcctgcaagaagagtacaattatactgtgcgaatctagcagcaaaaattgcagcatcacggcgtcacgagactacgcatacgcgaagcagatgtgatttgggtcgctgcgaacaccacatgtccacatgctacctagctttggacctttggtcgctactagtactaatacaatttactgtatttcttctgcagctctggtcttgtgcagccaatacgtatcttatacacagtttatacgggtcaaagctgaagggaaggaacggtcaattggtgatctggtgagtattatttcgggggcagagcttgc

SEQ ID NO: 7366 - DNA, 1501 bp, Oryza sativa
catccttgctcaatctttccccctccagtcagagaagcgtcttgaagaggaagttttagatggagtcttggcttataccccagttgaacgcctgtgaagatgaagccctaggcccgctagtacactgctgtttttctttgattgttaggccttatgtgcctttgtaataatgtaaatattatcgtgataattaataaagatgtgtcttttgtatcatgtttgtgtggtgtaccctggcttttcctgggatggggattaatatatgagcgttcgggaaagatattttccgggcgtgacaccagccaataaagacgcaccagagttgagcaagaagagaagtcataattgtgggaagcgcaaaccctcggaagaggtcctcgctgctgagcaaactgtaacaccctaaaaaaaagagcaagctagctggccttgggccttgtccggcccatgtgagcaagcaacagctgggctgggccgtccgtgcatgcagcagcgcagcagacagcagcagtagcagcttgcggtactgtagcagtactcggcactgtagcacccgagtttagtactacctcgctacttcagccagagcagcagcagcttataaggatggggtcctgttaagtccggtttgaaccttttgcatgaagcgaggacgaaaatgcaagtgagttaatagtgtccgtgcatgcagaagtgcagcagtagtagctcgcggcactgtagcagccgagtttagtaccacctcgctacttcagctagagcagcagcagcttataaggatgggagcctggaggttgttaactccggttcgaaccttttgcgtgaagcgaggacaaaaacgcaagtgagttaatagtgttaggtgtggtccaactaaatgagatgacccaataccgtttccgggcgctgggttgttacacaaacggacccacccaagcgcccaaacgcccagaacgatgactcacggaaacaatggtgccctatacacaagacgaacagtcactccattgaagattgttgcgtcttcaaaaaggagctcgcgcgacaactagcaatcgagaggggaaagagagtacgtgttgtcgaaacgattgttgagacggccacttccgactctgactccgtattcctagaatacgacctccacgtctcacacatctttagcggttctacatcttacacctcaaagagggagtacaaaaatatagaacgcgaagtctgctccacgtcgcagggggctactgtggagattatgggtaccccatacccacacggcatggttatccgactagtcataggggatagcttatatctatagaatatgtaaccgatcatgacttgggtattacgtttccttttatattatggagcggcctaaagtcctgatttgataatattgtaaaatagatttaggaaaccgataccgtattggttaaggtttctatcttgtaatcttgccccccatcctatataaggtgggcaggaggccctctagggggca

SEQ ID NO: 7367 - DNA, 1501 bp, Oryza sativa
gtgggtgtatcctggtgagatccatcgtccccctccttgtccttgtccttgtcgttgaggaggtgtatgggcttgggcgcctcggcgtccataggaggcgtgtgaggggagacgagaagatccttgtcgggggcgggggcgggggcggggtcgtggtcggggggcttgtccggtctcctccgcctcttgggggcaggggcgggggcggaggaggaggaggaggaggaggaggaggaggagagggggcggccggagcgggtgcggccgggggaggtggacatggcggagagcgactggagtgcgaaggcaagctcgcgcttcatggctcgcggcgccggagatggggaggcgggcatgggatgggatgggatcccttattgttggtggagatcgaaatctagaggaggaggcgggcgcacgcgcacctgctctgagatcgggatcggatttgatagggtttggagaggaggagatcggaggagatgggaggaggaaccgaggaggaggaggcggcggcggcggagcaacgaagcaggcctctgcgcccccctgacccctgccctccccaataccatttgggtttccacccccacatcttaccattactgtatcgtactactttccgttttcttttctttcttttcttttttttccctcttcctcgctccagaagaagacggagaatttggagatgcagctttttttttttcaaaaaagaaagaaaagtaaatgtggatgggccagatccagattgatgattgattgtttttagacggaaaaagttcgctggagctccctcgtcttatcgtcaaattttaaaatcgtcctgaattgaaatactacatatctctaatattataaaacgggattacattgggtcccaatacagtgttgagcgtgtttttggttgacgtggcactagaaacaagaagaacatgcgggacccccgtatcattgaaacaaatattctaccttatctctctcctcatatcttcgatctctgcggtagcaaatgtggtggaggtgcgcaaacaatcgaggacaaggaaatgatgtctgccatgctcgatggcgatggcggaggcacgcctcttcacatcacaccacgaactggaaggggtgacgaccaatggatagtgccgccacggcctcgcacaaggcgcgtggggacaacagcctcgtgggtcttgagcgccatgagggatttgaaggtgaagacgtatgcaatagctaggtcctcgtcaagtgatacggagcaggccacgaaggaagaaggcatagggatgtacctgcccatggcagagagccagagacgatgaaccgcatcatggagaggtcggattgtgatgcgaaggggaaaaagtggaggtgaaggacaagcatcgtgttgacgtcggatgtcgcggcggcagggttgcatgagggcgccatggcattgttcagcgacgcattgtacttgtccaccacgcacgagagtgagggcaacatcaactagggcgcc

SEQ ID NO: 7368 - DNA, 1501 bp, Oryza sativa
agcctcggaaatctttttcagaacttatattccactaatactacaaatttggaaggtttatttgcaaaatttttgtgtcttatgaattcgctgcagttttgagaaaacatatctttgtttctccctaatggcatataatcatttgccaaagttaaacacacatccataactcaacaaaattattcacaaatataaattactatgctactttgatccatctcaacattgcaaaaatatttaaaatacattataaggtcttgtggaaattaaactttttctatattatgtacgggctataaataaccggcacgcctaaaggtgcgctgattttctaagacattaagaattaggtcaatatttattgattatataccatcaacctttgctgtattgcatgatcagtgtgtggatgggctttgcgctttggctattgttatttatggttaagtgctaaaatatcctttgtttgaccaaataaccaagttgctaggtttatgcactctacatctactgtggatagaagtaagtgtctgaaaaagtttgatctttgtttttgtagctttatttgattagccagctttaccattttgttattatcaggatacgtttcataatgtcattctagtttctgttgcttcctatctttggttgtgataagcattcaggccccgtttggctaatgggaaagggaaatcatttcccacccactaaaagacatctttaaatcctaaccattcattctccctcttccatttaatcctaaccctttattcatttcccaatcccaatctcaccccagggttaagatatcttattttccctgcatcagatactcaaattaaagcattatttttagtgggtaaccatgtttttcagaaccactcgctctgatgacaatttgttactgctatccacgctcatttttcatatcaagttcagaaactgaaacttccgccccatatagcctgctgccttttccactctattgattatttaatgtattatacaaaacaacctaatcgttgagggatctaattagtctgatgtgttttgcaccctcttgaagtatggtgaatgactgctaatttttgtgacacaagaaatgggaaaatacatgctaagtggactagtttaggagtctgggcggctgggcctgatgaaagttctgtgcgtctcctttgcagaacttagaatctattccgcgagaacactatattttcaaacggagtattaattttggtacaagggctggctaacaatgcagggagagggagcacgtgcatcagtatacacagatgaatgtgcctctgattttagctttcttgctataagttgccctcctgttgtaaattgggcataagtaaattttttctattttgttttgcaaaactattatagtaagcttaagcaccccaatccctttcctgatgcagtgttgatggttttgcttgcaggggcgagggacattgtttggagaagaggtgcgccgcggcaatgaagc

SEQ ID NO: 7369 - DNA, 1348 bp, Oryza sativa
agtatggtgctttccgtttgactgcaagtcgttcatcatcgacgacggcgagcgacggaggacgatggcgacggcgggacgagctccggaacctcctaacgaacaaaaggagaggggttagagggagagaggagagtgcgagagggcgagggcgccggccgaaggcggcggccatggcgtcactcaccggcgcacgacggggatggggctccggcggcgaacctcgacggaggaggggtggacgaggtggacctcggccgcgcgaacccaacggcggcgacggcgcggtgcggcggcgagtgtagcggcggctagaggcgaccggagtagcgggagaggcggcggcggatgggcgcacggcgcgggagcaatggagggcacgggagagagcggtggaaaaagaaaaaaggtggaggggagtgcgggcatgctttataggggctcgggagagacggacgtgtccgaggcgagcccgatttcgccggcgacgtgggaggttgaaggtgggggagagagagagagcggcgtgattcaaatttgaatcccggccatctcggttgagggcgcggcgagacagagagggggagtgggtccggaaggcgcggcgcacgcacgggcgtggccgacgtggaccggagaaggcggggtgcggcggtttcggcagcggtggcaacgtgggcggccggccggaggttgggaaagggcccgacaggtgggccccacctgtcggcgaccctggggagaggagggaggcggccggcctggctgggcctcggcttgcggcccgcccagcagggaggagggggaggaaggagagaatgggccggcggcccattcgaaaaaagaagaaaaagggaggaaaaagaaaaggaaaaaggaaaaaggattttccctggaattaaaatattgcttgctcaattttaattggttaaaattatttctagagctctgaaaattccactaaaaatcctgttagtgaatttcgacatgtagaactcaagaaaaattccacatgcccattccgattattatttgcattactttcttagggttttctcttgattgcacctgcatttttttggggtcgtttataaactaaattttaggcttgggaggagaacttcggggtgtgacaccaagccgcccctccctctctccccgggacgccgacaggtgggccccacctgtcggacccgtccccttcctctagccggcgccgccgcgcccgaaaccgccgccgcagcgcccccgcctccgcctcctccgggccacgtcgcccacacccgcgtgtgcgctgcgtcccccgcgcccactcccctctctctcccgcccgcgcccgcgcccgaga

SEQ ID NO: 7370 - DNA, 1501 bp, Oryza sativa
tcattgattaatgtctcaaatcactatcacaccatgttcaaccagcagaatttttttgtcaacaagaattggagaattctgaaattaccatgcttgccatcaaaaccaagcagagatttctaaataaaccagccaccgccaagttgtgtttctgtttctgcaaagtatatgccaaatatcatttctgcttctgcgaagtagagggttccttcacaattaactgatcagctttagggtcattccaaaagactggaatagtgtgtttgagaaagaagaaaaagactgcaatggtcacattttgcctaaattttcagattaaactgcaggttcgtcgaaatagttaacagaagaatcgttgttgtaatttacatgttgttgttgcaatctacactgtaaagtgagggttcacctaggtgggggcacctacaccgtagccatgtgcccaccccttgctgtgttagggtgtaggcaagctagtggagtgggccaagcggcggaagcggcctgatccacacagctcgagcccttgatggagtagcaatcagcaacagcggcggatttggctccacactgctcctgtcaataatatccggaataagttcaccggaggtccctcaacttaacagcgagattttctgaagtcccttaaccacaaaaccagaaatgtgtacccataaactcacacaaaccgttcaaaggaagtcccatggcagtatatgtgggtggtttcgctgacgtggcattctagtaaaaaaaaaattaaaaaagtacgtggggcccacatatcaatagtactttttttttctttgcttttcttctccttctcttctcttttatctctcctctttctcttcttcttcactgagtgaggccggcggtccactagcaagcaatcttggtggtcgtcgcgcgctagctcgtcacacagatggagcaagagcaagtgctaacccaggagagcaatagttgcacctgcagcagcagcagcaaagacgcgagctcggccgcctgcagctcgctcaacgcgtcgtcgccgagctccatggactccgggagtgccgttgccgccggcagcggcaagaagcggccgcgtagacgctggcggcggagagggcggagcagcgatgggcgggcagcgagcgagcgcggcggcgggtccgcgcggcagccgagcggcagcaggcgagcgcggcctgcgagcgagcggacgagcacggcggcgggcagagcgaacgagcacgacggtgggcgagcggacgagcacggcggggagagcgtgtaggacttgtcgacggagagcgtgtaggactcgtcgacggcggggctgagcgggacgtcggggtcggagacggagagcgcgaggatgcggacggggacgcggagagggtgtagttggcagggggaaccagcggtgcgcggcgctcggcgcggatgaggatggctcggccgacgacgaggacgatgacggctcggctggcggtgtaggcccgcggagctcgcc

SEQ ID NO: 7371 - DNA, 1501 bp, Oryza sativa
tacatgaaatatattacactagtgccctacagttccaaatatcctcagcttctgttgcgtgtatatgtattatatactacatgttgtgttcatacccagtagggaacaaattgcttagtttcatttttgggccatatgatacgcggacttctttgagattgtctctagttcaaggcccatatagaaacaatttatttagttctctatatatttcaatgacatatatgaaaatgcaatataccaaatgcaaatgttctaacctttatctgtgtgtgaagtcatttctcgttccttgtctaacatatattgtcccatggggaatgctttcctcggctcctctttaccttcacttccgtatgacacagagacttccttcaatccctctgtagctaatatgacccatttccttttgttttcagtagacatatatataagatatccaacgtattacaacatacatcttagttccaaatattctgaccttcgcttttgtgtaaatacttttcgtattcattgtttgaccaattttttgcagggaatactttgcttttcttatcttcatcttctggtccatatgacaccgagacttcctttagtccctctgcaactcgtatggcccatttatttttattttcagtagacatctatgtcttacatagaatacaatacactaacatcttttagtcccgaataatctcgcatttgtttgaatatatatatatatatatatatatatatatatatatatatatatatatatgtatatatgtatatatatatatgtatatatgtatatatatatatatatgtatatatatatatgtatatgtatatgtatatgtatatgtatatatatgtatatgtatatgtatgtatatatatatgtatatgtatatgtatatgtatatgtatatgtatatgtatatgtatatatatatatatatatgtatatatatatgtatatgtatatatatgtatatatatatatatatgtatctatatatgtgtatatgtatctatatatatatgtatatatgtatctatgtatgtatgtatgtatatatatgtatatatatatgtatatatatgtatatatatatatatatatgtatatatatatgtatatatgtatatatatatgtatatatgtatatatgtatatatgtatatatatatatatatgtatatatgtatatatatatacatatacatatacatatatatatatattttttttttcttgtgttatataaatatatacacatatatgtatatacatatatatatgtatatatatatatatgtatatatatatatatcatatatatatatatatatatatgtatatatatatatatatcatatctatatatatatatgtatatatatatatatacatatatatatatacatatatatataaataaatgtatatataggtatctatatatatatgtatatatacatatatatacatatatacatacatatatatatacat

SEQ ID NO: 7372 - DNA, 1425 bp, Oryza sativa
  unsure (1)..(1425): unsure at all n locations
ccgctctttganaatcgatattcgagctcggtacccatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatatatatatatatatatatatatatatatatatatatatatatgtatatatatatatatatatatatatatatatatgtatatatatatgtatgtatatatgtatatatatgtatatatacatatatatatagatacctatatatacatttatttatatatatatgtatatatatatatgtatatatatatatatacatatatatatatagatatgatatatatatatatatacatatatatatatatatatatatgatatatatatatatacatatatatatatatacatatatatatgtatatacatatatgtgtatatatttatataacacaagaaaaaaaaaatatatatatatatgtatatgtatatgtatatatatatacatatatacatatatatatatatatacatatatacatatatacatatatacatatatatatacatatatacatatatatatacatatatatatatatatatacatatatatacatatatatatacatatatatacatacatacatacatagatacatatatacatatatatatagatacatatacacatatatagatacatatatatatatatatacatatatatacatatacatatatatatacatatatatatatatatatacatatacatatacatatacatatacatatacatatacatatacatatatatatacatacatatacatatacatatatatacatatacatatacatatacatatacatatatatatatacatatatatatatatatacatatatacatatatatatatacatatatacatatatatatatatatatatatatatatatatatatatatatatatatattcaaacaaatgcgagattattcgggactaaaagatgttagtgtattgtattctatgtaagacataga

SEQ ID NO: 7373 - DNA, 1501 bp, Oryza sativa
ctccaagattatttctttgatctcttagaagggagagaaagaaacccagccatacgagtaatcatatatatgctccctctcttaaggctagatgatcaggcaatctctgacccatcctatagattcctggttctcaaagctgagataaatcttcaaagattccggaacctacccacatacaaccatgaagaaatatctctccaaaccattatagatcatggtcttgtgaattccatctatgcaaccctcgatcagatccttcaatctgatttaggaaacgctgtgaaagatatctgcaggagacttggacatggaagatacagaattatcttctcctcaataccaccaaaattcacaccacctgttcgtccagcaattcattatatatatatcatgaatagacaatttaattttcaagaagacggtcctagcaaactatcggatgaagaggaagaaatatatacaacaattgctaatcatgaaaattggagattattttctgaagctgcagaaattgaagaagctatcaccacagattatgaatatcagctggttttccaaaacaagatcacaaggatttttatcagcaaattctacaaccaaagttatgaatacttcaagggagcagggcacataattaaaccggattttggaaatgaatgctccaagaaaagttactacagaagcctggctcagtggtttcagaaaacagagccatcagagatcgacacggtgcaatcagcacccatgataatcaacgaagataatgaataaagatcttgtcatccccgacaaagatcactattcaagataaggaatctacactattctagataagataagtctatggtcaaaaggcgatattatgacatctttattgaaggtcaaaagcgtcatcatcaaagattctctccatgaagtctaaagggatatcatgaactctttgaagtcaagaagagatatcatgaagattctctaccgagcgctatataaggggctcagaggcatcgcattccacacacaacacatctcactcaaccgttcctctcaccgctccaccagccatcacactccactccactccatcaaagtgttagtactatagtataacctaaataaaagactcatgagagtctaagtgtgagagtctatgtaagagtctttgtgagagtcctgtacctgtataattacgaacgtgttgtaccaagtccttggtgtaatcttcagaaggaactaccttcaacctatcaaggtatatgaatgaacacctggaccgttctatataaacctattatgttctaaatatctaattttatatcttgtacataatttgtatttacatctttatttccagtactgcatttatgtttgcataataatattaaaaaaaaaatttaacaacctggattgccatccaattgtcacatactaatctcacatcaaagattgcatatagataagcattcctatcctcatatctggtgactagacccctagtcac

SEQ ID NO: 7374 - DNA, 1501 bp, Oryza sativa
aaccagatgattccacgaaaagatctctgtacacgttgatttcgcccgtcggtcgccgcgtctccatcgcatctcgccatctcggagaacatcagagaaaggcacaatgctctcgtgttcgtccaatggccgctccaccgctccgttgaaaacagtcgtaactgacacgtgctcccgcccttttcttttttgtccatccaacaaagatgaaaattcgccatcgccacctttgtcaaacagcacatgccaaattccctataaaaatggttacgcatacgatctgattctccaactcacatacgactgaatttatcatttatcatcggttgtaaacggctacacactgtgtgtatgagcatagtttttttattaatttatggttttgcagggatgaatccagtgtggtagcggcggggctcgagcgtctactactagcatgaggatcgtaggagacccatgaaacctctacaaaacttttttttttataaatttcttttaccatacttcgatggaaattgtctcgctatttctttctgatccgttaggccctgtttagttcccacgcaaaaactttttaccatgtcacatcaaatgtttaaacacatgtatggaatattaaatatagataaaaaaatactaattacacagattgtgtgtaaattgtgagacgaatcttttaagtctaatttcaccatgatttgataatatggtgctacagtaaacattggctaatgctaaaataattaggcttaataaatttatctctcagtttaccagataaatcaatttattttgttattaaactatttcgaatgaatgtattgatgacacgtcaaaacttgaaacggcgccttattcttagtcagtgcgagtatccgacccgacgccacgcggggcgccgcgcccacaggatcgagaatctcacgggggtgcagagtgcagactgcagaggctggcacgggggccccgcgcgcccaccggcccacggcgcgagagccacagaacccgggccgcacaaaaatatctctccccctttgcctccgcttttatcccacccgacgatgcatcggacgctcgcgaacgttcccgacgccagatatttcccgcgcgccgcgtcgcgccgcgcaactcttcccgccttccagcttggcttcgcaacgcttcggctatcctcttctcttcttttggttgacacgatcaaagatattttccggcgtccgcgcccatatatatgcacgcgccaccctccgcgtttcgcgaggcctctcctcgacgtcgcccgtacattctccagccgcgccatcgttctttcacttcacccccaatgttgttctagcccccgcgccacccaagatagatagattcatcgcgatcgatcgagcgggaggtagagactagagagggatagtgtgtgctgctgctgctgcgtcggagtaggatatcgcgatcgatcggtcgatcgggcggatgcagcagggaagggggaggaggaggataatcc

SEQ ID NO: 7375 - DNA, 1501 bp, Oryza sativa
atgctggacgggatgatgcaggatttcgcctcgtccgaattgccttcgcccagcggcggcttcttcgccggcgcgccctcctcgccgttcgccgacaccggcgccgcgcagcagcagcgcggggtcggctccgcctccgcgcgcgcgcacgctcatccccaggtggtcggcaactctgcctgcctcagccggatggccttctccagctactgagatcaatttttgccagcggccgcaacatcatcacctgcatagattagctagcctcgtcgacatcgagtgagagtgagtagtcggcggcggtgcggcgccgccccctgctgccgatgaggcgcgtcagcgtcgtgatctcatgaaggtgcatgcagaaaggtggcaaggcagggcactggaacaaagtatttctgtttattttcttgtcttgtttcgatgggatgggctctgcagcgagaactgtctatactgttccgagtgtaccgtgacaatgtgatatcacgggactgtttgcctttgtacagtttcatgataaacaatctgaagtagtagtaatgaactagtgacaatgatgatgatgatcgtcgttgttccgttctgttaggatgatgggacgatccctttggtgtgaaactgcactcgtgtttcgctttttttttaaaaaaaaaaaaaacgtgcaccttatcttcctctacaggagtaaaccgtagaagactagtccagagaaatgaagttttttttaaaaaaaatacagagattgatcaatactgatatatatctccagaaacatgtaattttgaattgaatttaaacaaacaaaaatgttattttttttctacttagtaattgaacttgattctctcttcgtttcaggttataagacgttttaattttagccaaagttaaactattttaaatttgattaagtttatgtacaaatatagtagtatttataataccaaattagtttcattaaatcaataattgaatatattttcataataaatgtgtgttgagttgaaaatataattattttttctataaatttagtcaaatttaaagcagtttgattttgaccaaattcaaaatgtcttataacctaaaattgagaaattgagggagtatttatctgaaatcatatactattttaatattagttgttcggtgatatgcagaaacaggaagacgtcccacaaatacacttccccgactggcactagttgttttggacttgttcacctgtggccaaggtgcacggaattgaatgacaatagaatgaagcttgaagttacatctagaaccgaatatattatacttcagcaccaaaaagagaaaaagaaccactaatcaatcctgttcggggcatgctctcccgtaaccagagcacttaaagtcttaaaccccccgagatattagcggtagttccacgctcctaccagaaacacaataagaaaaggaaaagaatacacgtcacgtacaccagcacatctaacccagtcccagttca

SEQ ID NO: 7376 - DNA, 1501 bp, Oryza sativa
ctgccatcaccacaactaattgcacttattattatataacggtctgtattggtgaggcccatttagggtgtgtttggtttgtggtcgaggttggataggatatggccatccatatttacagggatatggtggtactctttttttggttgggtggagatggccatccagtttcttgtttggttggatggatgagaatggatagaataaaaataataacatattaattaataataatatatgttaattatcattaatatagctataatttatactaattaacaacaaaatagaccaattatatctaatcaacactaattttgataagttgattactaattaacaacaaaatacattaattattgctaatcaattactaatgattaagattagcaaaggtggatatcctcatccgaccaatttggccagatacactcatccaacatcttcatggaatatttcctctctaggccaccctatccacctttgcccaccaaccaaacacccttaaaaactggatcgccatcttccatccagggatatccctagaaactctgcgttggtgagacctatttagtaacaagtctagaaactttttagagatctgacaaacatatacgtgaacaattatagacatgccgatcacttaaatttaaaatactacaatgacgtgatccagagcctctgcttgaggtaccggactttgaatccgccattgagcctgtagggactcttcctctatcgccacccctttctatagggatcttggttagctcggagattgaagaaaagagatatacccatgatcttaatctcaatctaacaacagtacagatcaacaagttttggcgagcagctaccattaaacctaataactctacacttttattacgtgacactgctttttcgttaaacttgagttaataggattactatcccgttaaaaaaaaacaactttcatgtcctcaagttattctttttgacgtgacgagtgagttcaagtggacaaaactgcgatgaacccgaactgtgccatactaccttccgcgggtgcacaagcacacctcagcctccgcccttcctcaatgcgcctctctttttttcccctttttttttctctcacatatccaaaaaaattctccgtgtgctgatacgtcaccagccagtgtactatatacccttgcctgcgcccccactcctcctctcctctccctctcgcgtgtccatttcacgaattcctcgtctccacctctctctccctctctctccgctttctccccctttcctccactcgcctcacgccacacccctctctcccgaccaccacccgcctccgccgccgcctccgcctcggttcgggtcggcttggctgctccggcgtctgttggacggtgggcgcggcggcggcggcggccgcgggcaaggggcggtgggggtgggggtgggggcgcttctagggtttggtggggttcgggcgggcgcgccgccgtgtttggggtagcca

SEQ ID NO: 7377 - DNA, 1501 bp, Oryza sativa
attgccacattgatgcacttttgtgctcgttcacctccctagctactttatggtaacctcgtttattcagcaaattacggactatttgtagtacgaacaccaacattccaccttcagaccgtggcagagtcgcttctttatattcaagagcagtggttcagttcctttggcacccgatgagctcttctccaggacttaccacttatgttttgactcctattgatggacacaaatccagcattgtcaagatatcagggaggaatagctgacagcttgttcgagctgtgtcacgatgagggttttagtgttatgaccacacgtcaggcccatggggcaggttaggcaggacaaattaggaatagatcaaacaaagctaagagattatctaattaggaaagattagagattagagatagagaacgaattagtttttataatatcaaagataagttccttggatgccaagtcagtcttccctatatggtatagagagggacgtcactaccgagcaacgggggtgctcaaaatcctgctgcctgctagcacagtgatgacgtggacatcaccagaatgtaacacgtcagtgcaaaactgtgaggtggcttcaagtggggaggtcttaatatatccgatataaaaggactcgtataccccattataattaagaaataaggaaatataatattaggtctggcttgataagagactcctggtgattgggccaagctcagcgatctcgcctttatccctgtctttcgatccttacaccatccatgaatcaacatcagttatattttgaaagaagcatttagagtgaccaatttccaattgaccaacactaaaatgaggcttcctagttattacttgtctatgcaaacataatgcttatatattacttaatcagtgaaagtatagcctagttaccagaagaatgggatatttccactcctcttcaaattcttatacagatcaaactgcaccgctttgatctaatctaacttgtagtagcataccagaactgctctatcaaatcatttcatccatgtctaagcgaaatcaagttattctctaagtactccctatcatactgtcagtaagtaaaccgatgtaggaggctaatccaggattccacagatcctgaaaaaactaatcaccgccaaacaaatcccgctcctctcttctcacgatcactatagctcaaataatacagtcgaatattcaaaacctactggcagaaatcatgttatcttattttcccaccggtattccaaatcgtacagagaagctagttatactgtatccagaacacagtcccgcaaaccaaaacagtgggttcgtccaataaacaaacaaagttcaaaggaaatccaccccccaaaaaaaagaaaaacaacatcgcccgcgaaaccctagcggccaaacacgccgcaacaacccttctcccacctagagcacaaggccggaaccggaaccactcacttcgatcccttcccgtgatttc

SEQ ID NO: 7378 - DNA, 1501 bp, Oryza sativa
taccactgttccttcactatcacaataccatggcttgttacctgttggcttgttgctagtatctgcaactcggcattggtaaaaaaaaaaaggaaagatggaactcaaatgacaaggacgggagagaggggatgcagtaaaaacgcccaagatagcgcaagtaaagacgcgccggccagcctagcacgaacgggccacgccaatgtcacgcagcccgtgcctttgtcgccttccctacatgtagcagaatccattggtctccacggggaagaaatgcagaatccattgctctccatcgtcgctacgttgcgatgccatagaaactctacgctactgctgctgtgcaaacgccctcaccattgacgaatacagagccgaagacctcctcgctcttcttcgccagaattggcacaagaaaaacaaaaacaaaattgattcaccttatatcggcgacaataatgtacgtgtttcatagagtgagcagcaacaaaaaacgtagtcctactagtaacttactacctccatcgcattttaagtgtagttgtaaattttcgtatccaacatttaaccgtccgtattattttaaaaatttataaaaaaaataatcacatataaagtactattcatcttttactatcttgtaattaaaaaaataccaatcataaaaactttcaaataagacggacggtcgacattaataagagtaaagaccgaggtagtagggaaataaaaaatttaacaagctaacggatttaatgatttatcgctagtgtccgcatcttttagcgtgtattaaagacaaacaaaaaattaaggatttaattatatggtggacgtacgcgatggtgagtgtacatgtgtactctcattaaatcgaaaaaaataatactccatttattctaaaatatgtgtcacccacaactttaaagaaaaaaatcaatatttgtaaactttgactaatacttccttcatcttaaattgtatttttaggtgagcacaaatattaagaaaataaatataaatgattaaaggaatgctattattggttgaaaaaagaaagtggataaataaattaattgaaaatgcttgtgaactgattggttgaaaggaaaatagtaggtgaagaaataatttcatcttaaaccaaatcatattattaaaaatagctacattttaaaatggatacattttagaatggatgtagtagttaaacttaactaatatacgatattactctctttgccccaaaataaatccaatcatagagatgaatgtgaactaagagagggagtaatgttttgcattggagatcgcataaaaaagttttatattttttgcgatagaggagcactatagtagtgccatggacaatagaaaggccatggaaatgattagttttggaattcctttgctcccagctcaacatgtgattactcaattctagaacaacataaacgaaagaaggatgaggcacaatgatcacaaagggggcagacgatga

SEQ ID NO: 7379 - DNA, 1501 bp, Oryza sativa
ggggataacattgagaaaacgtagcttttcgaggcattttgaaaaattaaacgtgatctcctcgctttagccaagcacgctgccctgatagccaattattcggcttcgctgagattcatcacgctgggagatccccatcagtattcgcaaatattagattattatatatagcctccgaacaaatctatcaaattacaatttgctaattattgatttcagacattaggattttagttatgaaatactagtatgatactaaattgagagccaaagcaaatatgactatccatatagacagaccaaaatttaactaattaggttagataattattaattttttaattgattgctatgggcctgttcggtaagccaacctgcagctttttcggttgtacagcgcagccatagccgaacggctgaagcgctgcagcggagggtgcccctaatgggcgggtgattgatcccagcgatcaacccgcccctcccccctatattcctctcccttctctcctttcatcataaatttcaaaaaaacaaagttagtaaaaaaattagaaaaaaatctaatactctcatttagggatgaaaacggttggaaacgatcggaaaacagcctcaaccatttccataatcatatttttctcgaaaatgaaattgaaaacggtaaagccagaaacgaaaacgatatcggaaatatcggaaaaccggaaacggaataatacggacagaaacatgtcggtacatatcaaaaaccggtaaataaacattaaactatagaaaacatatatttaattttacataagtatgttatatgtacaaataaattcaagctatactatataaattataaattaactccattttagccctcaagttagggatttaattgaagagtcaatcaaactctaaactatgggtcaagtagagacatgcccagggcatccacaatgtgaagcaaaagtagtccataggcaatattatattccattcagctacctattaccattgtgcaactggtccatatagaaaaaataacaaaaggtatccataagcatatagactacccatatggaataaataatactatctatctttatttctctctcatttcctaatgcaacattgtatctatatacattgtggagattgttatagttaaagtccttttatgtgagtcccatttatatggatcacttttgccatatacattggtgatgcccatttgattgaagagacaatcaaactctaaactatgggttaagtagagacatgccctataaatatcaacatatttagaaatacagtaattactatattataagaaacggtaatttccataagaatacggtaaatacggaaatgatcagtataacagcaaaaccatttctgtttccatttccatattttatcggtcgattaccatttccgtatggcttggccggtagaaagtcggaaatgaacaccggacggccgggaatttctgttaccattttcaccccta

SEQ ID NO: 7380 - DNA, 1501 bp, Oryza sativa
agactgtctaggccacacactagacaacatcgagatgagtgtagatcataaaactatcgtttaaactatggtaggcaatgagctaatgcattttttatgtgaccggagttgaaattttctatcccacccaaagctcatatggcttagggttttgaccccattccaaacccctccccctgctctaagtcactcgctaccctataatcatgtcgcctctcctctactagtcaccatcttggatcttgctgagttgcttcgatgacctctcttcgacccatggctctacataagtgactacaccgtacctatcaccttgttattaaattttcttaggaagtatacttatatgtgccaaaaaaatacgtataatatggagtattgtacagtatataatatattgtacgagtttacaatatcgtgtactccctccatcctataatataagggattttaagtttttgcttgcactgtttgaccactcgtcttattcaaaaaattttggaattattatttattttttttgacttactttattatccaaagtacttttaagcacaacttatcgttttttatatttgcacaaattttttaaataagacgagtggtcaaacaatacaaacaaaaactcaaaatcccttatattatggagacggagggagtagttacttaacaatagaccaacgtgaacactgaattatactctatgtagtccatcgatggtaccaccctgtggctcatcatgatgtgtcttaattttatcgtgttatggattaatgtgctgtactagctgtgctaggagctcgtagaagctagcgtagatcgagccgtccgtcgttggcccatgtgtgcgaatgtacaaatgatactcgataacaacacgcgcgcgacgatctctcggccgtccgatcgggcatcaaccgattggatttggaggggtccgtccgaccggccggccggctacatggtgcgcggcgggccgacgagctgagagctagcgagtataactgcgagcagtggcggcaaataaagtggcggttggggggtggccggctcgatcgctgtggaacgactcccccacgcaccgcacattggcacatgcgtgcatcgcagctgacggatcacgggatcacggatggcggatgaattgtgggattttgtcctatcaatcaatggggacgcgttgattagggctatatcgtgctacagtacttgcaatgccttccttttctctttctagtttaagatggatgttccctattaaaaaaaaagacaaaattggttatatagcatgaaaaattcacgttttttttataacataaaagataccggttactttaatagcaactaaagttcatcccgttctagctagtaagatgtaaattagatgattatttccaatgttcatatgtgatcttttgtttttcgagctagtcatatactgtgccaagcaaaattctctcagttataaatatatggcgtttcagatacgattttatgagct

SEQ ID NO: 7381 - DNA, 1393 bp, Oryza sativa
gccgaccgcatccgcgcgtcccagtccagcggcgtcttgccggacccccggctccctgggcaaaaaagaaaacacaactccggtgagaaatttacattctggcattctccaatcaaacacctccaaacttaatgcaatgagtatctgtaaaaatgaaagactgaaaataactctgccatagtactaccatccaattaccaatggaagaatgcatttacattccaccatgatctttggtgaatgttgcaaggaaataacaataaaaaaatataattagtgatccttcacaagagaaaatttgctgccatcacttggttgaaatcgcagaatactcctggttgttgtattggattcttggtaaggatagacagagaaggttgatatttttattgatggggtgaataaaaatctcatcttggactggtccagagttggtcactgttaaagaaatcgggagtaacaaacaagtagtatgtcttaaacaaaaaatgtagtgctaacttgcatgcatgggatggggtgactgttgcaggctatgcattgcaagaggacaagacatcttcattggttaagtacagttggacagcacaaacaagcacacgactaatcaatcagcgcaatagttggttcagtaggtctactaaagaagagaataaatatatcagtgcattacatagattgcatcctagcaagtactactataaatagactattagctgttcatctggccatcaattaagcatatctgttaggtagcctagtacattacagaccagcaaacacaccgaattgttagcttcttgtctagtaaaagcaaggagaaaatcaatggtgcgactgatcctacagcaatagagtatgcatcatcatttctaaatgtgcaaaactgaatttttctgccaagtgttttcaaaacattgccgagcaattaggcaaatagagctgatgagcaagtgagcttgctaacccactgggcaagatccaaaagcaaagctgtggtctctactctcttgtcaagtagtggagaacattgacgagcaggtagcagagggcactggttacacatatgtgggtggcagcactgaccggtgccatggacctactatagctatagtaccctgcaattggaggccaggcgagcaagaacatgcatgtgcaactgcaattgctcctgtgacccttctctgaattaccagcaagccgtagtgcagagttgttgccactggcagtccgatcccaacccaactcaaaaaccacattctctcaactttgatatctgtgaacactctcaaggctctacagcactccagctgatacaggctgcagctccaaattttaactgttttttctctgggagaaacggagccagaggattaggacgccaagacagtga

SEQ ID NO: 7382 - DNA, 1501 bp, Oryza sativa
gttgatctacaaagtccactctcttataaagtaatgcagtttgcccacatgatgaacaagtcaacggaagaagcaaattaatctgcgcccatagtttcggccgatttcgggtgggtttcatatcagttttactctctccggtttcattttaattgacgttttggacatcaaaattttataactttgaccattaataactttaaaaatatttagaaactaaaacaacaaatatagatctgtctttcaaagcactataatatatataatatataaaagtaaacatatatttatttattgtatatattataatagaaatataatgtcaaaggtatattttgtagaccgtgtcgttgtccaaaacgtcaattaaaataaaaccggaggaaataccatataacgtacatagaactctgcactgacacatgaattggaactcggaagtattctcaatatatacaaaaccatttgtaaaaagaagaaataaaattcaatttttatcactgctatgaaagaggttttcccaaaccgtcaaaatcaatctttccatgcggttgggctagccgtccgcacgagaaggtctgtaaagatcacgatttttccatgcgggtgcttatgaggacctcatgcaaaaataaaaaatcatgaaaaaaataaaatttcaaaaaaaaagccaaaccctaactcccgccgccacccgctccttcaccggcgtccctccccccctccttgagggcggcgccgccagatcctccgcctgctgtcgccgaggtcgccactgcacccaagtgcgacggattccccctcctcccgaggacggcgccgccggatccgccgcctaccgtcgccaagccacagccgcacccgagggcggcagagccgccaccgttgcggaggctgcgtagccaccatccgtcgcaccctcaccgtccgcccgccgccgcacccaacagccagcctcctcatcggcgtcgctgcccgcttccgcccacgtggattcggaggaggagaggagagagaacgagaggagaggataggagagaaagagagtagaggggagaaatatcagatagggaaagagacgggtgaaaaattttaaagggttgagaagggaaacagagagtaggagagaaaaaaaagagggggtatttttgcaagcggacaacttaagcgtccgctgcgaaaatagagttttgtatgtggctccttaatagcaccgcatgtgaaagtaggcttatttttgcatgcgcggtccgttacgaggtccgcctgcaaaaataattttttttgcatgcgctcctcttaacaagccgtatgtggaatatgggtcgatttttgcatacacggacacttacaatccgtttggaatctattgggggtctcgtctagaaaaacgttttctctagtagtgtatccttatttttcgcaaattctattttgcaccttaattctagaaccagttgttttatttactgtaatatttacaaacctgacaaatagcgca

SEQ ID NO: 7383 - DNA, 1501 bp, Oryza sativa
cttgttccggatacatgcaacatgaattcatgatcatgggtctattttctatgctcaaagactgaactatttattattcccaataagggttatcaaccgaatacttgcgccagtcgggattcaattattatatctattttggagtatcccataagagataatcactcagatcagaagctatttatataagctacacttggtctatatcacccggaagatttattactcgggagcatgttacatgcgtcatcctttgaagggtgtcgaaggcatattttttggcctaggcctaatatgtctgcagcccatatttttaggtgtggcctgtcacgttcttttagggacttaaacactttttgcttaggccaaagtgcgcgtgatcaagtgcccaataccttaaaatccttttataccgcagttactcaactttttaggagttggtacaatgcatcttaaaaaatgtcaaatagtaaagctttatatagctgccccgctgacttttttatataagtcaaggtgttgtttgggtttttaagcaattgattggatacaatatcgttgctttttgccacgtaagtgtgcaattttattgaccaatattatggcttaggctgattatatatattggtcattttccaggcggttggtaaatcctttatgagtttatttactcggattttacaccacatatgccgtatattttcgggtgtggtgaaaccatgtgtcttttagagacttaagcacatctgttaaagcagtgtgcacatggcgtatgcccaatactttagaaatttctttattcacagcattcgagcttttttatagctattttgctatgtgaattttcaatgatgtagtcaactttagattgctcacatcaatttttataaagcagtcggtatatcacttggatcatgttatttgggggattcacaccgcatatgctatatattgatatcaagtcacttggttgattacaattatcaaaaccactcggttggttggattatttattccttgactgtatgcttagtttgttcagcaaaccacatagtcgggggctacacctattaggtgcatctagtcgatgcacttgactttatttttcagccctccacagtcttcatatttggtaaaagtactcgggagaccatggcaaagatgattgaagcacttggctttggagtaatctggttcgagagaagattatcttttcgactgtgaaggtctcaggggctactgtggagattatgggtaccccatacccacacggcatggttatccgactagttataggggataacttatatctatggaatatataacagatcatgacttgggtattacgtttccttgtatattacggaacggcctaaagtcctggtttggtaatattgtaaagtagatttaggaaaccgataccgtgttggttaaggtttctatcttgtaatcctacccccccatcctatataaggtgggcaggaggccctctaggggcatg

SEQ ID NO: 7384 - DNA, 1501 bp, Oryza sativa
gaaaagtggtccccaccgtccccatggccccaccatgtcatcgatctaacccttgcgcgggtatgtcaccgctgagtagacaccggataacaaactgccacgtggacccgtggcccccacctcccgagacattaggaaattattttttttaaaaaaaaaagaaaaagggagatagccaaaaacgccatttgggcaaatctagctcactccgaaagatcaaacgccccacccgaaaaagctttcgtaaatcgagagagagaaaaaaagaatcgcgcaccggaaaggcgagaggagggaggaaggctgcaagccctagcgccagggcgaagcaaccggatgtccgggcgcgcgcgcgcgtgggtgcattgcgcgatcccttcacgctgcggcaagccagaggcgaccgggccgccgcgcgcgcgtcttcaccttcttcccgggcgccgatccatggcggagcggcggtggtagaagggtttcgcgagcgggcgtggatccgggggcgggggcgccggtggcatggcgctcttccgcaagttcttctaccggaagccgcccgatggcctcctggagatcaccgagcgcgtctacggtgcgttcccctgcctcgatgccccgtctatatgggattgtatgccatttgattcgttctgggatggatacgccattttggagttcttctatgcgtgtggcattgcggaatcggtaaggtggtgtgcttgcatttgtcatgcaagttttgtgaaatgtttcatcatttttgtgaaatggtttaaggcaattttacagttggggccgcaatccagtttattgggtagaagttgtagttagtgcagagattttggactgttctagaggaaattgtagtaaaacggcatagctgctatctgagcattaggctcgtactgtccaatggatgatatgccattcatactagtgttgtataaatatataacataaggtatttgctgaatggagggcagcttacctaacttctcatgagaagtgatcgttgtcattgttatttactggtgtccatgggaggtcttctatttaatcttggtccactgatgggaactcgaatgttcagtcaagattattttgaattaatgttacttttttgtttgcaattttaatttttttcctctgcaagtttaaatatttttagaattaacttagtaatggcaggtttaaatccgtctttgtatactcaatttgcttctgtttgctgtaccattaatttgtctcgtatgctatgttatgcctagatcctctagattatgtttccttaaccatttatgctttctctaatgatattaataaaatataccattctgctttttcagaattttgaaaaaaaaaatcatttttcctggtgattaataagatccatttatgcctttcaaatgtatgtggaaaagtaaatcttgttttgttgctaaaattctgtcgtcaatgtcttttccttctgtagtatttgattcttgcttcactacggatg

SEQ ID NO: 7385 - DNA, 1501 bp, Oryza sativa
cggccgggctcagctggttgcaccaccgcagccggcacgacttgccggagcgccccgggatggcgccgctgatgatgctccaccggtgggggccatgctgcgccaccagcctcgtcagcagcgcgtcctcttccgccctccacgaccccttcttccttgtcttgctacacatccccatttaccttcacttcaattccctagctagctcccctcgctcgtcgacaatgcaagcgcgctatatatcgcacttcattacctactgcctgcaacgtccgggcaaaattaaagcaagcaaaagtaataagtccattagcaagtaattaaagtatgacgcacgtatgcatacgtgtatgggcgtctggacgatgcgtaggtgcggccatgtcgcctagctagctagctaactcgtatatcgcacgcacgcatgcatgcaccgatcgatcgatgctgtcttgttcctaccaaaacgtacactacgcttactcgatcgatcacgtagtattcgttgattctttcttggtcgctcgatcgttttgggttaattgcaaattgagattatattggtcctagctagcgagacagataacgactacacgtcgatcgtacgcaggtgcgacgccacagggatactgaaaaaggaaaaagtacgtactattggatgcatgcgcttcaaagggagatagagatagctacgtcgaggtggcgagctagattacaagaacacggacggacgatcgatgtgccacgcccgtttgtgagaaaagctaatttaaccagcaggggaaaacggcatgcatgcacatcgaccatgcatgcctaaattacaaacagtaccagaggtaatatataattttctttcattctttaatttataccagcttaattgccgatcgaattcaccaccgggaagttatttgtcaaaatctctttgatgaatggccaatatatacgctatatatagaaacatctttattttttctaactgctaagagaagacccgtatgtaaaaataaggaggtgcccgcttttgtcatccaacgctacagagataaagagagaggggtcgactgatatatgtctattgagttggttttcccttcttttattgtcacatagacgatgtagaccaagaaacaaatcttatagttggagatggacttattcccggctgaaaacacactggcccagcaggccatcgtcttcgctaggccgggccatcctcttctcgcggcccagcaacccagctcccctcctcctccactccactccggcccggcagcgcacgtacaccagctgctcgtgcaaatgcgcaccagcgccgcccgacctcatccggcgccagatcgccccgccgccaaaccaatctttcctcgcggcggcgtttggtcggcgttatgtagggtaggtcccgccggcagcgaggagtagcgggcgcgatgcgtcaccgttctcttgctgctgctgcttctgcttctgcgccgccaccacaaatgccgccctc

SEQ ID NO: 7386 - DNA, 1501 bp, Oryza sativa
tgttaaaacagctgctcttccccacaaaaaaaaattgcagcgggcctgcgccatcggacaaagaaaaaacagctgctcttaagcacaaaatcatcccttttcaagggtattttcattttttcttagccattgtacaattttgtatagtgatgatttttattcacactaataacacatattagcacttcatttattttgtcattggattatgcttcacaaactctgtacccccgtcaccaaaatcctgtgtccaccactattatgaacctgttaatggactagaaaaaatacccgtgcattgcaacgggtaaatactattttaattttattattgttatatggtttagttagggtaaaattcattatgggaattcacatgaatattcttttaaagaaaatcatggactgcaatcaggagttcgtatttcatctcagttagcatacgaatttttttaaagatatttcttatatgactcctcttgtatttccaaaagcaaacaaacttaaaatccaactcacatacggatttgtattttcaaaagcggacgaacttaaaaactgactcaaacatatataacgtaccaaaatacgggcaaaaacatttcaatttttgctcattgtcaaggaaaaccacattcgaatcctacgcgcacaggttttcacttatttttgctcataaccaatatgcgtgtggaccaaaagtgtacatgtggatagtggtgaacggaggactaaacttgggttgcttgtgaaaataacttacacaaaacttttggctaaaatggatggtttattttggtgttttccttatcacgatgaaatcatccagattaaaatccacccgagcctttaagggcaaccacaatgtatgaaaaagatgaccttaaggcaatgattgcacttgtaaaaaaagatgaccttaaggcaatgattgcacttgtaaagtgagccatatacattgtggaaagtagcattagcttagggtgcaccttatgtttaaggtctaccacaagcaaaaagaaaatattttttctctctcattcacttcatgaacaagagatgaaacaattatttttccattctatgtgagcccatcttgtggctaaattctaaccatagcattatggatatggctttaacaatggctcactattcatagaatggaaaaataattttatactacaccacaaacattgaggatgccctaaggcctcattggttggcctaatgctgaaaataagtcaagctcgttaacaataaaaagttatagatacaacttttatatattcttaccgatataatatttaagtgctgaaaaataaactttgacaaaaaaaatcaaatcagcttcagaatttagtgctaaaattcatttttttgcagcagcttgcatgtaagccatatggcaaaagatgtgaaccgttggcatttatacatgaaattaccacttgtagcattgaaaataattccctacttactgcgcgtacaccatcttgtacaa

SEQ ID NO: 7387 - DNA, 1501 bp, Oryza sativa
gaaatgcaattccatttattaaaaatacttccttatctcaaataaatcccagaaaaatctaggaactatagatttaagcaaagtatttagtaaaattttatctggccccattttatattgaaatttattatttaaaattagatcttctcttttaggattttaagatcatttctaataattccttttagacaacaatttataatttaaggatttttaaacaagaaaagcacttaacataattataattagatcattaattgattaactaattactgaattgttctttgtatcaattaggaattgagctctgaaaaaatccgagaaaatttaagagagtatacttaatcatagagaatttaataaaaattaaattcatccatcctttatatttaggaaattttatttcccacatttaacttcacttgtaaattaatgaacatttaatataaattctattaataatttattagataatttataaatcctgaaacaaaaatcagactgtgacaggtattggctaactcaggattccaagtgtagtgtttgagagggagacgatcagacagagatagagatagagacggcgagaccgagatagaaacgacgagttgggtaaatccctatgaccgttctgtaccaatacgtgtcatccatggggacagacctccgcacgtcggagaggccatccgacaatagggttttgggattcaattgcagagaaatcttgggcctcatctaaatggatgaaatttggaaattccgaagatcgaacttagtcctttttttttttcaaaatcaggaaacaatgggtaaaatcatcagaggatctcatacaaatatcgacacacataatccattaacaggttcataacagtggtggacgcaggattttggtgacggggtacaaagttagtgaatcataatccaatgagaaaataaatgaagtgctaatatgtgttattagtgtgaataaaaatcatcactacacaaaattgtaaaatggctaagaaaaaaaaggaaaatactcttgaaaagggatgatttgcttaagagcaactgttttaacattgctgatcgtgcacacacaaactatacatgttaaatcacatttgtgtagatgtgaaaacacgaggcctggaagatctgcttaacttcagtgcaggtccaaaaaatcttgcctttaggttcgtgagcgtgccagttgatttgatcctacaatcaacaagaaataaagacaaagaaaccgcggttaaatccataaacgatagccgatcggctagttgccgatgatatatcatttatctccaagccgatgtcatatgtgaattgatcggcaatcatgaataaaatgaaaaagaactaaatctactctatcggctgtagatattaacaatatgtagtccttatgtcgatatatacttaaatcaaatgattgggatatatcggtcgccacgccgagacagtataaatcactcagatcgaaatatatactaacaatgag

SEQ ID NO: 7388 - DNA, 1006 bp, Oryza sativa
aatagcggtgctcgcggttattgagcaccgggacatgtattacacttggctagactctaaattctttaacttgtgtgggatgggatattgcatgatgatttttatgctgatggagccacttcctgagaggcggggaacgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctatgaattcgtgtgtaccagactacttgatccagggaaatggtactgtttacacaattgattcctgttataaaaacgggggtccacagagctggtatcagagccatacgactgtaagaaaagaccaaaaggcgccccaccccttttctaagttggccaagggagaaattcccatttagtaatactttcaaaaataaaaacgctatgtttacaaaactcggtacaattttcatcttactcttaactattttctttacaaaacaagttttactctcaactgactttgggtttttcttaaaattagatggcagatccggattcacccgctacctgggagt

SEQ ID NO: 7389 - DNA, 1501 bp, Oryza sativa
gaaatcttgtttcgacaatcttactacaccaataagaaaaatccgttccatcgaaaacatggagcttagttgtaaacttattagccatggcaaaaactctagatcggttaaaattcaaagaagaaaacaagactctgatacgacttgtaggatcgaaacacaagaactaagccaaccagagggggggtgaatggttggtatacccaaaaacccaaacttcttgaggaaataaaagttaccctcgaatcgatgtagatcggtctgactgcgcctgtgccgccggtctgaccggtgttgatcgtctggttggactgccctggaatcgcctctgcctcctgaagccgtcgccggtctgaccgccgatgagttgctagttagaccgccgaatccgataaaacacaaatcgacgaactctcaaagtatatgacaactttattgcttctctctgtgtttacaaagtgcaacagccacactccttacaaaaatcttgactaaacttgaaaccctaactaaactatcaactcaattgctctaaaaagcactaccgggaagcctcacgctccctctctatttatacatgaggtaggcagcctaaagccacgaaccaaactcatactagaagtcctaatccgcataggaaacctcatcgtacaagaaacaaactttacataaccaatcataccaaatttggactccttccaaattcgagtctgcatcccatacacacacaatacctccatcgtatgcaatatggaatcttcaccaaccacgtgcattgaactctagcctaagtatcccgcatgatatctgaccatcgcggacattgcctttccacgaagtcgactcccgatccatcgccggcaatactatcccgaggcatcaagtcacctacacatgaaacaaataaagaaaccatattccgagaccaagctatctccaacttgactcattagtagcaaacaactgtattacatacgcatagtatccatctagaagccataatcatgaaacaataacggatatccaaataaacaacctgaaaccgaaaccgacacagagtcggccgatcagactgcaggctccaccagtctgaccgacagcacatgcccggtctgaccggaccacatcacgaccagcagttcctattcacctgcaaattccaatcatctcgaaaaccacttcgtaaataaattccaaatatcaaaaccaataatcttagatgccaattattcatcacagaataataatcaaaaacacctttgattttacacatggcctctcctgtcctccagaactatgcgtctcctgcacatgccctgtatcttcaccatgaagacgagttgctaggctgcaagactactgctcgtgacttcctgagacaaaatacgtaagtgtttttctcttctaaggcggtgttcccacatagttgttcccatccgaaacagtaatcacggaaaacggagtggtccattagcacgtgattaattaagtattagctaat

SEQ ID NO: 7390 - DNA, 1501 bp, Oryza sativa
ataccaaaggatggcatagtatggtttcatttgcataaataatatttaataaacatttcagaatttaataaaacagttaagtaataattaaacaatattaatccaacgctatacaacataccatgttgcataggcccaaccattctgaacaaccttcgcggctgcacagttctatctccaaaccaagaattaaccattccaaaccaggagctaatcaaattattaccagttatagcatcatttattatgatgggaagtgtgagactaatcacgaaagacattgttacacccgcccataaccgcgggcacggctattcgaatagttttactctggccagaggtgtaccactgtacccacaagacacggccccacgacatgtcaccatgcgcctcaataccaccacggtacctcggaaaggagctgtgacagtacccctcacacaacacaatccaccacagcgcaccgttcctggatcataatcacccccttataaacaaggcatggactccccagtgacccccatgggcttatctccgccacttctcagtctggtgctccacaatgaaccatgctatacaacaggtaaagccgttgcccacgctggcttgtggttggtacggttaatgtttcacaaccgaaactcgtgaaccggtccttaattgtcatgagcacgaccatcaaaaccatgtgctcacaacccacctttatcaaattttatttggcaaattaattaattaaccaatcacgattgaccatcgtgagcttccattaaatatccataagtgatagtgaagtatgatttatcccattaatgagctaatatttctaagcacggctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacaggttcaacctgctcaaagggttgtttgggatctgcgtgacttgccttgctggccttggaactcttcaaattcttctcctgcgaaaacggactctccggaaatgtcggaatctaaatagaaaggggcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaattagattaaatcatttatttagattttaattgaattatgacgcaataatgaattatttttgaaaaggaaaagggaattattgcgtcagcggctagggttcgcggtgaaccgggtgcacggcggcggctcacggaaacgaacggccgagatcgattcatccaaaacggacggccaagatccatcggtccatgaccgggccacggggaatgacaacga

SEQ ID NO: 7391 - DNA, 1413 bp, Oryza sativa
acaagatttgggtgtgacagttgcccaaggtagttcacttcggcctgcaaattaaaatgcaagttattatatactacagtagtatatcaatcaagagttatgcagaaagaaagaaaatccataccagccattccctgtggccctggaagccgtcctggttgagcttcttgacggcgatgaccatgccggtgccgggcctgctggggaggaaggtgttctcgtccacccaacccttgaagacggagccgaagcctccctcgccgagcacgctgtcgggccggaagttcctcgtcgccgtcttgagctcgttgaacgcgaagctcctcacgttggcacaccgcaggatctcgccctcgctccgtggggtcaccgccgccaccgacgacgacacccggctgctcagccccgtccccttcctcctgcttcctgatcttcttcttcttgaacctgaccaccaattaatgagctcatatcatacgcatgcattgtcaatttaccaaccagttaacgccaccgcacaatgcagaagcctcatctatataacaacttctttctcagattgattgagatgaccataatatttagttacaaaagtgaatgatttcatactatactagtccatcaaggattagtacaagatgatatactactagtatgtgcaggcgtcgtcctgtctctgtctgaaaccgatcgcttatttcagttcaactggaactggaaacggcatgatctacctaacctactaggatcgatttcaacaaactcaagcaattaggaatgatcaacaaattgcaggcaggcacaaacgaacatctccattcctaatcatacatgcctcactactcagcggttacttttttacttgaatcaagaatctatctactcctagtacgtcctatgcagctagctagatggtgaaatatatacgagagcgaattgaagaagctagattaccagatgcgttccgggagatggcgtcggagctaatcttggttccgcagcagttgcccatggcacgcaggggatggagagcgagctcgctgctctgatgcagggaaggaataggatgcaagggaagggcagctagttataaataaaggtgagagctttgctttacaataaaattaagatctctacagctagtaataaggcaggtctgaacaatggatcacgggatatatgagggttgagcttgattgtgtgctactgctactgttagctgcctcttaattcctgcctgctaattaaatcaaaggttgaccttctggccccctctctctcacgcccacttgtgattaggattattgtgggtgatggatggatcaagactcaagagaagagatcatcaaagtcctggatggggatggaagatttcagaccttgaagctataaaggagcagcctctgtttcctt

SEQ ID NO: 7392 - DNA, 937 bp, Oryza sativa
gggcgcgccctcgcggctgcaaagtgggcccggccgtcagccgcccgcgcccgcgggtgcgtctgacgcgtgggacccacggcgccggccgccgccagccgcgtgctcccggtccactgtggaccgagaggctgacgcgtgggccccacccccgtggacccggtccgcgcgtcccctccctcggctgacgcaataaatgggttttttttaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgctattgttattatttccttgttcaccctagaataaacaaaaccccaactagtggacactctactcatggtaccactagtatgattttaggtagatgcttcgctatttaattaggtaacattaggtggttttacaactctagactttgggatattcatttcacctggacactttggaattgttggagtattgtggaattggattcacaccgccccccctattcaaaatccccaaaaatggttttaggctgggctcggggtgcatggttttgatagtagcaccttcgccatataaggaccggt

SEQ ID NO: 7393 - DNA, 1501 bp, Oryza sativa
ctcatccgtttgcggtgctttgatttgcagccctttgggaagaagggctaaaatccaatgcgagctcgccatagttttcgttcgctggccgcaactggtgagcatcgtggacccaaatccattgccgccaggcagcatcagtgccgtctgctgcattgtcgactatcgccgttagggatggatttggaacccacggtggacgccgccaactccgaccgtgccagaagtacaagtccggccgcatcgccagccgccgtcgacgaggggcagagagggagcagcttcccctgggaaaacacctcgaaggacacgcaactttccttcttactgcctatatgctcgattccacggcaaccaaacgcgttcgtcaaagtagaatccacgaagccaatctggtgattcaagacgacccgtactagcagcggcggcgcgacgacaacacactgagacaattcgctcaacaggcgaggatgcgacggtggcctcggtgagggcgtcgatgcgatggcggccgctgcggcgtggatgcgacggcaaggacacacgagttgggatggcggtgagagctcgcaagggacggaaagcaggaggattaagaactacgcagcgacgacatctgacggcctcacctacctttcggtctcccgcagcgacggtgtcgttcctcaccgatggattttttagcccgatcctacccctcctaaaccaacggtcagatttaattggtacctggtacctcatagtaccttctcaagaataggaaaaaagtatactactatacttattgctattactgttactccatgtgaagcccatacaacactaataattatagtgacttgagtagcaccataatattctaagtttaaattttcatagattaagccaatgtgaactgttctccatagatcaagttttactgtgatgtactgaactgttttttttttcgtttttaatttctaggagctgaaaaaattaaggcaatgtgttgaccattcgatgttgatccaacggatggcacaaatccccacaccgcacgacacctcggctaacaactggctgagcgtcaggcaaggcaaaggggtccgtcctataaataaaggaaacagaggctgctcctttatagcttcaaggtctgaaatcttccatccccatccaggactttgatgatctcttctcttgagtcttgatccatccatcacccacaataatcctaatcacaagtgggcgtgagagagagggggccagaaggtcaacctttgatttaattagcaggcaggaattaagaggcagctaacagtagcagtagcacacaatcaagctcaaccctcatatatcccgtgatccattgttcagacctgccttattactagctgtagagatcttaattttattgtaaagcaaagctctcacctttatttataactagctgcccttcccttgcatcctattccttccctgcatcagagcagcgagctcgctctccatcccctgcgtgcca

SEQ ID NO: 7394 - DNA, 1501 bp, Oryza sativa
aaatcagttcggaaattactagtgaatttccgggcgtgacagccattaatggcgggcgggtcttccgcgcccattttccccttctccggccgccctctctcactcccaaccctatataaaccctccccgagctccccaccaccgtttccgccactcgccgccctttctcctcgacggaatcgagctcgtgccgtcgctctctctctccgccgtcgccgtcgagctccggtccgccgccgtcgtcgccccgaaccacctcccgcctcggcgccgcctccttcggcttcaccgcatcctcgccgacctcgtccaccccttcgtttcgcccgccgaccgccggaacgccgtcgtccccgtccacccgagccgcgccgccgcctttctccgctccggtcgccttttccgtcgtcgccgtcgacccggggtgagccgtggaccgccgcttcgtttccccctttccctcccctctctcggccgccgctccgccgtgcctatggccgccgccggcgaccataggggcgcgggcgcgccgcctcccgccgctgcgccggcgtggccgccttcgggcgcaccctgcggctgccgtgtggggcccggccgtcagccgcccgcgccctcgggtgcggctgacgcgtgggacccacggcgccggccggtgtgagcccgggtgcgcccggtccaccgtggaccgtggggctgccgcgtgggccccacccccgtggacccggtccgcgcaccccctcccctcggctgacgcaataaatcttttttttaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctatgttcctgcttgttatatggagtttattagagtaaaagcctttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatattctcatcacctggacactttggaatggatggattattgtggaattggattcacacttccccctctattcaaaatccccaaaatggttttaggctgggctcggggtgcatggttttgatagtagcacctcggccatataaggaccggt

SEQ ID NO: 7395 - DNA, 745 bp, Oryza sativa
ccgcgcgcggagatctcgggcgccattgaagacgccggcgtacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgcgacggcgggcgcggcgggaggaaggcgatgacaggtgggccccacccgtcagcgagagcggcgggcgggcccgcctgtcagcggcgcgcgcacgggggaggagccgatgggccggggggaaagagagagagagagggaaggaatgggccgagccggcccaagaagggaggaggagggggaaaagacttcttttaggattttctttttataaaccttttcaactttgtttatttcttttcaattattatttgtgctctgaaaattgcactaaaatttgagggctccttttagaccaaggagaatttaacaaaaattctccgggccacatttgaatttttcttgtacgtattttagtgtttgccaatttcttttcgaattttaattaattctattattccttttagaagatgatttttatttcgggatggatttatcaggacgtggggcattgctcaacaccgatcaccttgccggcagactggtcaggcgagtggaggaccaaaaattcggtctgatactcaaccaaacacctcgaaatcagc

SEQ ID NO: 7396 - DNA, 1501 bp, Oryza sativa
ggcacattccaccgtgcactttgcaggtcacccaaagagcgatggaatactaaaaagcattatcaacatatatttccttattatacatcaatctagaaatatgaatcgctaaattaaatcaatattattaaaaaaatgtaaattcatgttttaacggtgcgcaacatccctaacattttacgtgtcattcgaatttccactaaagattttggaataattcaacatcataagttgcactatcatatattattttgcaaccatacgtaactaaactaattagacattccgtacataaaaaatagctcgaacacaaatagtccaagcgactacgtagaaataaattcatagggacaatcatccgaattgccaaaaaaataaattaattcaacaaacaggttgtaagtacattgtttcgcaagcaaggtataattaaattagatatacactacataaggaaaataactatctgaaatctgatttgtataaaaaaaattggtgccttcagttagagaaaataatccgattacttcatgattacttttgcaattaatatgctcaaataatcaaaacaagtcaaatgatcttctgcctaagtgttttaaacttattttatttatcatttaatcgactttagatgatggttgctttttactataaagccaccacctgttaccccataaatactcctaggccttttaaatcgatgaactcattatttctaatggttagaaataatatttatgatacatcgcattcaaaaaatatatattgcacaactatatttcttcatccagcattattcacactaggttgcaactctatatggaacgttcacatatggattctctctcaaactaaaaaataatatttggctatataaacccatatatttagtggagcctcatatctcaccgaattcatccgtcaatgaacaatgacaacctatattcaattaaaaaacttcttacttttgactttacacttaatttggtatacatgttttattacacaaaataaatctaccttctttttagatggtgaaaaatattataaataattgcttggagggattaattaaatatgatatgttataaagctaattaatagctaggttagaaaattataaaagcaatgctaataaaaacaattatggaaaaatcgtatacatgagatgttcatacaaagtctgtaacacataacacatgttcgcgcgaatgcaaggctgtctttctagcttgtcccaaagtcatataaaaaaaatagggggagtaagtattacgtaggtgtaggtggctcaaaatagcaaaaccgtttttcttttcgagaggaaggaacactgattgcaactgtggtacccatgcactgtgcatacaccaataagatcagcatgcagccacgtggtagatgggctatcactatcagcacccacctatccttatcgtcggcaccctgtatctccacgtcgatcaatggccaccacacagctgcatcggctgctgcc

SEQ ID NO: 7397 - DNA, 1501 bp, Oryza sativa
gaagattatggatttaatgatgttgtaaatattactatttttttcaatagagttagtcagacttagagtagtttaactttatccaaagttaaaacgtcttgtaatctgaaagagagggagcagctaattacgatagtcagcatgcatcacatgcgtttgcatcacagtacgtcgctactagaaaaagcatttttcttaacgtgaggaccttattttcacagacggacgtgacccttagagccaaatgacagcctacaaaaatataaatcggggtaaaatttgatgcccgcttgcggaaggcacctgcgaaaatcattttcgcaggcgccgcttaagtggtccgcctgcgaaaatagacttgaatataaatagatttgcgggccctaatttctttctaagtcctcacacctctcctcccttcctcaccagcctctctcctcccctctcctctcatactctcccctccccttacttatactctccccagcggcgaccgcgggcggtgacggcagagggcggcaacggcgaggaggcgcggctgaagtccgggcggcggcggcgcgggccgggcggcggtagcagttcccctcccccctccctcctagatctggccagaggagggagggggaggccggcggcggcggcaacggcgtggagcggcagtagagtgggctgggcggcggcagcggctcccctcccccttccctcttagatctggccggaggagggagggggaggccggcggggttgacggtagcagctcccctcccacctccctcccagatctggccggaggagggaggagggaggccggtaggggcgacggcggcgacgacggcgcggggcatcctcatcgtccttgccatcctcgtcggcatcatcgcgctcatcgtctacctcgtcctccgccccacccaccctcgcttctacctccagggcgccaccctttgccaactcgacctctccaactcctcctccaccgccggcgcggggcggcacgcggcagccggcggcatctcccctccctccctccctcgcagatctggccggaggagggaggggggaggccggcggggccggcggcggtgacgaaggtgcgggacggcggtgaagacgacacgcggggcgacaatggcatggagcgcggcggcggcgacgatgacgacggcggcggctcccctcccctctcagatccggccgggggagggcggcggcggtgagccgcgtgcggcgatttttgtttgttcgtttttttgcattttctctggcgggccgttgcgccgactgcgaaaatcgatcgatgattttcgcagtcgttatgatgcaggcgaacctccctcccgcctgcgaagattagttttctagtagtgcgtacaccgtaatcgcccacgtatatcacgtagcaaaattagtcaaaagtgcagagtgtatgacaataataatgttgtacacgtacgacatggccggcggctcacctttccggatccgagggatcatcgtc

SEQ ID NO: 7398 - DNA, 1501 bp, Oryza sativa
taaagcctcgaatagcacctaggcaagtgtggagacctaaagaagtaaaagttaagagaccggtgatttcccatagtagtagtgataaattcaatttgatgagagaagaatcatcggtcattagagataagtctcctccacatgatgctatgggtgttagtgcggtatccatcttgccttcgaaatcgtgcagtcaagaaagccgattttgcttggggggcaagacattaatatgctcatgaaggaatcaagagagatgaacagcgatggatacgacatcacatctttgagccgccgtttgtcagatgctaaggcaaggtatgagtttattgtgttcatcatcatatgatatgcctatgccatgttagaacattgcttactatctagcacatgtgtgtttttgcttatcgaattgatattatacatacatgttgcaaatgccagttctaagtagtggaattggtaggttggcatataatttgtttgtagtatgatttggctcatgagtctttgatatttatttaaagccaaattgtatgtgtttttatggatcaccatataagatatagattttataattattgcaccatgaaagttttgcttattagtaattcggctaatgtcaatgatcaatgtgatgatttattctagagttgttttctttagaaacattggcattgttaatattttgcattcatgctcaagccgattacttacatttgtagtttattggaattcatgtgtgtgaggcatatgactttggtgattcattattgatcatacttcaattggctaagtgttttgatgccatgatgattattgtttcaaaagccatttgaattagtattcatctagacatgttagttggatgctataatttttcatatgtctagagagaagaaattttggtccaataatttgatacaccaagcatctggctattatgtgaagagaaattatatactaaaggccgatgcttgatttcaaaagtttggacgaaattggcaaaatcatagaccaggggcggtctgaccggcattgcacggccggtctgaccggtggtaccggcggtctgaccggctctacatggccggtctgaccaggtagacagggcagtctgaccggcattgcgtggccggtctgaccgatcccagacaggaggctggggggcacgttacaattgattaaaaggccgacttaattgtgaattcggacatttgtgcccatgagttagaggtagcttggagaattcatttgattagatatttgaatgatcctacacttaaggttgatcgaaagattcggcggcaagcgctcaaatattatatcgccgaaaaacagatggagtattacttagataatgatcaatctaaagttgctaggagagtagtacatgaagggatttgtaaaattcatcaatcggcccgtaagataaattggttgcttaggagagtggggtttcattggccgaaaataattgatgattgtttcaaatgttata

SEQ ID NO: 7399 - DNA, 1501 bp, Oryza sativa
aaaagagacgtatgcaagggtttatacaggttcgggccccttatctgatatgtaatagccctactcctgttggtcgtagccgatgttgctttatattcatcagaatcacacaagtacaatatttgggataacctatctagttgtcgtcgacttggcgacatagataaccaacacgtagtcgacgacagggtagtctttctcctcgagtacgaactcattgagatcagatatggcgctatatccatcttgtcggcctccgcaggcaccattaggtctatctaggcttatctctgatgtcgatgtttgacggcgtgtgttggtgtctattctgacttgtgtgtcgatcggtctgtccctcctcctcctagaaggtcttgtatttatactcatagatgttctcttgttcaagtagaattagggagaccaatatggatacaatacgagtaatccttgtcgttttcatatagaactctactcgtccttcattatccgaaactctttctatatttgagatatgattccatataagacttgtgtatggtgggtcctgccgagcttagtgggtatgtggtatccataaccatgacaatactcttcttctaatatttcttatttttttaattctgaatttctattatttcttaattgtatttctatatggacttgatacccttcttctaatattctatattttttaattccgaatttccgaatttccgaatttctgttatttctaaatggactctgaccaaattttaatttttctatttttaaattcggaatttctattatttctaaattgtataccggcatggacactagtctctttttcaatattccttaatttatttctagactgtaagagcaaatgtggaggtttttttatttattactttaataagttgttaatagaagatttctactggtagtagtattcctactgtactagagaagtatgcaatcaataatgtacagtataactctgttgacttttgaatgactagcaaagttagtactaactaagtacactaatataaaaaaaagacacacatatgcgcgcggtcagtagtcagagttttgggcttagaatgaaggaacggagtgaatggtggatgggcctttattgggccgtagcaggcagaaggaaagggaggcccagctaagggccgaatgggtcaattcacaagcacgcgggcgggcggggggagggatggattagggtttccttccttccctgtcgtccccgccgctccactcccactcccactgacccgagacgccgccatttccgcctcttcttctcttaaacaaaaagccaacccctcccgcccccgcccccgcccccgcccgctaaaccctaaaccccaaatcgctctctccatttcccgccgcctcccctctcgcgatccatatccatccatttctcttggctctccgcccgatcaatcgatccgcccccagatcgcggccgccggtagctagctgcagctgcagatggata

SEQ ID NO: 7400 - DNA, 1501 bp, Oryza sativa
cctacccactctataaaaaaaaccattccttcaatactccttgggatacaaagaatagatttattttttacaatatagggagtgtgtattacacatgtgtaatctttttcaaaggaattgaatggtgtataaatgtacacgtttctcgagctactaaacaatatttataatttatatgaatgttttaaagatatttattttaaattattttaacataataatatttaattaatttctttgtattccagaatatcatcgcaaatcattgaactatttatccattcagctgttcagcgatgttgtaagaatgtaaacacgtacacatattgatcagtaagtactctctatgtgtctttttgtttgttgaactaaccaacatcaaatattgaggaatggatcgccatggtttagaatttaaacccttataactttatatatatgctcaatggcacacaactgcatgcatgcgctgcctatcatccatggccttttgctatatatgactttttacccccggcgcctttgtattgtttgcgtggacttgttccacgccttccacgatgacattgatgtgcaatacatctccatatatactggcatggcatacacatccaacgctgcctataggaaaggagcaatctccaagggtacttgtgggaggctaattctggagaaaactgcatctggtatgaacttagttactcttctgataggcacggattgaactgcctagctatttcagctgaattttacagaattattaatttcttatatgtgtatatatgtgtagtttccaatgagagctagcaacatttatatgctcatatcatgcttcatcagttataaactgtacttcactcatgatcttaataaaattggcctgggcttctttcgccgccggccggtgattttttttttttttgctaaatcagttagatgtcaggaatataggaattggtctaaaatcttaccagtctgaatttctcgagggcagaaagttactaataaagtaggtacaattaaatgagggatgattgtgagtggatgataaatagaagtatagatgatgaaattgagtgacgtagagttgtgtttggttgataatagaatattggtgaagaggttgttatattctaggacaaattctgaaggctaaatgttgttatattttaggacgggaaataatatattgacatgcatgcgtgtatcatatcgttaatagtgttgtcactatgtagttctacattaataaaacttgcgccaaatatttagctttatgatatggttgcttaattagttatgtagttttgtgatggtttgtcaaacatttaagcagtctaatagttatgtagtatgtttttcgttttatacttcatagctgaatgtacgagaaaagaattcaatctcaccttatcttttaatgtggtctcaatgactagattaatttaattagaagctactgattttaatataaaaatattgatgaaacattatcatggtt

SEQ ID NO: 7401 - DNA, 1501 bp, Oryza sativa
aaatccatccaaacacgttacagtgcaaccccacgagtgtttatgggatacctctggctaagtaaatagttatcacatgggagtttggtgtgccaatggttgtgggatgccgaggatgagagaagacgaagttttggattcttacaaccctttttgggtagccttattgcctctattgtggcacaagttaccaataggagtaggagacatcctcagtattcctaagtggatgaaggctgatcttgcttgatgctcgtctaagagacttggcccaactaggtgacatgcgatttttatgggttagctttggaaaggccttgtcacaaataacttagttgcctaggtgcttcacttagtgcctagttgctcagtcgcttagtttctcaccgcttttagcttccggctgccgcttttatgactttctgtgatgccgtgttgctcatatataggcctgtccatgatgtcaacttatgtaaagtctactttccagtgatataataaagtagtttactttgattttacatttattctgtgtataccagctagtatgttctggtaatatattacacatgggtatgagtcagcttgttttatggctaacgagtgtcagggcgttacattctcactattccaaaatgtagtaatttaaaatcggattgaatatttcttagtacaataaatctaaacataaatcttatccagatttattaggaaaatgccggcgctcgggcgcccgacacgcgtgcgcgcggatcgggcgcctcgtgcaggcggccccccccccccccccacgcgtcccgccacatgtccccaccacaacatgctatgtgttcccaccacacactccgttgcaacaaatcacccacatattaagggaatccgtcttattttttgttccacaaaaaatgtttcacctagtgtacttataatatttcactatgtatagatcaatgttgcagtgaattgaaacattctttcgtaacaaataacccacatattatggaaaccctctgttaagggaatccgtctcattttttgtggaaccaaaaatgtttcacctagtgtacttataatgtttcacgatgtatatatcaaatgttgcagtgaattgaaacattctttcgctatttgctaaaacatttgtttttatataaggtgaaaaaaacgttagattttttaggaaactgttgtttcatacgttgtagcaaaatatttcatgaggtgatttagttgtgtttcaactttttaaacgattaaaacattttcaatatacttagtgaaacaattctgatctacttggtgaaacaacatgcaacatttaaaaacaattcaataataagctaaatattttttccatcggattatatccatgtgtggtcttgttttaaagatttaattgtaacggatttagtggtgcaatcggatcatgatttggataaaaaatttaagagaaaaaatagtttaaagttcgcttaggaagttttgcatgtatgtgtcgacg

SEQ ID NO: 7402 - DNA, 1501 bp, Oryza sativa
tatgaatttagacaaagtactggaatatatatcacatccctccaaagtcccttatattttgggacggagggagtagtggcgatgaatttaccaccacccaaatagcatacgagacccacaacatagtgaggcaagactttcgctatctcccaacctcataggccacaaacagcttagtaggtgcatagaaaccgatagcaaaagtagcatcacgataatatatcttatctatctattataatattaaaacagtcttgaaaggatgcaccacattcattgtggaggctataaattcccacattaatcagagaaaaagaaaagaagaatccaaatagaaatacaatctaaaaatagctgaaattcggaattaaaaatatgcaatattaaaagaggagtccatataggaacccaatacgtgattaattaaaattcagaataaaaataaaataaatctcaaaattagaaaaagaaaaggaagagttcgagtgggaatacaatttaaaaataactgaaattcggaattaaaaataaggaatattgaaataagagtccatacaacaatccaatatgagattaattaaaactttgaataaaaaataaaaaaaagaagagttcaagtagaaatacaatttaaaattaacttaaattcggaattaaatataagcaatattggaataagagtccatataagaatccaataatagattaattaaaattcggaataaaaaataaaaaaaagatccaaaattaggcaaattaaaaagagagttaaaatatgtacaattttgaaacaactgaaattgaaaataaaaaataaaaatatcaaaagaacacaatacgaaaaataaaataaattctgaaatcagaaaaagaaaaataagatctcactagaaataccatttataaataactaaaattggtgataaaaaaataagactattgaaagaaaagaccatctaaaacacatgacgagattaattaagtaacatggctagagagaagcagagtggtggtggttgataatcagataaaatcctaatgacgattaaaaggaaggacggcgggcaggtcgtgaagcaatcggttaatgcggttggcggggacttctagaaagtaaaaaaaaataaatcccaatgataatcatatttaatttttaaaatctcaatggcaataaaaatgagaggcagcaggcgggtcgtataggagtacaatgacagagccgccgatggttggtgggtcttctagaaagtaaaaaatgaattccaatgatagttatgtttgatttttacaatcccaatgacaataaagagtatgcggcggacgagtcgtagaggagtatagtggcagtgtttgacgggttttctaaaaattataaaaaacatgaaacccaacgagacaataaactctaaaaactataaggttcaaattttaaaggttcgggcttctaaaaaataaaaaaataaaccctaatgataatcatatttgatttttaaaatctcaa

SEQ ID NO: 7403 - DNA, 1501 bp, Oryza sativa
aagtcctaaggttggtgcgtgtacctctttttcgccggaccgttggtgcgtacctcttggctgccgctatccattttgtttaccaagagaaaccaaacaaagctaggagataaaacatactattggtgaaaaatcatctaagaacagaagaaaacacaagctaatcaaattcgattgattttccataaatatttgccaaacgataggccttgtgatctagtactccttccatctcactagctaaggcacggttagactcaacataatttttaaaactactctttaattttaatttttttatatactacgatatttatagtaacaaaatcacaatcatctgaaagaaaaattaaatgacaatcaacgatattattttcatcaataaaatttaatttataataaaatatttaaagagttcgaattgtaaaataggtgcgcatcttagtgaacgggacgaagggagtactaactaattacgagatggtgattgacctctaaagggggcaaggacataaaaacttgaaagtacttctgtttttaaaaggatggtgaaatatatatagtcgaacataactttaaatcattaataaatattaaaatattaggatttaaaatatgaaactgaagcttaattatattagtaattttgtcataaatattttttatatattttatacatgtatagttttaaaaataatgactctgcacaaattcaaaacgacgtgttaaaaaaagatgtgagcaggagcgtaggacgctcttcgagtcaacacttgaaggccttttacgaccaaagacgaaagcgttggtggccgtttccctgcttaggccgccgctgatcgttgaactcctccattactattgaacgtgtctcaccaacccaacacatgaaatgttctttttttcgaggataccgaaaatggttatgtttcggccaattgaggagttaatttgtctttatcattttggttactgtccatgatttgaccaatgtacgtaaggtcaacggtaaaaaaattgacccagagaggcccagagggggaaagcatgctgaagagtaatttgcaaatcacagctgaaaacgggagaaacatcagataagtcgattacatttgctctgtcacaggctcacagctttcctcgaaaaattttttctctgtcgcagctcacacagctgcagacaagtgtgagcgtctttttggcaaaaaaggagaggatgatttgactacagttctcagcttgatataacatggttaccaacacgactacacgaagcaaccaatgtcaaaattgtcaatatgttcctacagtttgcatgcaagcttcagaaaattgggatgaaatggttggttccagttgatttccaccctttcaaatttcgttggcaggatctatcttttctccccttattatgtggtatgacatttaaatgcttgtcattttttgaaaatcttaatgcccgtttattttgtaaatgccctacaaattttgcggtatacat

SEQ ID NO: 7404 - DNA, 1501 bp, Oryza sativa
acatacacacacatatctcactaaaaattgtacaaaaattattgtttgtacttttagatcgtcaaattttatacatttatactccttatactgtcaaaatttttatcccttttattatacggctatgaatttaaagtaatactttacacataagtgtaatactaaatgcctaatgcatgttagctaaaagaaagttacaaagagtgattgtttcgagtatataaattccttgaattataaattttagagtaaaaatttttaaatcatgacggcaatcatgaaaagtccacattacaataataattatgcttgcagagttatttttatctatgaaattatattcgtagtctatttgaagtcccacgcactctacatgaaacaatgagttatttcccacaatccaaaatcaatttagactcgactagacttttttttttgaaatatttattgtgtcacatgcaccaaggaatgcattaatcaacaatgagaaaatgcagcatatagagaaatattagtaggtacatcagctacacgatacaatagtaagttctaaaatatctagccaattataccacataacaaaaagaactatcaagttctatcaagttctatcggttgttggcaaacaataatatgggcacaagtaccattattttcacttttccaaccttttaattgtataaataattattttcatcccactactacacaaatggttcttgcgagcattcttttcacatgtgactcaaatgtgcagcctcctatgtgccaagcctcttgcctcaaactcaaggttcatctttgaaaataacttttgcaatccttttacacataactattttatggggtgcttaaccagcaatgtagcattgaagcttttacacataaaactattttagtggagcacttaacacgtaagatagtattgaatcaatctactcctttcgttatagtaaaacatagctcattttacaacgtaataatattttattctttcaatttgttttatatttgtcttcatacaagtcatattaagcaatccaagagatgaaggtcaataataaatcaacaaaattcagtaaattcatattcttcaaagtagctccatgggtttctccacaaccttcatgtataagcctctaaggcggcaaaaatcagtagcttttcttataatctatacttttttctaataaattattactttaagatttatattgactaggtcttttctttaaaataccatagagtctcacatattacagagaagccttaaataagatacgtatatttgatcaattaaaaagaaagctaagcacgttggtaaaaaaattactagcaataaaagtttctcgagactttttatggaaaaaataaacaatgagaattgaattaaaaagaaaaattccttactttaatttcaacttattttgttggaactaaccttcctagtttttataacaagtgtttatctgtatattttactgtagcttccagatttacc

SEQ ID NO: 7405 - DNA, 1501 bp, Oryza sativa
tgcaaaaacgccatcatatgggccgggcaatagcaggtgaatcgatcgatataagctttcatctgggctgttatgggcgggaccgaagcgaactcttcctctagcttcgaactcttgcacggagtaattgatatcctgattctctgcatctttttcagaacatatgacgaattcaaagctcgggcatgacctcatgaatttcatttcacgggttgtaacttgtaagagcaagtataatagtgagctataagattactataaacttatgtggagaagagatgtaccaaaaagttaaaggtgttggctctcatgcaagagctagcttaacacaagctccaagacatatacaattagagcaagtataatagtgggctataagaagtctgaatgctgaggtggatgggagaaaagaggagagagatgagaagcgggctgtaagtttacagccggcttaggcacaataaccaagaaaatttgtgagatagacatgtgcaccatatatttatagtgaagagctaaccattatatgagtgagctgatagataggctataagtaagcagctggctgtattattatccttgctcttaatgtataagtgagagatagaaagatgagaagaaaattgtagtcaaccttataactaatctattagagcaggtacaatagcaagctataaaccagctataaccacatatcgagaaaaaaagagaagaaagagaagaaagcgggctacatatttgtagttagctgcaacatggactccaagacgttatgtgtgatgaaaggtgggaccgggtattaatggtataatatatttttatagttaactattgtataaatgggttattagattagctacagttgttttggagccaataattggctatactattaaacttgatcttatatatgttggctttaagattggctaatagtaggaagtgggctctattattatccttgctctaagcattagtttcacgtaggtaggtgcgtccagttaacttgacagcgtacctgtaaactccacgcaccggcaccgccggggatgttcaggcgctgtccaacttttaggatgtttatctggcatccatacattttcacttatttcaggtggagtctctgtaagtctgtatcgtatcataactctgatgatggttaggtcacacattttcactagttcaaacagagtctctgtaattttaagtctgtatgacatcataactgatgatggttaattaggtcattcattttcactatttcaagtggtctctgtaaatctgtatcatatcataactgatgatggttcagtgcgaccgggccattctacgttcgcgttgaacagttcgtgtggtaaacatctcatcagtaatcacaggaatcaggacacaacatttaaaccaagctcttcctgtgcagtttaaatccgggtcatcactagactactcgaggtcgtcgcagcattgcagcaaccatggcttcgcctctatctgctctagc

SEQ ID NO: 7406 - DNA, 1501 bp, Oryza sativa
tctctccgttcttcctcctcgctccatctccccccccttagttttcggtggtagcacgagtagcctccccgtagctagccggcgccgccccgaccgttgccgtcgctcgccgtgtgctcgtcgccgtcgccgctcgagctccgtagcacccgctcgtcgccagcctcgctcggcgtagctccgcccaatccgacgctaacatcggattcccgtagccgcgtagatgctctcaccgccgggaatcggcccctcgtgaccttgtcgccgtttccctcttccctccccgccggttgccgccgccgcgattcgccgccgtcaagcttcctccggcgaatccgagccgttggctcgtctcccctcgtctcgtgcaaccacccggtgtgctcgttttcgccggtatcgccgtggttcgctccgccgctcgccgctgttgtccgccgtccgttccggccggcgtcgtcgtctacctcccgccagcccacgtggcagccacgtaggcgccacgtcggtgccagctcagccgaggtcgggacgggccgaccccggtcagcccctcccgtgcgcgcgttccaccgcgagccgtgaggctgcgcgtgggcccgccgcatccgttcctccgcagaccgtgcgcgtgcaccgcgtccctcccccgcccgcgcgcgtgcgccgcgtactccctccgcacggtgagccgagccgctgacaagcgggtcccacccgggaccgcgcgcggtgagcccggtccaccggctctctctcctccctcccgcgcgcgcgaccgtcttgggccggccggcccatttagctcggccggaccgccccaattctcttgggctgcgccctagccgcccgagaaaagtctattttccctccctcttttcttttcttttcttttcttttcttttccaaaaaggatttaattaaatccttttcctttagaccaaaaatccaataatcttagaaatccaataccttcccaaccgtaaatccgtttgactccgttcaacttccaaaattcctcaagtctcgagatctatctaatggcacgcttagaggtcattaatagggctttattttcgccgtttgttgagttgttccgtttcgcgtgtagtttcggagccggaagacccgcagtgcgaggatttcgaggatcaagctccagatctcgagcaaggcaagccacctttgaacatcttgagcctatatttgaaatttaattatgttgcttgaaaaatattatgcactgataggatcgcacttaatctgttgtcccgtctgcaaggcagtttggcggacatacctaatttgttgcattgatcctccctttgttaattgttatatcatgtccccttgtaaccatctagatgcgtctcgatattcgtgcaccctgtgcgagtatcgacggacgccttcaaacttaaaatctgaaaaacaacttgggtaaaacttgggttttacaaaagacttggaaaccccgacacctgggtcggtgcttgcgaac

SEQ ID NO: 7407 - DNA, 229 bp, Oryza sativa
aattctaaagactgatacattgcacaaactctgaccggacgagacgcactgtctcaaccgtgtcgtttgagaagcactcacttagttgctttcagaaaagagttcaaataaaatcaattgcaaaaacaacagcctttccttgaagcctgcattaaacacttaattcccatggcttgctgagtactcccgtactcacccttgctctatataaatatccccccccctcagt

SEQ ID NO: 7408 - DNA, 1501 bp, Oryza sativa
tctgtcagcacttatgttttatggtatgtatgaaaacaatgttgctattgttcttaagtagaaacatattcatacgattataagtggctatgtaaaggaatgcacttggcaaattatacacatgcattctttgacaaagacgaatactccctctaatccaaaatataagtcatttttagctctctcaattctgctccaaatttaagtcatgccagaatttcaatgcattgttttctgttacataaatgctgcttctctcatgaataaattgcccatgttttccaatgcaaaaataatttaaggccatcaaattcattagtcacttttattactctttgtgcacaactccaaaacgacctatattttggatcagaggaagtaagacacacacacatatatacaactcaggcatggatgttccaatatagtaagttagtaatcatatttcatgattattacagtgtttgggagattaattcaccaattaaaaatttgaatacatactatactaaaaaaatagggacacaaattgaaattatcatgaaagacttgagtgaagcaaaacttcaattaaacagtaaaattgaataatctaatttaatttctatattgcagcaacttgaaattgttgatggccctgcctctaggagcatgcatccattcagaaaagaaatggccaaagatctacttgtcggcgagctccgagttttggaaagtgctcatgcatgggttgcaaattattgtgaaacaataaagattccacaataatctcatcgaggcaatgccgctttgacaggagcaggaaagggagtttaacatcagagtcactgttccatgcatggaagacacttgtctctctggcgtatgtcaacttattcaaagagaaaaaataaatcccctgccaacatataggctggtatcttaagcctgttcgaaatgtatgaattttgcaggaatttcagaggcttgatatttttttcattaaattcatgaattctaaatggcctttacctatttatctcatgtgagaagattgataattaatcagattgcctttggaacaatatgaaatgtcgctcttctttctgaaagaatatagcaagtaatttagaagtagaaccctattccattccatcgtggggcacagctaggtagcagtattgtgtgcctgttgtctcatttgatctgccatttcagcgcagttattatttttcctatctgcatttaagcaattctattatgtacatgtttgtgcatctgctgtgtgttctcctttcctttaacctctcaccatcttaactatatttagccattgaatggacttggctatgagcctctcaatggcatctcctccctcctcctttcttgctcttttcatttgccacttctctgttctcgtgtgttagttttcatgcacaggaaagactaatgctttggattttggagaaggtgaaggaggaagagacagaggaggcaggatgctgcagcgggcggcgagcaa

SEQ ID NO: 7409 - DNA, 781 bp, Oryza sativa
tttgtcatatatatatagtgcgcaaaagcaagcccagggaactaacttgtgcggctactacgtgtgcgagtattgctactgccttgcataccaaatcatcaccacaagagagctcgatgtacatacaaataaattcaaaatttcattgggtacgtatcgatttgttgttgactaattaattcatataggttattcgcatgagggataacctcacacacaagtaatttatcgcggcggttcaagaacaactcatgggattcatcaacgaacaaatccttgatcccgagagaaatacaattcataggtcgttagcttctgagataacgcctactactacgtcgaagtcgtagctagctcggacatcataatgaattgtaattaatacatgtctatttttctatatgcatgtacacatttactttagtgtaaatatatattttggtcatatatatatgcacataaaatgttaagcgctttaatatatatatacatatgcatttgcataacatatatatatgtataaatacaaatatattatgcatgtatatgtattgaaacatatataaatataatatatctatatatacatacatatatatatatatctatatatacatacatatatatatatatatatattatgcatatatatgcatggtttatatatatatatatatatatatatatatatatatatatatatatatatatatatatatatatatatatatatatatatatatatatatatatatatatatatatatatatatatatatat

SEQ ID NO: 7410 - DNA, 1501 bp, Oryza sativa
aattccacatgccagattcgattattatttgtattactttcttagggttttctcttagatttgcaccggcattttcttagggtcatttataaattaaattttaggcttgggaggagaacttcagggtgtgacaggtcggcaccctcgcccttcttggagctcctccccttctctgtggggagtttctgggttggattgaggcggcagctcgtcagcgggggaagcctaggctgccaaagcaatgccatccagtcccgggttctcctttcgtccaaagctggcgaggaggccagcgggtggtggaacggaggggtcctgggccagctctcaggcaaggttgtcaggatcgggataataggtagtatcgttttactcaaagtaatatcgtaccgtaggatcgtattgtagtatcgggatactatgggattttctttttttaagtttaattaatatttatattaattatatatagccattctatattaaaaaaatatagtaatgatatatgtcatgcaaatagagatatttatcgagagaaaccacgttggttttgatatatttagctgatttttatataaatttgagcatatttatttatattatttatttgaaaccatgttattttaaataatattttgtagtatcgtagggatcatagaatcgggataccacctaaaattttgtaggatcgtgtagtaatgaatagtatgatcgagatactatgaatattaggatactatgtgggatcggtatcgtttcggcttggtaggatcgtattatcgtaagatactagaatacgaatcgggatactgacaaccttgctctcaggggcggtggttgatgtcggctgacggaggggcgtcagtgcggtgtggttcaatgaagtcggccgacggaggggcgttggtgtggtatggcggaagctacgtgttgccatttgtctgtgtggtggttctgagttggtggacggcgatttgcagtcaaggttgtagggtcccaggcgaaagcctagtccggtggttcaccgggccggcagcggctacgtcttcgggcgtcgtaacctccttggggcgttgtcgaggggtatcctcttcctttcttgatgagcttctctgggtgaaaaccacatcttttttagatgggcgatggcggcatcctggatgtcgtgaccaccgtggtggcatcgttttcagagtcttgtctctgtggtgttgccgtaggcctagcggcgttcggccacgcttagcgggggtcgtttggtgctaggcttcaccctcagcggtttgtgcttgggtggtagcgcgtggtgtgtggtcatgcaccttggtgcattgtgatgtttttttcttgtaatttttactccttcttaatacattcggatggcctccttcggccttcccggcgaaaaaaatagtcaaaaagttatcattctgtaatagctttggcatgatataagaaaatggtctctgcttgtattttaaattcaaagaatggaaacagg

SEQ ID NO: 7411 - DNA, 1501 bp, Oryza sativa
atgtatcaaatctaaggttgatatcttccaccacagaatatgtgcatttatcaaatttggaatcaataaatacctagttatacttggtttggacactcgagtatagtattttgatgaataataattgaaacattcagcattaacaaatattgagttttactcggtctagagtctcactagcttattttttatgattttattttataattccgaaattcagaattgataaatactgtgttgtactaggtttgaagtttttgttgaataatagtttcaaaattcaaaaacaataaatatgctcaatttagagcgtagagtaattttctcatgacctaataattctgcagtttagatttaatcatagtatctcatgatttgataattcaaaaatcgaaattaatacatactcagttgatgcttgtacattcacacgggttaatttctaccggtgtccaagcggtgtagcaagatcaaatagtatgggttagactcaatttacactttgtagtcaaagttgtgtgaccttgtaagcaatctagacaaatggcaaatctatggctatctaaaatttaaaacaaatcagacatgctatttacgggaagctgttttgatccctcaagagaatgtccctcgcttgtaaaaaaaaaccatctagaattctcaaaaaaaattcacaacattcatactatgtatgtatgtatgtatgcatgcatgcatgcatgcacacacacacacatgtatgtacatataacacatatacatatacatatacatattcatacataacgcacacacacaaattaacttaaatttttgaaaattttcaacttatgagtatatactaaggtacaagaatttgattcgtacctatatctagcaacaaaacaactcaaattcaactttattttacaatccattattacatacctaactaattatatgtttgggtggtatatacctagaagcaaaatctaacaaaaaaatgttcaaatttagttcaaacttgttagtaaagaagttaatgtccatacctgatctacattgccttgctctcatcatcgtcagcgttgtggcctttctcacaggcaacctctcctcgctcgagatccataaaaacaagagagaaaaaaatggattggttagttcgtgtgtgtatctatatataggtctatagtaaaaaaattactgggtgatgcgttgtgggatgggcgatgctggtagtctgcgggggtgggtttacacacacaacactccactaggtccaaactcaatttataacatttaggtataaaaaataaatatattcataccggaatttgtctttttgtttctcaatatataggtcgaatttgaagttgttctctcgtggaatgttagatgtcactgtactccacattgttaattaaatttttataactattttaattgaatttaaaagcaaaaaagtatatgaggggatatcctttcgtgggattagaattcattcctgctattaactaga

SEQ ID NO: 7412 - DNA, 388 bp, Oryza sativa
aagaatttcgaaatagcgggaaaagatatttactcccggttgttgagaacaaccgaaactaaagatatctttagtcccggttgttgagaacaatcggaagtaaatatcttttctttactcccggttgttctcaacaaccgggactaaagatatcaagatatctttagtcccggttgttctcaaaaaccgggagtaaagatcttttctttactcccgtttgttctcaacaaccgggactaaagattattcccggttgttgagaacaaccgggagtaaagatccaggggtatatatattcccagtgcgccctcgtcttcttcaccaacacttaaacgttttcggccgatcgatctctctcggcctctctccttcgccgccactgcctagg

SEQ ID NO: 7413 - DNA, 1501 bp, Oryza sativa
gtgggcgtcagcatcagcaaggaagctggcacgactgtgctagccaaacggtatatttgtaaacgaaaaatagtttgtaaataaaacttttatatatgcgttcttaacgatctaaaagcaaatgctgaaaaataaattttgatgaaaaaactttaaaatcaactttaaatttaaggttgaaattcaaattttggctgataagcataagcaaaagcgaaaagatgaggctgtaggtctgttgcggttgtctggccttctgcttatcttgcgtgagaatgaaggcaagacggtgggggtatcctgtcctgccccaatccctcttgctcattcgtcactctctccgatccccgacggggaaaacctctattaggggcttcaaatgagaccatatcatcccccatggggttgttatcagacaaaaattgccccccgtcgggtggagcgggggcggggacattccttagctccccgtccccgaatccccatggggcctgtgtagttaggtccatgtgcacatgtctatgttaaaagcccacaaccataaagaaattaaaagcccacttgaggcccattcgtaggtgcatatataccaactaaaccctaggcacaaacaacagcacggaccactcgtcctctcgttgaccaaggccaggggcgccaccaagccgcggcagtcgaccacgccacatcgccgccgcctccaagccaagctgcagtgatgctgcactgctgttgcctccgtgccgcgtcgcagcgcgtccacgatgagctgccatcgccgcctccaaagccgcgggttcgagtggggcgccgcgtgcacgccgttgttgccgtcgccaagccacgagctcgcgcgagcgcctgctgcacgccgttgccggtgtttagatgccattgtcgcctcctctgctgctgtgtcttcttgctgccgtcgtcgggggtgaggaacccggggggtggctatcacccccatggggacggggacgggggaaaatctccacccgagtgcggggatggggatggagacgggagattttttccactccggggacggggacgggatgctacaacccggcgggtgcagccccgttgccattcttcctcctctccaacttatccatcagaactaacttgagagaggaaatgcataccatcaaggcatcaaccgtccaaatcccgaggttttggccgtcagccagccggatccaacacaggaagtggtgacgcatggtggaaggggcatgggcaggattatgttcaagataaaagaatggcaaaggcgtggaggaccgggagctcatctgggattgtcgcaatacattcgacacgaagagggcactgtggccactgtcgattgggctgatctggcagggaagtgcttaatggcagtggctcggctagtacagagtgttgtggggtggcagctactgaaaattggcgccagtcgtcgaataggcctaggagcgattttcgtggggttttcttgtattttgtaaccaac

SEQ ID NO: 7414 - DNA, 1501 bp, Oryza sativa
ttttccaaatttatcatactataaatatttcatgttgtacttagctgctatattttgaaccgaattgaacgtagtttcaagggagtggggtgcattaaatcattggagctgctggcggggtcaatcatcaacgagcttttggctgatggattgataaacgtcatcggggtcatctgaccccggtggtagtgatctggatccgccctgcagaccccgtttacctgtgacaaattaactttcattgttaaaactctctggacataagactccaaaataggaatattgtttagtactttttcgtgctaaaataaattcatttatatattacaaaactgaactggtttatatgcaaattcgacaattcgtgtataaaaagaagctaattaattttgaaatggaaggtagtacgtactacgtgatgaccccgctggcttatttggctggatcgcccagccgccatcgttcccctgattccacacgaagaataggatcgtccgtgacctttcgtgacagtcccagtttattattatctgcacttcgataaactggtggggctaatttattgacgatgattccatggactatatagccaagtggccagtaacagctagcgctaaacctaacaagaagaattgctagcgtcgcctcttccagacattcgatgttattgactttttaacaaatgcttaattatttgttttatttaaaaactttgtgtaaatataaaaatatttacgtcatgcctaaagatcatttgataataaatcaaatcattataaaataaataataattatatactccatctgtcccaatatataataatttttagcattcagaatttatcctaaaatataacaacttctctaccaacattccttttcccaaccaatcacaagtcacaaccatccaccattcatttttcccacatatttcttttttttttagataagggtattttttacccggcctctacatccaaccggatatatacaacatttttaaattgggaacttagcttatcaaacagggaatttagtcctcaaataactcaatctgaaattcgctcctatagagatttgaactcagaaccttagggtgctatttaggtcactgcaacctagcctatctactttcttaattactgtgtccaactctaaaacttcttatattataaaacatatgtagtaatatttttaataagatgaatggttaaagatatctaaaaaaatcaacgacatcatatattaaaaaaaagagagaagtattccctccgtttcacaatataagtcattctaccattttctacattcatattgatgttaatgaatctaaacatatgcatttatctagattcgttaacatcaatatgaatatgagaaatactaaaaatgacttacattgtgaaacggacgaagtactatatatatggtatgtgtggcctgctgcagcttcgccccatattgaagcgaagcatagctggtggagggtacgatgattgcc

SEQ ID NO: 7415 - DNA, 426 bp, Oryza sativa
tatatatatggatgagacaaatgagataagacgcatggtggtccctcggatgatgtcgtccgttccttatttccattccatggcagctgctatcgctatctagtgcgcgcggcatctccaatcccatccattctagtggtcgatctagctactactgagtattgttttttcttctttttactactgttgattattctgcaactgcagttagatgcttgctactcctacatcgatctctctcgcgcgggcgtatgcattgcattcactactgatgatccgtgggtgtagtgtgggtggctataaatagggcagggtgcggttgccattgctcctcaggccagcaactgagaagctccatacaagtaagcagcagctagttgccgacaaggccagagaaggaagaagaagctctcatcatcatcacca

SEQ ID NO: 7416 - DNA, 1501 bp, Oryza sativa
cacagcagcagaggaggcgacaatggcatctaaacaccggcaacggcgtgcagcaggcgctcgcgcgagctcgtggcttggcgacggcaacaacggcgtgcacgcggcgccccactcgaacccgcggctttggaggcggcgatggcagctcatcgtggacgcgctgcgacgcggcacggaggcaacagcagtgcagcatcactgcagcttggcttggaggcggcggcgatgtggcgtggtcgactgccgcggcttggtggcgcccctggccttggtcaacgagaggacgagtggtccgtgctgttgtttgtgcctagggtttagttggtatatatgcacctacgaatgggcctcaagtgggcttttaatttctttatggttgtgggcttttaacatagacatgtgcacatggacctaactacacaggccccatggggattcggggacggggagctaaggaatgtccccgcccccgctccacccgacggggggcaatttttgtctgataacaaccccatgggggatgatatggtctcatttgaagcccctaatagaggttttccccgtcggggatcggagagagtgacgaatgagcaagagggattggggcaggacaggatacccccaccgtcttgccttcattctcacgcaagataagcagaaggccagacaaccgcaacagacctacagcctcatcttttcgcttttgcttatgcttatcagccaaaatttgaatttcaaccttaaatttaaagttgattttaaagttttttcatcaaaatttatttttcagcatttgcttttagatcgttaagaacgcatatataaaagttttatttacaaactatttttcgtttacaaatataccgtttggctagcacagtcgtgccagcttccttgctgatgctgacgcccacaggtgcgcgcatgggcagctgatgcgtctgcgcttgcacgtgtcgaggcccattgggaaaggtgtttatgtttttttttgtttgtttgaattattttgattgtattttagaagtccacctacatcatgaatctttcaacccaaattttaaaacattctattgaatctttaaaaaaaataagagaataactttcaactcaaaatttcaaaattttaaacttccattccgaacttagaaacttttaagtcgaatttaaaaaatctcatctcaaaatttaaaacactgaactcaactttttaaaaactttcaactcaaaattaaaaaacttccaactcaaacttcaaaacttttttacttagatttaaagaactttcaacgcaaaattcaaaactttcaactcaaaattaaaaatctttctactaaaattcaaaaactttcaagtcaaaatgtaaaagctttcaactacaaatttaacaccgtcaagtatttttaaaaacttttgaactacattatttatgtattgcattttttaaaaaaataatactaaatacgtactatcaatagcgcgtactaatagtcgtagt

SEQ ID NO: 7417 - DNA, 1501 bp, Oryza sativa
gatcgtctcccgccaccaccaccgccaccgttaccaccgatctcagccgagcgctactgttccctttgccggaagctccaccaccgccccgcgcagatcgacgtgctgttgtccccggccctcaagctccatcgccacccatccgctgcaagctctgccgccaggtcaccatcgatgaccaccacgcctcctctcttttcctccgcccacggctctggatggagtagcatccgcaaggtgactcgcctgcgagacgagatggaaaagggaagagaccaccttgcactcaaatccatcgccgccggtggtcaatatgcccagaactgcacaacttctactgcggcctcctgcaatgagcagaccctccggccgcctccttgccatggctgacgacgaggtgatcaggtaaagagtttttttaccactatctctctggcataagcatttgtcttggtgaagcaccttggcagctcttcccttgctcatcattttctaccgacttctaacaagagaagtgtgtgttgcatcttcatgacattgtagaagtgtgtgttgcatcttcatgacattgtaaagggataacactgttcatctgatatgtgtgtttcgtgctattggaccgtacttcggaaagtgctattggaccgtacttcggaaagaagctggacctagagcttatatatggcaagaagtggcagtgctcgaaggaggctgccctggactcaagtactgtgagcactacataccccttagatctcaggtgattgttcattctttttttctcaaatgccatatttcagtggcatgttatatactctttgattttctaaaaaaaagtacaattgtctaactgattggtgtcatatgtatgcagtgatgcctttgtacatttgtgattggttaattatcgtgttacatacttacatttgtttgcttcagtggcaattaaaccatcagttcatgctcgtttgatgctacaaatatttgatttgtaaatcatctatttgattctaatccatgtgagaatcagaacaaattaattgctcctgaactgatcttctatgttaggtgttagatttgaaatgaccaaatttgtacatgtatttttttacatatacatgtcaaatgattttgtgggagtaagggtgtgtccctaaggtattatttatctgtgactatgtctttgtaattggttgattacattgccaatagaatttttcaaaattaagagtttgttatgccacacctctctgctacttcgtcctatttttgtttttatcatagattggaccattgattttatccatggcaatcacttcaatttttatggtttctcatggttaatgtggttcattttcttttgtgacttgatttgctctcaacctaaggcatcaattatcatgtaggtactacatagcgttatatcacacttacatgtgtttgtccatcaatatattgtttataatagcttaagcattatggcaaggaccgttaattttta

SEQ ID NO: 7418 - DNA, 1501 bp, Oryza sativa
tatataggaagatggagtacatctctgcgctagccgccggcaaacagggcgacctcaacctctacgttgccccaagcggcgcgtcgtcttcgtacgtcctcagccagggcggtcgcccttggccactctctatcgccgccatgcggacgacggacgagagaggctgcatcggcgacagtggctgctgctgagaagagatgttgatatgatctgagccggtgagctgacgggcccagagccatcgagcgagtcgcgactcctccgtcctatttgcgctgcgcttggagccatgcacagccatgcacagcgagacgttcgatcctaaggttgtccacgtagcaaccatcggggtcggggctgcacgggagccggtttacacccggtctccaccaaatttttttccgaagagtagtgtatagactatagagaggaaagtgatttgctttctccgtttcacaatgtaagactttctagcattacccacattcatatagatgctaatgaatctggatattattatataaatagattcattagcatctatataaatatggacaatgctagaaagtcttacattgtaaaatggagggagtatttattatcactacatggaaattatctttgattttgcatttcacttcaaacttcaaaggtggcatgatgcatcaacatgtggcatacaggattcaaaatttcggattttggaaaattttggttctatcggacccccccccccccccgatatgatattattttggctgaaatttttaatttttttcatgaatttggtaatattttattcaaattttgtttaaaaattcatataattcggaccgaaattttcaccctacaaatgaccaaaccgaaatattaaacgctcgtggcatatcgttacataaaacatgcaaactcaacatatgtaaaataataataatattcagttcaaacagtacgtgttagtttggtcgaattcaaatatggattgatatatcttataatgggtctattatattaaaaaaaagttgttttttaactttttggttgacaacgttccctagaaagaaaaaattccacctccgcctatatagatcgagtgttatagaccatattgcatatgagaagaggaaaacaaattcctacaaaaatgtttctgcgttttttttagataaaatgtttctgcatgttctagacacacggttgttgcttaatttagtgcttagttatagtaaagaatagcttctctacttattagatgaaaacagatatataagttgagaattgaaatttacaggtgatgaatatgcatggtttttttttttttggaaactatgcatggttattcagattgcagagcttataggtgaagtcgtaaatatgttgcattgatgacaaacttttttgggcaactgaaacatcttttgccacagccttggcgaatacttggaccaaattcttcaatttttgtttgctgctttgccacaaaattttagttaacggctat

SEQ ID NO: 7419 - DNA, 1501 bp, Oryza sativa
agtacatttttgagagaaaaaaaacgcgtaggaggaatgggaggatgtccatcttcgtaatcaggaagagatacatgcaaatcgccaaattgagctaatctgatatgttgcccttaattatgtacccatatagtactacaaactgatgatccctataaatagtgacactatctacactaattttcctcacaccacagagagttgaaccaaaccatctaccatcaagcttatctaacgccatcatcgtcacgaccatgacgaccaaggccaccacccttctcctcctcctcgccgccgccgccgcggcgctcctctgccacatccacgtcgccgtcgccgccggcgaggacccggagccgtgcgagtgtgcgacccgtcggacatcaccatcgcgacggtgaagaccgggcgggtcgtgggcggcctgccggagttccaggtgacgatcggcaacgagtgctcgtgcccggagggggacgtcgtgctgtcctgcctcgacggcgtgcccgccggcgtcgaccggagcaagatccacgccgccggcggcagcgacgggctctgcctcgtcaacgacggcctgcagatcgtgaaggggtcgccggtggtgttcacgtacgccgccagcgcgccggtcagcctcgccttcgacaacgcctcgccgcggtgccaacgacgttgagtttggctgcaggcgtaccattaattgcttgcatcatcttccatggaagcgatctgttatgtgtcatgtgtgctgtagcttgtcagctgttgtgttccctgtattgagtataactgggtgtttgggcctggcttgttgtgggccgtggaccgtgtgtgtgtttacgacgtgccgtgctggactggcggtcgtgtcgagtgcgtgtgtcttgtacccgttaaaaggggaactccctgccgatgagcaggtatcgatgagaagaaatcaaatacaatcaaactacctctctctctctcagttcatccccttcctctctaattcaacccaaatcccctagcgaattccggattagcttggcgtgacgccggcggagtcttggagttcgtcacatctggtatcagagcagtgatcccgctggcgaggaagaaggggccaaatctcacggagaggatggttgctgcggaggcagagctcgtcgatctgaatcagcgagttggggagctcacgagcaacctcaacgaactcctggggtcgctgaccaagctggagacgtggattccatcggtggacacggggatccaagcgctgaacaaggccgtggaaggaatcgccgcaagagtgacggttttggagaacttacctgcagcggcatcggggatgacgaccccaacgcccatcgagcacggcgaaatcgagaatcaccagggagacgaatccaaagccctcgcggctcaggatcgatccctggtcaagggtaagtcccgattccccaactctcccatcacttttgatataggagagtcttcagttcagaatcaatcc

SEQ ID NO: 7420 - DNA, 991 bp, Oryza sativa
  unsure (1)..(991): unsure at all n locations
tgttttaatataacacggtaatccatataacacattaatccatttttcatctctctcctgaatatgatgccatcatatataggtggtaaaatataagcaattttgcaaggtaattaacttgcaacaagtgatagatgatatggacttgaattcaatagtcagatatactaccctttctcacaattctttggcctagtatcacagtaaatacagttcgctgcaaagtgacacttctctatgcgctctgggtaatgttcttggtggcattttcgaagcgtcatttggtataatttgattttggaggataatgattgtgtataaataaatatagaacaaacgttaaagttagaaattagatcttgttaagcagttaattagtccttaattattaatatcattgcgaacttgtatacttctctatgtctcaatatatagctacttttggctatacatacacataactaaaaatagctattttctaggatagagggtgtcggtgacatgggaccgggggtatcttggctagaggtttggggcagccgcggtcacccacgtggcctgaccccctcgggggggggggggggtcgggcccgagggtgatgtgnccgcccctccctctgtctccccgaggggtcgggccgctcccgtttcggcnccgagggctggggcgcnccgaccccctgtgggtttggctccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgctgactcctggagttagcacgtcagtcccggctagattcatacc

SEQ ID NO: 7421 - DNA, 924 bp, Oryza sativa
  unsure (1)..(924): unsure at all n locations
cgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctttttgtgtagtggtttaatgtggtaacataaattctcgttttttaattttttgctatcatatccaccacctagttctagatctagatctagatcttgtcatgtatagagagagaaaaaaattttaaatgtctattcttcggtggaatcacaaaaatagtaagagtattttgtaaaacccccatgaatttgattgtgtaagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttaga

SEQ ID NO: 7422 - DNA, 1501 bp, Oryza sativa
ggaggagtgtgtggtggaggtgatgtgatgtgattagttgacgagacggggaggggcgtccagccaaagaggatcgaatcgccatcagccaccgccgccgccgccggagacctccgatccgccgcctccaatcgccgacgatggaaccgctcaatcatccaaggtgacgcatcggcatcgcctcttccaatccccctattcatccatccactaaattcgtcatcatcgccatggccaccaccaaatcctttctccctcccccattcatcgccctctcttcgaaccctcgtcccaccaccctcgctcccactcccaatcccaggccccgccgccgcaattccctcgctatctgctccgcctccgcctcgggcgacccttctcccacacccgaggccgagggcggcggcaacccgctcctcgcgctatggcgccgcacgctccaccccctgggtgactacggcttcggcaagcgcagcgtctgggagggcggcgtcggcctcttcatggtctccggggccgcgctgctcgccctcgccctcgcctggctccggggattccagctccgcgcccgcttccgcaagtaccaagccgtcttcgagttcacccaggcctgcgggatttgcgtcggcacccccgtccgcatccgcggtgtcaccgtcggcaacgtcgtccgcgtcgactcttccctcaagagcatcgatgcttatgttgaggtaccccctacttacaccatcctcttccttttttatgcatccttttgcattccttcaacaaaccaaaatggaagatggcagatctagtacatgcaccataggactacttcttatcaccttacttatattactctctcatacaattggcactcaaaccatgtaacttgtcaaaatggcaatgcatattcttgtgtttaattttaacgcattttcttgctaactgcttcgccttctttctaattatcaactgaaatttgatgctaacctaatcaatcagaatcaaatgactgcttcatgcatgtcaaattctatgcagatatatgccatttccttctaaagaagattgccattgcttactgatgctgaaattaattgcatctagagtagttttttttttctaaaaaaaatattggatctagagtagttagttgctcaaattttgttcattcggaaaagctgagatctttactcttgctggctagtttattttaacctggctgtgtagccactcgatttacctaagctggtaatctgaacagcaaattcctggtattgtaacttgtcatgattcatgattcatggatgggaggggtcatgtcctccttttagatgcttagagttttccactactcacttactcagacttcacattttcaatataaagttggtgttgcaggtgtgcgacttatttgaaagcaagactttgcattgactttgccctaaatgcctattaattcatagaacaactttctgaaaagaatccatggtttagtttgtgcaatgcaatg

SEQ ID NO: 7423 - DNA, 1470 bp, Oryza sativa
gggaattgcggcggcggggcctgggattgggagtgggagcgagggtggtgggacgagggttcgaagagagggcgatgaatgggggagggagaaaggatttggtggtggccatggcgatgatgacgaatttagtggatggatgaatagggggattggaagaggcgatgccgatgcgtcaccttggatgattgagcggttccatcgtcggcgattggaggcggcggatcggaggtctccggcggcggcggcggtggctgatggcgattcgatcctctttggctggacgcccctccccgtctcgtcaactaatcacatcacatcacctccaccacacactcctccaaacctttacacaagatttcacattatttttactattattattttagaaaatatttcttggtgaaagaaaatatactgctaaccttgtgtattaactcatctgttctaaaataaatcaacttttgtatacaaatttagacattatcaacgctctaggagccatcgaatttaggtttgttcattgcaaaccatccaacccagcaaccaaaaccaaatcagtacaagcgggttacactggttttctcggttatagatcaaacatgtacgatttgacaacgtggtggattgaataacggttttaacccaccggctataggtgcggcggaggtgttacttttaatctctccgttgttatagcaaggtcgtctcttctcctccaacaaaacaaggactatttgttattgtctccggtatagttactgtttgttgcatcaccatgtgcacatgttccacgtggttttttttccctctttgtttttgcttgtgcccatgcttcacactctatatatattattactctactttttttaaaaaaagaatggttatatataatagtattacaatactaccatacaattctacgatttgatactactttaaggatactgcctagaatcttgatactaacaactttggtattcctagcaattcaaaacacaatatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcccttttttttttctcgtgggatctcctctccagatcatccccccttccagccccctctcttaagtgggcaaggtcctccttttatatctcaaggggataccacatgcaccacttctccttctctctctttttgggtgggggcccatcctatctatagtaaaacttggcttgccttctcttggaagctgaaacactgcctgttttt

SEQ ID NO: 7424 - DNA, 1501 bp, Oryza sativa
  unsure (1)..(1501): unsure at all n locations
atctctataccatgattcatgagacatgatcatcaattaatacatgtgctgatcattaaacatatttgttccacatatgatatttgatcagggatcctttagaaatagtaacatacaacataaagagtctcatgaaacaatcacatattcattaaccaataatgagttatctatttcaaggaacaatgtcggataaatatgtaaatatagtatgtgatacaatcatctctatgattgcctctagggcatatcactaaaactcatgttccaggtctttccgcccaagctcctccattgcctgaaggcggttcttgtaaccatccaggcgagccccgacagattgttcgatgctactttacgccgaaagagcctgcgagcaaaaagggggaaggtggcgaaaatatttagtgcaaaaagaacacttagtaaaaaagcgtgagaatgaaagaatgtgtactcgaagaagtgtgctcttgaccgacgtgcagccctcgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctcttgttgtagtggtttaatgtggtaacataaattctcgttttttaatttttttgctatcatatccaccacctagttctagatctagatctagatcttgtcatgtatagagagagaaaaaaaatttaaatgtctattcattcggtgtaatcaaaaaatagttatagtattttgtaatatgccgatgatttgattttgttagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttagagatatagaaagtcgggaatggatgtatcattggccgaggtttttatctccatatagaaacgaagtggctaaatttattggtattg

SEQ ID NO: 7425 - DNA, 1501 bp, Oryza sativa
tttatgcacctaaagtttatacacctcaagtttacacatctaaagtttatacacttaaagattacaggcccaaagtttataagtcaaaagtttatatatccgattcaaatttaaatttgaattcaaatatttttttatatatagtatttctatacatctaaagtttatacacctaaagtttatagacccaaagtttacaagtcaaaagtttatatatacccgattcaaatttgaatttgaattcaaatattaatttgaatttgaattcaattttttatatatagtatttctatacacctaaagtttatagacccaaagtttataagtcaaaagtttatatacccgattcaaatttgaatttgaatttaaattcaatttttttatatatagcatttctatacacctaaagtttatacacctaaagtttatagacccaaagtttataagtagaaagttttatatacccgattcaaatttaaatttaaattcaaatatttttttatatagtatttttatacataaaattttctaactttgtttttttattattttaaaatttattgtatagtagtaagagaagaagggggaggagaaagggggagaggccggtatagggggatggggggtgatcgctgacgcccattatcgtcgccccagtcgcagtgcctaacagatttgttttcaatcagttcggttgcacatgcaaataaaaaaaagttgtggcattagttttgtccaaccaaactaaggcagcacgcttgtcaagcacgcggcacgatcgatatcttaaaatttcctttcaaaatcatggctgggaatatttttgcaatcttctccgtgacctaaattgctcaatatcgaattttaaagctcaaagttcatttcagagatcagttaaatagaaaaacgaataaaaatcctctccctcagctttgggttttttccaaccaatccttcctcccttcctctccctaggtcggccctggcctcctcctctgttagcacttgcactggactagctcgctcggcctgtcccgtcggccgcgtcgctcccgtcctctcaaccaggccgcacacttccacatggcccatccgccccgctcgactagttcccatagcctagtcggatcaccagccccctctctcgctcgccagcaggtggggccgggggcccacctgttagctctatcccctatgtctgacctacaaccaccgaaccataatgttaaacacgccgccgcctttttcgccgtttcccagcaccctgttccaatggcgtggactaggtcgccgtcactcccccaccctatctccatcccactttccccaaaaatctctgcccatttaagccacctcccacacacatcatcgccctacttcgcaccggttgccgtcctccatggccatgacccacctccctgagcccattgaaagaaccgtcgaacctccccctctcatttttccatgtcgccgagctcaattgctcaccactccctcacca

SEQ ID NO: 7426 - DNA, 1501 bp, Oryza sativa
actctttggaggtttagtttaggtgctctactggagatgctcttagaagatcattattgggttgaggcttagttattttgagtagtatctaaatacccctctgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatcttcccaaaaaagaaaaaactgacttgcgccttcgcctggaagctaaatcacagcttgtctttgagtgaggcccagcgtcatcactcgcctaacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaaacctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaatgagtgtgctgcgctgcattaaatgcagcgtggggcgctcgtccaacccgcaataaacgcggctaggtgagcgccgctgtgctcacctaacccacacacgtggcgccaaacccacaggaggtcggggcgccccagccctcggggccgaaacgggagcggcccgacccctcggggagacagagggaggggcggccacatcaccctcgggcccgacccccccgagggggtcaggccacgtgggtgaccgcggctgccccaaacctctagccaagatacccccggtcccatgtcaccgacagtagcccccggcgttatgccagggcgatcgccttcctcgaggaaagcgctcgggcgtgacgccactccttaagcctggtgacaggcggggccggtctctacaggcgggcaggaatccagtggtcgcaaatcgcgcgcatcggcaagggaaaccgaccgacaataat

SEQ ID NO: 7427 - DNA, 1498 bp, Oryza sativa
ctgcattaaatgcggcgtggggcgctcgtccaacccgcaataaacgcggttaggtgagcgccgttgtgctcacctaacccacacacgtggagccaaacccacagggggtcggggcgccccagccctcggggccgaaacgggagcggcccgacccctcggggagacagagggaggggcggccacatcaccctcgggcccgacccccccccccccccgagggggtcaggccacgtgggtgaccgcggctgccccaaacctctagccaagatacccccggtcccatgtcaccgacaccctctatcctagaaaatagctatttttagttatgtgtatgtatagccaaaagtagctatatattgagacatagagaagtatacaagttcgcaatgatattaataattaaggactaattaactgcttaacaagatctaatttctaactttaacgtttgttctatatttatttatacacaatcattatcctccaaaatcaaattataccaaatgacgcttcgaaaatgccaccaagaacattacccagagcgcatagagaagtgtcactttgcagcgaactgtatttactgtgatactaggccaaagaattgtgagaaagggtagtatatctgactattgaattcaagtccatatcatctatcacttgttgcaagttaattaccttgcaaaattgcttatattttaccacctatatatgatggcatcatattcaggagagagatgaaaaatggattaatgtgttatatggattaccgtgttatattaaaacaacaataaattagagagagataatataactaatgagaagaatatattagtatttgaaatggtaatgatgtttgtttttttaattatctctttcaacgcactttcctttggctagttttatgcaattgattagttggtttgaaagcataactaaaattgtggtaccagtaatgtccaagagtcctaagttacaatcattattatatctgaaattcctatgatggtgcaaaataaaaacatccctaaaatgctaaggcaagtttactagggagggaatacaacgaaagtaattaatagaaaaaaggttttgaactgataaaacttttgatttgcggacccagatatgcaagagggtacaaatcatcttattttagataaagttttgtcagtgttctagattccccatatatgtgaactaggctctgcggagcccaccatattctaaatcatgtaaagaatcaagtctcatatgtatggtaaaagtcctgagtacacaaggaaggagtgccggataaggaaagagaaatagagttctattctggtccgactagtatatcacagatcatgtcatgtacgaaatcaagcctcatatgtatggtaaagtctgtacacaagcgagaagtctcggataaagaaagagaaatagaatcctattctagctcgactagtactacatggataatatccatatttgcttccctagttatacttcgaca

SEQ ID NO: 7428 - DNA, 1501 bp, Oryza sativa
agtaaccgtgaccggtatgttgctacagtactatatcggaggcactacagcgcatgactcagattactgtgcgcctctgacttagaacgtgtttaagtcagaggagccggttcatccgccgccaaatcccggatgggaagcactcccctctcccggcttctcccgaatgagtaaaaaagtatggatcatattatctgtagaatattagttatgtcagtaacaaaattgttttattaatcctttgtattattttaccttttattaatattttgtattcttttctccacattcatccggtagtagttcagtacaaataaaatttactgaacaatatacgtcactggatattttttttactgaaggatagttatacggtaactgaacagaaccatctgtatgccgaacaaaaaattgctgtgatagttaaaaatttactcctcaagtgttggtcgttcgatccatataggtgggaagcgggactctatgtgatagtaaaaaaattacccagataaatgaggagtgggtgggtgttgtgaggtgagctatttagttaaacagcacgtacgtagagtagttctatgctgtcgaaaggacaactgcgcacgtcgaaggacgtggttactcaatagtgttggaaacagtagatgtattaatttaatatttttcttaggatcccgcttatatgtccctagggggctatttataattctattacaggttcccccattagggtttaggttttataggggaatttacatggttgtctttatgaaagggacatttacatgggtacacagtgtaatttggatatatgggcctctaataggctaatgggcgaacattggcctaatggcaaacgggcctgatggttcgactggccccttgggcctccttgaagttggacttgttgtgacgaagtctccttccttcggcgtacacccttcgccatttactcttcgcccaaaatgcctttggtctcgcgggataccagcgcaactgttcggctttcgccgtctttgcttcatagtcttcgccatgagggcttcgcccaaatggacttgacgccttgagcttgaatcctcgctggttacatggtttcggcaggcctggtcggggggtctcacgacataccgccaacaagccccacacaggcaagggtgagataggagcttcggccgagatcgtgcaaaccatgtggtatggtaggaggcgccccccctttcgaccgacgctcctgccgaaacctatattggagtcctgcagaaaatgcgtataccttgtgcgtatgtatttttacggttagtgattattcttagttttcgccttttgcaaacggcgaagccatccttatttcttcctgtgggccgcaatgaacagcgacgggcttcccttcgtgggcctagcactgtgcggctcaatgaatgggaatttaccatttcgcctacccttgtgacacgtggcagcttacgatttggtgggaaggcgaatcgacgcctgggtg

SEQ ID NO: 7429 - DNA, 868 bp, Oryza sativa
atttcggctatttttaaattgtacttctacgcgcaattgcgcggctagcaccaaaaaaaaacatatattttttaaagtatgattttacttaaaatttattaaatagctatctcattgttaagactttgaaaaaacaaactttatcatccccgtgtttctaattatatagtttttaaaagtcacaccagttgttacgccttatgttatctcctttatttgtttgctcgatctatcactatttctattcattcttcttggaacctttaaaaattggattttataatttttagagtttattttcacgttgggtttcgtttttatgattcctagatgtcccgtcaaacgttgccattatgctcctctacggcccgtccactatctcttctctttattatcattgagattttaaaaatcgaacataattatcgtttgggttcatttttactttctagaagtcccgccattgtactcctctacggctcgcccgctgcctcccttctttattgtcattgtgattttaaaatcgaatatgattatcattagttattttgttatttttagaagttccgaacctttaaaaattagacttgtagttttattttttataatttttagaagtcccatcaaacgatgccactataccccctacagcccgtccgccgcctactctttattgtcattgtgatttaaaaaatcgagcataactactgttgcaattcattttttattttctagaagtcccgtcaaccgtcggcggctctgcaactatactcttatacaccccgcccgctgcttctcctttttattttcattgagattttaaaattcgaatatgattatcaatgtggtttttttcttactttctaga

SEQ ID NO: 7430 - DNA, 1501 bp, Oryza sativa
aaagaaacctaaaacgataaataatttgaaatggatggagtactgtattttcatgggaaatggagcttgtagactagtagaaatagagtctcgatttaaacctgaattttgaatagaaaatggcccacgcaatagtgtaccaatagtaagctagagaaacccaaggtaaatatggttgaagttgaaagtgtaccaaacacaaccttgtacaaaactgcgtgcggtgcataattaatcaagccggtgatgccaagcgtgcaccgacaaccagtttgtttcttattttaagaaaatcaacacggtcgtctcagatcgcatgtttgatccgtgttataattaattaaggggttagctagctcattaattaacaaccgcttgtttgcatgattgttgcatcccctgtacaatatactccaactttatcatattttaacaaaacaattagtagtattacttagtactaaggcactagtagtaattatataccatcagatatatagacagtactttgatggacttaagcattaattaagacatagtagtacttaaaaagatgtaatgatcttaaacgagctcatcggctggcgcggctcgttttgaacatgagtttgagctggcctaactgtttagaataaaggtcacatccacgttgacaagtcagaaaagggtaaaaggcagctgcgcggccaagattgcaatcaaattaaggttaaaactggataaactctcccaggctccctcaaaaatcatacagtactatttcagtggctgcaatgttttaatttctagtagcaattataagtggatacgatgttcggtttcaaaaaaaaaaagtggatacgatgttatatacagtagtgttcctgtctgaatagcgattttttttttgaaataatgaatagcgacttttccgacctgttttggcgcatgatgccaattcaattggtgtcaccggagtaggttccaaagtttacctccccagaattattgtaacaccactaatgtatgtgaacacacatgtttttatagactcgttagaatttctactagtatgacgaagctagaaattcttgtgggaaaatgtccgttttgagaatatacgttcataagtctggaaacaatcctaactaccggaagaaaaaagggtgaatgttaaatagacttaacgcctttattaattaatatttattattacaaaaaggcacgcatggtagttgaagaagaaatcagtgtagaaagcgaagactaaattgaggaaggcaagtggtttgaggaatgctacgagcgaaaagatttggagtataaataaacagagagcgatggagccggtcgttccaagctgaagcctccactcacttgctctgcccaccggcgccggcgccgtcgccgccctatcctgtcctacctatggggcacggcctgagctgcagccgcgacaccgacgagtacgacctgttccgcgcggcgcagctgggcgacatccacgccctctccgccctcc

SEQ ID NO: 7431 - DNA, 298 bp, Oryza sativa
actgggcctcgctggtttggatccaccagggtgcatgggccggaattcaggcccatgcaccaaggccacggtagagtgagaagagaaggaaaccctagttagtgatgagtagcggcgagcccccagccgccacattgctcttctttccccttcctcctcggcctcggcgggcggcctccgataccgatacgccgtcggagtcgattccgattgcgattgaaggtctgttcttctatttattatagtatatatagatccagtcggctgctgcgttgaaaaccaggagaggatcagatca

SEQ ID NO: 7432 - DNA, 1404 bp, Oryza sativa
tgcgcaataaatcgagtttaattatagaaattcatttaaatggctcaaaccttctaaaattcatatctaattcattcggactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacacggggtcagggtttacctatctgctcgcttgtgccatgtttacttgatatctgttctttgtcaaccttgggtaataaattgactagctcgtgttacttatgtgacctagctagaactatatgcttagccatgcttaattaccactagctcagtcgatgggataattgcagttttagacattctagtatcttgttgagccgcgtgctcgagacatctggccatgttttatggtcgtaattatccaactaaaatgcgactgaatggtgggctgtgggtgcatggttttgcgagtcgcacccatagcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgcctttttaggggtgggggtgaaaccttagcgtggtgtggatggttaggggagggttatgcgaagggtctcgtcacaatcactcgacgtggtgacgtgtgcatcatgggcacatgatgacgcggtgacatgtcggtgggttgtgtcttgtgggtacagttgtgcacctctggccagagtaaaactattcgaatagccgtgcccgcggttatgggcgctcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagat

SEQ ID NO: 7433 - DNA, 1277 bp, Oryza sativa
cggaaccctaactgtgatggcatttttgggacaaaatcgtttgtacgatggcatttcttggaactcatacttgtcgatggacttttgggacttagacgcttgtcaatggcatttcttggattatctcatatattactgatatatacgggcaatagcgtaggtttaatcttttctttgccatatacttcactgccaatctgatccatatcgcatcagcctgatatgaacgatacgtcatcagcaatccagccgatcggctatcgtttatggatctaactttggctcctttgtttcttgttggttgcaggatcaaaccaactggcacgccttgaacccaaaagcaaaatttaggacctgcactagagtaaagcaaatctctcagaccagtgtgtgtttttcgcatcaacatgcttttggcatgctcagtgggaccgacttcgacatatcttcatcatggtggatatcaagtcaactaatgttgacccggacaacatcgtcccgataacgctagacaagttgacagcagaacaaaaggtggacctcgagcagatgatgaaccaaatgcaaaataagtttttgcactcatttgtgttaactagatcagggacagtaattcagaggtataagatagcgatgctatctgatgacgacccagaaacgagttctcctaaagatgccaagcctaaaaatgagaaaccataaggagatcctaaagggctcaataatatgcaagatcggattgactatgctgtttatcatgctttgatcaaccaatcaggagtgcttgtctaatatgatcaagtgagtatcaagctaagggatcgattttccttcctgagggtgtttttccacaatataggaccatcagcactaataatggtggtaagcatcaacctgcatctggaataaccccagagcaacagcctatagttacaacggcttttgggaagctgggtgcgtcaacatcggctcacggtcagccgagtgttttgttcaagcaacaaccacagcacacggagcccaacctacaatcaaattattatcccaggctatcaatgaatcagggtaagcataaggctgagtacgggtaaattccttcccacatgacattataaaataatgcaattttaagagaaaagcaggggttttgcagataggctcaatatgatcaatgatatctgtatgacttgccttgcccttgagctgatagaacctcttcaaccacttcaaaataaattggagcgtcggaactgccagagtctaagcgacaaacaagg

SEQ ID NO: 7434 - DNA, 1281 bp, Oryza sativa
  unsure (1)..(1281): unsure at all n locations
aaatgataacantgttacagnacnccatcacactgaagactcaatttagtactttaggtttcattttgtccatacaggtcatctaagtatttgttttggcttaaaatcatccttggacccacttgatttgccatatggctatttttagtcaacaattctattagaaagtgtcccttttgcctttaatttgtatacaactgtgcactagaaaaaagaaaacaaaaataaataaacaacattacatatgtatttcccattatttcaacatgtgcacatgaaacttgagcctaatggctatcgtatacacttgtaagtatataatttatttttgttttacataaattgctatgcattgtctataaaaagaattcattgtatgcaattgttttctcttacacacgcacgcgccgccaagcccgccgctcccgccagccgcgcgcatgctgctaaggccgccgccgagccgcgcgatgccgacggccgtgcccacaccggcttcgtccaggaaaatcttctgtactagtccaggaaaatcatttctctaatagtgaaaccgcgggtagctaacgtatattcacagtcaaatttgtttttttttcgttgagagatgtgaatgttgaatttgaacttgaatgtttgaggagtgatatatcacatattaatacatattctcaaattggtttaaatttttttcataaccatttgagagacatgcaaataacgaggggatattccctcaaggaataagttcactttaggtccctctatttgtcgactagtctgattttcgtccctgcaccataaaaccgggtacgacccatccccaacttacgaaaaccgggcaaacaaggtccctcggcggttttgatagcggttttgactaacgtggcgcctacgtggctaatttgactcggactttatctgacgtggcgcttacgtggcaattcgatcctgaaaaataagaaaacccgtaggacccacatgtcagtttcacacacaaaataataataaaaaagtgggacccatgtgggccccacatgtgatcctcgctcctccctccactctatatcctctccctcccctcttctctctatcccttctctctttccggtcgatggagcggggcgagcggcggccggcaaaagcgggcgacgggaggggcggggcagcgagcgagacaccgacggcgagagctcgaggtcaacccgaagaccagtctccagccacgcgcgcgccgcgcaacggggtccgacgccagtagcgccgccgccgccgacgcga

SEQ ID NO: 7435 - DNA, 1501 bp, Oryza sativa
cctaaaaatgagaacaaattgccggaaatctactttgatttgtctacttcccatgaaaatccaatgccaattcaatatggttcgaagagagggatggaggagatcaagagaaggacatttgtccgtctcgccttaccctcatctcaaaactagagtttaattctaaagataaaaattaggacaaacgaagtagggtataccacaaatttcgataccaaatcaacatgatttaaaaagaaggttggaagaggagaggggacttcattcgaatgtgaggtgcaaatgatgctaatgccaaaccgccaaggggtgccaagattgcctatgattattgtctctcctcctcctagcactatttgttctcagctcatctccctatctctcttactcgtatcgagctctccttccgtccatcctctcatttggtgctaatagagttgcctcgctcctctgtttgacaccgaacaagtcatcacgatcggttgcatccttcttgtccgttgtctgtgttgttgtcacctttctcggcctcccagctccaccgcttgcatccacctagaaggctcctagtggaagaaggcccacctgatgacactctctcgtgcgacccgatcttctggtgaggggataacgctcgctttgatcgaatacgacttttgcaacttggcaaccaaccaaaacaagtccaggacgtcatgcattcgcttcacaacaaatgatgtcataccaaccgtgacgcgcggttgatgatccctgaaattcaatcaaaagaatactacaagaacaaggtaagatgcaatctaaatgtcgtgaataggtaactaagcacaaaggaatagttgcaactgaagtgatagatctaatcgactcggtaaatcaacacaccaactattggcctattggggctctaaatttatagtcatcgactaaacgaacaggactagagacaaaccgaatgacacttggtaaaattcagctaaacaaaacctaattttttttgggggtgtacatagatatttatagagaaaaaaagagcttgggatagattatggatagtggaggaggatagacacacactcaagatgggtccagtctattacaagaccgaaagactcaaattcagttccagcaatagcactgtcttgttttgacgattcccgttgactcataaaaaaatttgatacaatgccggatgcgttccgttgttaacaacaggtgacaacacaagctttcgaaaaaaaagtcaaagatcatccaaatcagagttagcatgaaggtgctatgtccatttgaaatcagtgttgtagtgttgtatctagaggacgaactggacttgaaactgtcattagaacttgtggagttgcgagcgtatctaataatgtcctcgtcactaccccccacagcatccactccgtggaagaaaagccctgatgccaacattggagctctagattggctagcagcgtagagtcccgagcttcggctcctccaaatcatccta

SEQ ID NO: 7436 - DNA, 1501 bp, Oryza sativa
tcgaggagggagatcgacatcgtcttctccaacttcggccgtcggcgtcaatcttcgattctctccgctccggtgaccccctcgtcgattctttgcgcatgcaccatccctgggacctaaccaacctcatggatgcacatgcatgccttcatatcgaatggaatgagttggcatcgtctcgccggagctcggagccgctgctgagacgttttcttcatcgctgccatcaaccaagccccatggcctttgctcggcctcgccctgtcccacaccatcgtcgccaacttgttccgccgcatccccgacaggtcgatgccctcgtcagcaacgacgacgaccacctcgccgcgctcgaccatatccgccggcggcacaaaacgaagaaggagagaaagaaagagaagagatggacttgccattggccccaagggcatttccgtctaatcaccacaaagaagaggcaaaatgatttcggaattaagagaaaataagaaaatggcaatctggcgagttgcatggccttgatattggcattttatcgaatcacgttttgaagatggcattctagcaaaaccgtgttttgaagatggctaaatgtccattttctcattggtttgccctctgtggtgatatgctccttggggtcattgcctagcctataatattctttgtgtcttcattggtcgttgccggttaacctctatatcgaacatgttttatacgtagctcgaaagatattagaataggacagattaatttttaacttcttttatttatcctaatatcccttttgtattttaaaatcttgtatttgggcttgttcaaaccttatgcaagactgggcctataaaaacctaagccaaaaatgtacagctgagcccgccctagggtgttgctaattggcgcgcacacggcgccgcttccccgcgtggtttcttttttctttccttttttccacgatttttttctttcctttttacttttttttctaataatttttgtaatctttagcacacgtattttcaaatattttgagttgaaagttttaaatcttgacttgaaaatttttaaatctttaacttaaaaattttcaaatctggacttgaaagttttcaaatcttgagttgaaagttttcaaatttaagttcaaagttttcaaaatttttaattttcaaatcttaactaaaaacttttcaaatctggacttgaaaattttcaaatctcgagttgaaagttttcaaatatgagttgaaagttttcaaatttgacttcaaagtttaaatattaagttgaaagttttcaacctgctagtaaataaattgaaaacaagaaaaaacttttcttaattactatcattatccttaattaaccgagttagttacgttaacacgcaaaaaacgcgtgctgctggcgcgcacgccagctagtttttccgcccggcctaagccttttcagcacataaaaacaggcctaaacctgattcatgttcaggtttcttcct

SEQ ID NO: 7437 - DNA, 1501 bp, Oryza sativa
cccacatacgcaccaggctgggcatgggcctccattttgtggtctgaaagcctgaaaaaaaaggaggaaaaagtacaccgaaggtccctcaacttgtcagtgagatacaaaaacatccttgaaccgcaaaaccagatatgcggggtcccttaactatataaaacggtcactcgaggtcccttggtggttttgacgcccgatttgacctacgtgacggctgagtcagcatgggccccacatttcagggtgccacctcatctcttccatcttatttccctcttctccctttctctcacttttctcaggctggtgacgggcggcgatgtggggaggaggccaccggggggaggggagagaaagaggtccggtagccggttggaggcaacgccaccgtcagcatcatcgttgccgccgccgtggcacaacgccgcccgtcgtcggctattttgccactgctgactccgtcgccttgggacactagccgcgctccggcggcggcctcgctagcgcgatatcgtcgatggcttccacccggaaaagctcatcgtcgccggctgtagtttaagacccgcgtgccgccgccacaaaaaaaactccgacgtccgcaccgaggaggacatgcggagagaggggttggagccgtgctggccggaggagcacgacggctaccgtggtgactcaccgccgctgttcccctccactcccctctttctctttctctgccctgagctcgccagtgccgcatctatctgcactgccgccaccgccgccgcatctatctctctctctctctctcatcaccgacacggattgctccttggagaggcgtagcttcttgcgccgctgcatccacggtggtagtcgtcgccgcggcgagcggcgccggcaagctgtcgctgtgggcgctggtgaaattgtggcgccgctccctcctctcccactaacgccgccgcacgctgctccctcctcttctgcttgtggccatcggggagaagggcggcggacttggtggggccgccacgtcgccgtcttgctccccctgcggccaccaagctcctctcgccgccgccgacgcccctcccctgctcccgcgtcgccgccttgctcccctcgccgccgccttgctctcctccccgctgccgccttgctctcctccctgtcgtcttgctccccccacggccgccaagcccttttcgctgccgtcgatgcccctcccctgctcccgcgtcgtcgccgccttgcttccctcgccgccgctttgctctcctccctgttagagttagagataatgtgtgcatgtgataatgcatgtgataacagaatagaagttagagataatcttggggttagtttggattgagatgtaattctgttatatatgtaaaaccacgttggaggttgtttccaacactaatcaatatatacgtgcggcctcgtacagaggtgataacgcttcctaaaagttttatatggtatcagagccatactagccacaaacaga

SEQ ID NO: 7438 - DNA, 1501 bp, Oryza sativa
aagactaaaaagaaaaaaaagacaccaatcgaggaaggacgcgcatagcaccgagtggtggcacgtaggatggggcaacgggatggtttgggctgggagggggaggggttgggttgggatatgagtgtacaatagttattctagactcatgttgaattgaatacgagtgacatataacaaactaaaaaccaactcaaacacggatgacatatcaaaatttttgtgaaaacatctttaaatttttatagtagagataaaaagatagagatatgattgaagttaagtttgacataaattaaaatgtcttgtactccctccgtttcacaatgtaaatcattctagcatttcccacattcatattgatgttaatgaatctagacatatatatgtaaaacggaggaaataatatttaaggaaaaagtacaccaaaggtccctcaacttgtcatcgggatacaaaaacgtcctcgaaccgcaaaaccagatacacgaggtcccttaactatataaaaccggtcacccgaggtccttaggtggttttgaccccggttttgtcctacgtggctgctgagtcagcgtgggacccacgtgggccccacatgctaggaagccacatcatcacttccctccttttccacttctctctttctaggcggtttctcggtgaggcaaagcggcggcgcgacgtcggcaggcgagacgggagagaggagggcggcggcggcgcgacggcggccggcgccctgggggagaagggtagggcgactgcggcggtggccagggtgagcgcgaagaggacggggcgatgccgcgccgtcgcccacacccgccgcccctcgtgctcgtcgcgctcccacaccagcacaccgcactccacgtcgtactccgtcacgatgccgtcgtaatcgccacggtcgtcgggccactcgaacagccacgtgacccggaggatgtcccggtacagcccgagtgcctcccgcagcgagctcgtcagccggcggcgcgcctcggcctccgccgcgtctccgtcgagcgccccggaggacgaggatgagggggacttgttggcgctggggagagtggcgcctccgtcgcccccatcgccgtcaacctcgcccccatcgtcaatggggaggcgcgggcatcgacgggcggcgggatggcgcgggcgtcgatggggtgagacgggagaggaggaggacggcgccgcggcttcctccgccgcgcgccgctggggggaggggagaggaagaggtccggcagctggtgttgccgcagaacgacgacgacgaggaacaggccgctgctggccttcccgcctcctccctcttcacgtgcgctcggtgcgggagttgtggggaaaggcagcgctctatctgcaggtcaactccatccttgtcgccgccacacaaagtcgctgccgccatcgtgtagctcgtcaccggccaccagacctcttccgctcccgccgaccggcccaccaaaacgagtaagagagagag

SEQ ID NO: 7439 - DNA, 1501 bp, Oryza sativa
attcccaaataatgatactcctattttctgatgtcgaattgccaattatattgaatagcacactgacactctgttgaataatgtctagtttcaggtgacaaatataggtacacattaatgttttcaatataacagttgtattcatagcctataacaatgttacgactcatcagaaaaaaaagagagacagagaagagtcgagagcctcctgcaagtatgcacatgcacacccaaaagcaaattataaatcactgaagactctatatcactgattcttgtagagaaacttcagagttaataataagaacattcaagaaaggacaaaatgaaaaggttaattaaaattttaacctttcttccagttcttcgaactgtttagattttgtttcaaggcacttcatctcggaacaaatttctgaatattgcttttcagcttcctcaattgcagctttaagtttcttttcttcttcctcaatctgaaatggcagaacacataatacatttagttccatgaaaatcatggccactgaccagtcagaggtgcttattcttttttttttcacataagaaaggtcaagtaggcaacttcttcaggaactgttgcacttcaacatttttataagtgggcaagaattctcttacagagaagttacaagggaattatttgttcatttaaaacattgctcactacctatgtgtttcatctatcaaaagaaacttctgccttacttatttttgtccaaagcagcaggctgtcatgcactttaggatctcattaatcacgatatgaccataaatatgtaagaaagattaccaccttttgtctctccttctgaaagtcagtttcactgaggatgttataggtttcctgctccagacgttgaagacaggcctcataagctttattgtcagtattaacatcttcaatttccttctccattttatcagacagcaacctcatacagtccagacagagtggctgttcaatctacaagtatattccagattatcagcggtcttgacattgttcctctcaaaatactaacagatggcaatgaaccctcaacatatagtagcaaaaacatgcaaatctgatgcaataactagcaactgcacaagctaataaatgggaaacaaaggtaaaatgacagaaatggcaaaagcacgtgttctcattcaatacagaggcatcttacagaagtcattgtagtacctgtgtttgtgatgtagcaatctcaaatgcccgttttaatacagtcacgctagagtgaaaattatttcctggtaaagggctaccggggttcatacttgttggtgacaactgcgcaccacctccttcagaggcagatgtcttgtatatggaagcggcagcaggtggaagcactatatatgatccctccattgctcttgttggttggttcggctcggcacgcgggatccctgcgcttggcgggcgtgggggaattccatggctatgtgatctattttgcttcgatagcac

SEQ ID NO: 7440 - DNA, 1501 bp, Oryza sativa
ttcttcaccatagtggagtgtgaagatctcgagattggttctcctacaacgcaatcgcctccgctcctaccactacggcggcagccctagctcgttctacattcctgccggcgccggtaggctcaccggcctttacatctgtagtgccctgcctatcctctccaacatcactgccctcaccatctgcggaaattccctgaaggtatgtgtcggtgacatgggaccgggagtatcatgactagaggcttgggcagccgcgatcacccacgtggcctgaccccctcgggggggtcgggcccgagggtgatgtggccgcccctccctttgtctccccgaggggtcggactgctcccgtttcgaccccgagggccagggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgtaaggaagtcattgtatgaagaagggcagatatgcagcttgccaaactgacgcgtggtggacgagagtgaccggtctgtgactggtcacacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtagtatccccttgagatataaaaggaggaccatgcctaccaagaaaaaggggaaaaaaagaaagaaggagaaaggggagctcgtagaaaggacggggaaaaagagtagggagagggtctctagagttagaaggctcttgctttccagctctttgtaactccttcagagacagatccgccagaacacaggagtagggtattacgcttctcagcggcccgaacctgtctacatcgcccgtgtcttgagcgtttgctctctcgcgaaccattccacagatcaagagtttagaagctcacttagcgcccccggccgaaccggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaa

SEQ ID NO: 7441 - DNA, 1341 bp, Oryza sativa
  unsure (1)..(1341): unsure at all n locations
ggggtnnnaattcggtcgactggcacagnagnncatcatattgatttggtatatcctaattttcacaatggagagaaagagagagtgagaggaagagggtcctccaccatgggaattaatctactctttttactaaagttttgcatgattttagctttttctttcacaccttttctctgcttgtgatatgatgccgaaacgtcaggcccggtcccagcacgattgaaatatataaatgtacaccgtcactagttgtgcatatattttatatgcttgtgtaaacaagtaactataaatttaaacgactccgtttggagtgtacggattttttttctctgattaatagaagaactatttcagtaaaagcaagccccttatctatcaatcttttttgcaaccattatgtaggtcatcgatatctaactaaatccaaggcatgctatatgtcacttgttttctttcgggagtgaaacaaatgatgtgttcacaactttgacattttaaaaattgtatttaattttgtgttgatccttgtcaatatataaaatatagtaattcgatttttttcgtcaacatctacataactacataagggtgcacaacaaagttgaagtaaatctgtactcgtctactggatcgagttaattttactcattgtgtagctttaatatagagaaacacacaggttttccagctagctccataattaaggtgatgggctaaccggcctgacttcgaagcctcaccccttctatttatttgatattaggtcattcactattattcgtgttttttagctttaatttaataaaaattaatttaaaaaaagcaaaaatcgccttaactattaatcaacatatacgctaacagtccaaggattattatactaactccgtttttaactatatgacattatcgacttttgtacatgagtttttactattcatcttcttgaaaaataaatagttaactattgtttagtttgttataacttgctatatcattaaacatagggcctgtttggtacagctccaactcctaaatataactccaggagttgagtctggagtggagttatggagctgccaaaacccagttccacaactctaatatattttgtgagagagctccacccaacttcactcctagttttgatgagctgaaactgtttggctgagctccagctccaagaggggtggagctagagctggagctgtgccaaacaggctcataatgtttgaaagtaaataacgtcacacgtatttataaacgggggctgtatataactttaatttatacatatgcattttccgcgcaacaatcagacggtgagaatgaaca

SEQ ID NO: 7442 - DNA, 1501 bp, Oryza sativa; identical to SEQ ID NO: 1890

SEQ ID NO: 7443 - DNA, 1501 bp, Oryza sativa
ttcgataagtttcaagatttttttttccgttggtagagatagcatccatccagaaatcgaccgcgtcggtgctgatcaaatgcgatgctaacaacccacaaaactttccttgagctgagtctgccaaataaaaacatgaagcaaaagcctcattgtgacctaaactcctctcgtcacctagcttgttgctcccaccaagcggccaaagccaatcaatgtaagcccatgacgtgctctcgactatcgtccatacgatacttacaatacttgaggcgaggtgggagtgggcggcagcggcgacgacggccaggaggaggagtgacgagacgcggaggaggacagagagggtggcggccttgtcccgcgaaacggcggcggtgcaaggaagaggcagccgcagatcactggcgacagcctccgcattgccgcggggagatctttgccgtcgccatcgccgcgggataggacgaacgcgatggccgaggcgaatagcagagacaggacgcacatggcggcgcagggcagcgccaccacggagcttccctttgccttctcgccgccgctgggcggcggcctccatgttagccacctcgaccataggcttttgatgatgatgtgtacacgtaaggcccacttatctttttcgtcgcttattatcgcgtacagttttgctataaatctactaacgaattccttccttttttaggagaaaatttttccacaaatatatagatagtccctgtcgcgtacatagatcacttttccagcattcctgcccggcattacccaaatgggtcaggcctcatggaccccaatagaacccttgagcttagtgattaaaaaataatttgtgagtaatttttgtatgtgtgtctttaacggctaaaaagttattgctgaaaaagaaactacgttgaaaaaacatcaaaattaagttaatcgtattatgagtaaactaaaaaccgaccccattaagggctcaccacgacaaaggcattggaaaagattgatgggttaatcctcttcgatttcccttccatccctttaagagagaattaacaaaataaggcctaaatcgaaaaaccgagtgctcacccctgtgtgcacatgaagtagttcaagatcaatcccacacaacacaacaccaaatgcatttcgccgccccccggcccggtgccacccaaaaacctttcatgcatagtacacaagctgaccaacatatcaggtgagaaaaagaaacatcaacatattgggacaagaaaataaatatcaggaagttgaataatgatggtgaacttctcaatagttgggaaaacgccggggatcgggcgcccaacgtgcataaagaaaaatcgccccccccccttaacacacatgcgcgtgcgccttcggctggcttccacgcattcccaccactggcgttccattgaacaaataccccacatattacggaaatgccctattaaaggaaaccgtttcattttttttccaccaacaatgt

SEQ ID NO: 7444 - DNA, 1501 bp, Oryza sativa
gaggaatgaatgccgaaaataagctactgtctttaaggcagaatattgaagggagtggttgccaggttttatgtctgcaagaaacgaaaatggaaaactttgagctttctgacatcaagaaatttgcccccaagcgctttgcctcttttgcttttgccccctccatgggtgcatcaggtggtattctaattgtttgggcatcaagagttttcactgggacacccaaagaagttaaccctttctctgtgactgtggagttaacttctagattcacctcccaagtttggtccttgacttgtgtgtatgggccatgtaatggccctcaaagatcagattttgtgacctggtttaaaaacatccatattgatgctaaacagaactggcttttcctaggggactttaatttctacagatctatttatgatagaaataaagtgggagctgatatgaatgatattttattttcaatgagatcattagttctctaggattgcttggaatcccattaaaagggagaaggttcacctggagcaatatgcaacaaaatcctttgctggaaaggcttgattgggttttcacctctacatcctggactttaaccttccccaatacaactgttctccctctgaccaagaatatctctgaccatgttccatgtgtggtaaagattgatacaaaaatccctaagtctccaattttcagattttaaaacttctgggttgaagcagagggtttctttgatgtggttcagcaagtttggatgttagatcctggttttgatgatcctgcaaaatgtatctccttcaaattgaaaattatgaggaagaaactgaagctttggactaagaatttgtccagaatcatgctcctcttgagtaactgtaataaaataattgattttcttgatcttctagtagaagagagaaacctttctttatttgaatggaatttcaaggaggtagttaaacatcgtatcttaaaacttctagaattctggaaaatatattggaaaaaatgttgtactaatagatggatgatgctgggagaagaaaacaccaagttctttcaatctattgccacaggaaaggtacagaataaacacaatttctcaagttttgaatcatagtggtcagatagtttacctgcatgatcaaaaggcaaatttgttctatcaaagtttcaagaataggatgggtatctcttgctccccaacaatggactttaatttgaatgagcttttttcatagaacagatttggagtgtttgattgacatgttctccacacaagaaattggtaatctcatcactatgatcccagtagataaggcacctggcctagatggtttcaatggttatttcatgaaaaaatgctggcatatcattgcacaagacttctatagacttgtggcacattttcatgctgaatctacatatttatagatcctgaataattcttacatcactcttgtgccaaaaaaaccttctccaaaaacagttaatg

SEQ ID NO: 7445 - DNA, 1501 bp, Oryza sativa
gaaggtttatactctactaatatggtacgaggacaagaatggcttgcttggcgacacaccactggtgtgagacttgacgaatctctacaaaggttctgtaacatagcatatgggtcattctacaagttacacatacaccaatgagacaaagttgagcgtagacatcacgactattttaatctgaattatgcagatgataataaggagaaggatacatagaaagagaccataaaacacggttgcaaagtggtttacatcaatgttggaagtaaagtcttgatagtctgttcaggtagttgatggtcaagctaatcaagaagctccattggaaactagaatcagaaaggttaaggagacaccgttacatgaaataattcaagaatatttgagatataaacaataattgttttacactgcaaaagatgaaggtcagacggagaagatgcttcaagatccgctattaatttaaaatactttgaagctcagatacttcgtagatatacttaatggttaagagacttgtttccataagacatgaggaaatcgttttaccacgaaaggttggattcggtcgaatgttaaatgttatttttctcagaaaagtgaaatcatgggaactaattcaactccagtgatgcgtgaggtttctatggacttgatagagtcaagggtgctcagagaagaatatagaacaaacactatcgtattcacacaagactttgtgatttgagacctctcagtcaatattctaagggtcgagaggataatgttttttttaataaaattgacctatcaatatctacagaaggattaagttaagtgttatgttctattggaaaaagaagagtcagagaaaggtatgttagattggctagtcagtttgacagagtggtcagtgaaggattgccatacccaatttcttgctagccgttccaaatctcgggacgagatttctataagggggtggatttgtcacaccctgaaaatcgctaaattataaattgttgtaaaaaaggaatttttagaatttatttaataattaaagtaagtgtttgaataaaatatatgaaaattttgaacattaaattgatatagataaaactttattaaatatttttagtgtccaaatattttctggatttttcccggaattatttgagcattataagtatttttaataaatgaaacatcatttcagcaattatttaaattaaaaagtcaatcaaaatcctcttctttgtctcgggccgaatccggcccattcccttcctctctcttccgccggcccaacccgagcctgcatcctctcttcctctctctgccgaagttctatttgcctccctccttcaatcgggccgaggaaatgaagcccggaaagaagtctgttttgcccccctctactacagtgtcgcccctaacctccagccggccgatctcctccctgccgtgcccgtgtacagcgccgcctccccaccaaattcgtgctctccgttgctcctct

SEQ ID NO: 7446 - DNA, 1501 bp, Oryza sativa
gcataatatagggcttatttacaaaagcagcatttagcaaacttttgagaattgtaaaacagtagagcaattaatcattaatattaatcaacactgtacaacatacccatgctgcacaggcccaaccatcctgaacaaccatacccggctgtacaaatctatctctaaaccaggaatgtaccattccaaaccaggagctaatcaaattattaccagttatagcatcttttattatggtgagaagtgtgagactaatcacgaaagacattgttagacccgcccataaccgcgggcacggctattcgaatagttttactctggctagaggtgtaccactgtacccacaaggcacagccccacgacatgtcaccatgcacctcaataccaccacggtacctcggaaaggagctgtgacagtacccctcgcacaacacaatccaccacagcgcaccattcctggatcataatcaccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcataacccaccattatcaagttttagttggcaatttaattaattaaccaatcacgattgaccatcgtgagcttccattaaatatccataagtgatagtgaagcatgatttatcccattaatgagctaatgtttctaagcacagctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacaggttcaacatgctcaaagggttgtttgagggatctgtgtgacttgccttacaaacaagcgtcttcaattcgtcttcaggaacttctccaacgaacggacgatcctccgaaacaacgggaagtctaaacctaaaacgcaaaacaaggaaaaacactaataaaaaccaaatgaccagtacaattaaagttcatatgggtagagcttgaatttagatgaattatgagacttgaacgacctcattccgagttcgtaagaattagatatgaattttacaagattcaattccaattaaacctattaaagaaaagactattccaaattgattaaacaatttacaaatgatttataactgagacagaagattaaaacatcattcggaaaaagattagatcatatttggtagatgacatatattaaaaaggaataatatgtcattgaaaagagatgacaaatttatattaattttggatggccaagatggcgctgatatcagtgatgaca

SEQ ID NO: 7447 - DNA, 738 bp, Oryza sativa
tctgagaaaaataggtttaccattggcccgaatccaacctttcgtggtaaacgatttcctcatgtcttatggaaacaagtctcttaccattaagtatatctacaagtatctgagctcaaagtattttaattaaacggatcttaacatctttccgtctacctgaaaaattttttaccccttttttttttttttgggcccccaaggttggtaaaaacaaattattgtttaatatctcaaatattcttgaattatttcatgtaacggtgtctccttaacctttctgattctagtttccaatggagcttcttgattagcttgaccatcaactacctgaacagactatcaagactttacttccaacattgatgtaaaccactttgcaaccgtgttttatggtctctttctatgtatccttctccttattatcatctgcataattcagattaaaatagtcgtgatgtctacgctcaactttgtctcattggtgtatgtgtaacttgtagaatgacccatatgctatcttacagaaactttgtagagattcgtcaagtctcataccagtggtgtgtcgacaagcaaaccattcttgtcctcgtaccatattagtagagtataaaccttctttagtgctttcaagtaacctctggtgtaggggacttccactacgacattatatatccttgattaattatcacttcgtctttattctcattttcctgagttactataaacatccat

SEQ ID NO: 7448 - DNA, 911 bp, Oryza sativa
  unsure (1)..(911): unsure at all n locations
agccgcggagacttacatattttgctctgcgtggtacacctacttactccgggactccggtagttctcgannttgttggagtgcgttctgtaggtttttctccgcggcgntcnncccnnccnccggggcnncttgatggtcgacgcctcctccgcagcnacncatcaagnnggggcgtcgcacatttatgtttgttcagcctgagttcccctctcgctctctccctccgccgcgtggcagccgggcgagggcctcggggcgaagctacgggagagctcgagggggcgacatcacgccccgaggccccccccccctgccgctttcgcgactcgcgggacgcgtcggtggggctagtgtcacgtcctgattttcgtttcagatttataaattatttaataaattattattagaatttatattaaatgttcattaatttacaagtgaagttaaatgtgggaaataaaatttcctaaatataaagcatggatggatttaatttttattaaatcctccatggttaattatactctctggaattttctcggatttttcagagctcaattcttaattttaatcatacaaagaaaatttcagtaattatccacatattaaattaatcattaaatggtctgattataatttttttaaatactttgagggtccaagtattttcaagatttttcttgaaattatttgagcaatataagtatttttaacaattcaaagatcatttcagtgattaatttaattggaaaagtaattaaaattcaccttttccttttcgggccgaattaggaaaagtcctctcactctcggcccagtctcctctcagcctgcagtcctttccctctctttcccaaagtctgctttttgtccctcctttaatcagtccttggaagtagaagcccagc

SEQ ID NO: 7449 - DNA, 1501 bp, Oryza sativa
gcaaaggttcaagcttggggattcgttgacggtcgttatcgatcagtttcgaccgtcaatactaccaaaataggagagaacttgtgatgcttgcaatgcataagtatgttagagtaataattttccactagtattaggtttactaaccttttgtagagaatgacaataaagtggaggagaatcgacatcaacttaaatgataaatcaatcagacgatgtcgagaataagacttatgaataaatgggccaagaactcagaactgacacgatgaattgggccaaaattcacaagtctgtggagtggagcaatagaggaggccaccagtcgaaattgggctggattggaccagccccaggttcggccgaaactggtggttcggctgaaccaatcctggcgccgttggatccatgttttggcgtggacgtccaggattgcatcccaatgacggttggagggcacttcgcacaattccccttccacaaccgtcataactacctctatataaggagctcactctcttcacttcacacaaacctcaagcaatagctctctcattcctctcaagtttagtttagtagtatctagctggtggaatagaattagaataggaatcaggagtccggaagtctttggaagtgttcgggtatggctctaacagctttcctttcctcttttgtacgctttgtacttttattagaatactcttctatatacatttatggtattgaaatactttccgagtatacgagtacctactttacattatgttcatgttatactgagtatacggctagcttatctgggagatgctttggtgcgggtataatgtttgctgatgcaattactctatgtcaagacgatgatattagagtagtatctggtcgtttagatgtggtgtctagattacgggatagcattatttggggttatatattgcggatgagaggtgggccgctaatggtgacagctcagtatgggtattcctccacgccggtatataacccaaagggatatcgccggtggccaggttggcgtgccaaccataacagcggtttgactgccactgaccgcgctcatgatgaagatgcttgaggcgcgataacaggggggtcggtcagaccacgcctcgattccctcgctcgccactcctgcggcggtagcggtgacggtttgttcaatttgcgctcatggccgttgcacactccacctcgagtgtgccactgacaggcgcactaaaggcgggacgcggatacaacgggcgatgtgatgagtgggcgcgggaagcgaagagacaaatgcgggcgcgaggatcgtgggggcaattatgggggcatgaaacgaggaggtgagcgtggatgaggcgaggataaaagggggcggaggcagagactctgccttcttcctttcgccaaccgcccactcgtcctttcgcttctcgaaccctaatattctcgccacttcacactgtcccacgcgccacgctctccgccacttctccgc

SEQ ID NO: 7450 - DNA, 1501 bp, Oryza sativa
agccaccgccgcctggaccgctggtccggctcccgcccgcggtcgcaccaccgccacccgcgccgacggcgctatcgctggcgccgcctcggctggaccgactccagctggcaccgacagctgacatcatggctaggatgctctcccggtcgcggtcgcagcagaggggaagaatcccatctgggattagtgttggctcggcggagtctaggcccagcacccgccgaatcaccctcttcgcgtcctcctcacctcagtcccagcgctcgcccacatgcgtgcgcatggggtcgttgggaccagtgtattcccacgtgccacgggatcgctcttggagaggtgcgatgcggcggtggaagtaatcgccaaagaccatcgcccccatgaggcccaggcttcgcaggcccctgaggcgatcccaaaccacgtcgtattcctcgcccagctccgaagccaccagccatgcggtggatctttcaggaggaccagcgggaactcgaagtcgcggatggtccggcaacgcagtgtagaaccagtctttcttccagtcctcccatttcttgtgaagatggctctcgatgtattgacccactgtgcctggctggggctggaagtagcatccccccaccaccgcgccttgcagcagctgtgggatgaagaaggcctggaacaaccgcatcgtcggtcgcaccccgatgaacatctcgcacagatacgcaaagatggccagcgtcatcacggcattgggtgcgagatgcaaggcatggatttcgtagaaatccagaacctcatggaagaatctggagaacggcggaatcaagcccgccatagcgaaggacaagaggtgcacggatcgctccggatatcgtggccgcggccgcgactctcccgcccgcacgacggcaccatccggcatgatcttgtggggaaggataaggtgcctgtctgccgtgatgcgggaggaagggagcactgtgtcgctggcgtcttgagccatggtggccggcggagaagtggcggagagcgtggcgcgtgggacagtgtgaagtggcgagaatattagggttcgagaagcgaaaggacgagtgggcggttggcgaaaggaagaaggcagagtctctgcctccgcccccttttatcctcgcctcatccacgctcacctcctcgtttcatgcccccataattgcccccacgatcctcgcgcccgcatttgtctcttcgcttcccgcgcccactcatcacatcgcccgttgtatccgcgtcccgcctttagtgcgcctgtcagtggcacactcgaggtggagtgtgcaacggccatgagcgcaaattgaacaaaccgtcaccgctaccgccgcaggagtggcgagcgagggaatcgaggcgtggtctgaccgacccccctgttatcgcgcctcaagcatcttcatcatgagcgcggtcagtggcagtcaaaccgctgttatggttggcacgccaacctggccaccggcgatatcccttt

SEQ ID NO: 7451 - DNA, 1501 bp, Oryza sativa
cacgccaatcccttgtacatctgcctggattcgtgtgccgtctttcataaatattgtccagattcattcacacgatcgagatagaaaacaaagagagacttcccaccttccttgcatctcttgttaaatgctcataactaagcaatatatcacgatttgacctcatcttcccttctatctctggcgagttacatgggtactttagtttgtgataattaacagaaacagcgctctagtctttagctagtgccgcttcgttttgggacctattgggaggatagggggttccttttccttttttcttcctctgtctaggagcagcaattttgttagtttgtatcccttctctttgttcaacccctgctatccctcccttgttacttggcaagggccggtcaggcttattgtgttgtataactaaaactcttttcttctaatgctgacacacactgcgtgttcgtgaaaaaaaaaagaaacaccgcgcagcaacttgctccgcttgcagcggcggagcttgaacaataaattggagagagacagtgtgatagcttctttgaacggttattgtgctattttgtgaagtattagagtatcaaagacttggggactccaataatgcaatatttctaaagctggaggggccatgaccaaggttggcctccatggaactctgcctctgtaagtttgtaagtgcagccatcgatggcgcgatgttgaggtcgacgcaccagatggaccattttggtggaagggagagaacagtagatcgatgccagtgtgtttgtccacaacacaggaagcaagttcgatatcgtagttcgtcgctgatgagtggggagacatagcacttggtgattggaaatacggattaaaggaaggtgtcataccaaaaaaaagaaaacaagctggcttcgactatcatgtctgcccgatcgcgatcgaatggttggagatgaccgacctggtttatctaggtgggtaagtgcaattttttgagttaatagagggcgtcctcaaaaaacaccacttgaatgaattttgcactaatgcaacatgtaactcgttaattagctagatcttcagctttctgttgcatcaatatatattgcgtagcgaacagttgactatgcattgaaatcagctccacctttcatttcttgaataactgtaagaagcattaagaaatgcattttcaaaaaaatgtgatcacatttgtgttaaatagtccatgaagagaaatatactgcgattattggttgatttgttttggagcctcgtgaattgtatatataggagtacaacgatagagacaagaaagctgatttcaatgcatagtcaactgttcgctaataatgaaggactctaaacatatcttatccttaatatttatataactgccatatataatttaacgatttcgttataagacaatggaaacatcccattctccacatctgacggtgcactaaagctcacttattacatcaccatatcccttttc

SEQ ID NO: 7452 - DNA, 366 bp, Oryza sativa
ggagggcaaatcgttacggtcaaaaagtcaatagatataatacgtttttggtggcgattaatcgcattgaatgcttaagctaaattacacctggtatgcgggcgataaaacttgttcccgcaaagcaaaggtccaattagggggagtggatggggcaaagctatttataaggggtcgtggcaacattgtttgcatgggagggaagaacagcaccaagatatgaaaatgttggagtacttggcatacagaacacacggtttcaatggccatgaggaagtatgaaagctgaggtatgaggatatgatgtgtataagtgagcagtcaacggttgctgatataataatagtgcaatgtttgatggcagca

SEQ ID NO: 7453 - DNA, 921 bp, Oryza sativa
atatatatatatatatatatatatatatatatatatatatatatatatatatatatatatatatatatatatatatatatatatatatatatatatatatatatataccacctatttgctactaccgggagtagttactctctccgcttactggatcgggttagtggaataacccataatccaataacgggtgggagtattcgattcattagacccggtaacagtcattggcattagtagcgatcgaattgagggcacatagagagggagtagctactcccggtagtagcatataattttcaatatatatatatatatcaataaatttaaatctttagtgctcacaatacgggccgggtgtttttttttttagaaattagctagtgaggttagggattaacagctaatgtctctctttgtgtgctttaatttgtgcttgtgttaaagggacacactagcttataggtacttctgcctatattgacttgtgcactcttgcgtgtctaccttacaatatcacaaaaaattattttatatatttacattaactttggcgtatacttatgaacacctcccgtagctggtgctactgtcgcacctacctttatgctgcaacatccatagccaaatccctgtgatatcacaactacctagctaagaaaatggatctttctcgcgatgggccaggctaaaccatcaagaaaatagggaaaagcatgattaaatatttgagtaaattttgtaaaactataaatattttgatcatactatcacaaaactacatatttaagtagtatattacagcactattgatttaactgttataaaatcagtccaaaatcaccattagaaaccaaacgcaaaagtaacatcataggagaaccaatcaagatgacgacaccgagacacaatatttgttaa

SEQ ID NO: 7454 - DNA, 1501 bp, Oryza sativa
ccaagtattttcttctcaccttttctctgtggttaggatggtaagcatcaatttctttcctcaatccgggatcatatttaatctcctcatcccaattgatctcttccggacatgaagttccgttaccatcgatcatatcttgagctttccgtttaggtttataaaacctctccatggctacctataattcattattttgtataaataaattgcagttcacaaaagagaaaaaattaattgaggacgagatcggcgagatgatccttgaggacagaggacgaacactcactctagttagtcgagcagcaggcagcggctctttgagtctttgacgctgacgaggacgagatcggcgagatgatcagatgaacgtcgatcgtcgaagtcgaacgccggcgaggcaggcaggcaggcaggcagccacgatcgtcgcacgcgcagctgatgcgtcttcgtgggcagcggcttcgtcttcgtgcagtcctgtcttcgtgggcagcggctcgctccgggcgtcggcgtcgcgactcgggagtcgggaggaagggcaggcagtcgatgcgtcgctgcgtcggcgtatacggcgcgtctcgcgaagtcgtcgtgaggagaaaaagagttgggcagctgatgcgtcgtgggctgaataagtggcatcgtgggattcaaggtctggtgggggtgcctcctattgggctgtaggggtgcctaaagggccaaaatttgttcatctctaagaaattttaggaatctggggggtgcctgggcacccaggccgcccaaagtggcttcgcccctgaatccatggtaggtgattaatgtggttcggagcgcagaggataatgccgtgccgagttggtccgaggaaatggatgagcgaggaagaagatgggttagtgggttgtgcgtacgtgagcacgaccgacgcttgtctttagtagagtttgattgttgctgaattgagcgacatttttgcatcttggtcctttgcaaaaagtaattctacaaaatatattccaagtttggacctcacattgacatcaaaaccagagagtctacctataaatcgttagtgtcaaccttcttggtagtgtagctattatggtgattggcctgcatatagggaagaggtcgacaacagaacacagcagcataaatctacatatttagttttcataaacctaaaggtggcatcaacgtacaagaagttaacaccaatagctctagcatcaacctctatagagttatacattagcaacgcagatggctaaagttatcatatgtgcgttacaggtccatacaagtctccttatttccaacacattatatgtcgatgttggtgcgcaccaacctgaggtccatttgtgaaataatagcatgttctaacttgacgattgggggggggatgtaaagtcaattggacaaagacgggcctgccgatcagccggggggggggggcttgggagtcctaaacttggacaagttcacaagggccttgaga

SEQ ID NO: 7455 - DNA, 1501 bp, Oryza sativa
gagatcccatagacaagtggcatgagatcttttggtctttgcccatcaatccatgcagagtcctagaagcgtgccgtattcctatctccgacggttatctttgtcgaagcagcaaaaaagtccttgtctaatccatcacaaggcatctccagtcccacccacggtttggttgggtccttccattaatatcataacaatcgcaatctcaaggcccttgtgaacttgtccaagtttaggactcccaagccccccccccccggctgatcggcaggcccgtctttgtccaattgactttacatcccccccccaatcgtcaagttagaacatgctattatttcacaaatggacctcaggttggtgcgcaccaacatcgacatataatgtgttggaaataaggagacttgtatggacctgtaacgcacatatgataactttagccatctgcgttgctaatgtataactctatagaggttgatgctagagctattggtgttaacttcttgtacgttgatgccacctttaggtttatgaaaactaaatatgtagatttatgctgctgtgttctgttgtcgacctcttccctatatgcaggccaatcaccataatagctacactaccaagaaggttgacactaacgatttataggtagactctctggttttgatgtcaatgtgaggtccaaacttggaatatattttgtagaattactttttgcaaaggaccaagatgcaaaaatgtcgctcaattcagcaacaatcaaactctactaaagacaagcgtcggtcgtgctcacgtacgcacaacccactaacccatcttcttcctcgctcatccatttcctcggaccaactcggcacggcattatcctctgcgctccgaaccacattaatcacctaccatggattcaggggcgaagccactttgggcggcctgggtgcccaggcaccccccagattcctaaaatttcttagagatgaacaaattttggccctttaggcacccctacagcccaataggaggcacccccaccagaccttgaatcccacgatgccacttattcagcccacgacgcatcagctgcccaactctttttctcctcacgacgacttcgcgagacgcgccgtatacgccgacgcagcgacgcatcgactgcctgcccttcctcccgactcccgagtcgcgacgccgacgcccggagcgagccgctgcccacgaagacaggactgcacgaagacgaagccgctgcccacgaagacgcatcagctgcgcgtgcgacgatcgtggctgcctgcctgcctgcctgcctcgccggcgttcgacttcgacgatcgacgttcatctgatcatctcgccgatctcgtcctcgtcagcgtcaaagactcaaagagccgctgcctgctgctcgactaactagagtgagtgttcgtcctctgtcctcaaggatcatctcgccgatctcgtcctcaattaattttttctcttttgtgaactgcaatttatt

SEQ ID NO: 7456 - DNA, 938 bp, Oryza sativa
aaagttgttggcccgggtggccgtttaaaaagctattggccgggtccaacttgttgcaatcctaaagattgacacattgcacatactccgaccggacgagacgcactgtctcatccgtgtcgcctgagaagcactcacttagttattttcagaaaagaattcaaataaaatcaattgcaaaaacaacagccttcccttgaagcctgcattaaacacttatttcccctggcttgctgagtacccccgtactcacccttgctctatataaatatccccccccagttgctgaagaagatgaagcggatcctgctgatgaggagttcttccaggagcaagccagctacgatgagttttagggtttcggcctagttcccaagtcgcgcctgtgatgtttggcccaagtcctggcttccgtttcccttttgtaatgcagttgtgagctcgggatctgtccgcagcccaacatgactgtacctctactctataataaagagacctctgttgctgtggtattctgtctccctgtgataccagcactgtttcctgggactggtatcgattaacaggctaaattggagcgtcacgggctagttccggtcgggactagttcggggcgtgacaagagatggtatcagaggacaggcttggccctagggcgaaacccgacgcttaggacgaccctaaggatactaagttcaaaactacttgcgaaaagctaaggtttcttttgctttctttattttcaatagtttgtttctaaaacggttactgatctttctccctctttcaaaattgtagatggcagtgaacgccagcttcagttcccacggttttggtgagggtcaccacgtcgcttagcttcgtgacctctcccgtttccttggcttctcgtgtcccgagtacacggggtactccgtggaccgtgttccccctcactg

SEQ ID NO: 7457 - DNA, 1501 bp, Oryza sativa
attgtgaatggatgagtagtgaaggtacgtgagaaaggtgaatggtgaagggttgtgattggttgacaagaaaatgttggtggagaagttgttatattttgggataaatcctgagggctaaaagttgttatattttgggacggagggagtatataataaaagtaatttataaatataaatattttttcgtcgtaatataatatgtaagatcttgttgtgaagatttaattataacaaacacactgatgtaatcggattatagatcgaataagtaatttgagataaaactttataagaaggggaaaaagacatgcatgtctaataaaaaaaggcatgcatgtgtagtaggcttctccacctctcccacgatcaaacggctatgacgcagcgtgtgtggacgaatctgaatggcgtcgcgcgataagacaatatcaagaggcctcgctgattaatttttgtgttttaggaacatagtataaaacatatttttagtactataaatatataaacatctatcttgatttgtatcaggttattatccaatctggtacgaggttgaatagagggtgtcctgtcttatcctcgttagatcatctctagtgccggttcgacttgtatagtccaccgaaaacgaatgtgtttagttggatagctgtagcatttgaagtcgaatatgggatctgtcacgccccgaactagtcccgaccggaactagcccgtgatgctccaatttagcctgttaatcgataccagtcccaggaaacagtgctggtatcacagggagacagaataccacagcaacagaggtctctttattatagagtagaggtacagtcatgttgggctgcggacagatcccaagctcacaactgcattacaaaagggaaacggaagccaggacttgggccaaacatcacaggcgcgacttgggaactaggccgaaaccctaaaactcatcgtagctggcttgctcctggaagaactcctcatcagcaggatccgcttcatcttcttcagcaactggggggggatatttatatagagcaagggtgagtacgggggtactcagcaagccaggggaaataagtgtttaatgcaggcttcaagggaaggctgttgtttttgcaattgattttatttgaactcttttctgaaaataactaagtgagtgcttctcaaacgacacggatgagacagtgcgtctcgtccggtcggagtatgtgcaatgtgtcaatctttaggattgcaacaaggttggcacccggccaatagctttttaaacggccacccgggccaacaactttccaaacggccacccgggcctagctgatcccatcagctgcagatttttcaaacatcgaaccccttttcacaacagcaatttcacaagcagtagacaaacaaaactacgctaggaatcacctcacatccgcccatgtccgtgggcacggctgttcgaacagtttgttaacctctgcagagggggtacactttacccaca

SEQ ID NO: 7458 - DNA, 1501 bp, Oryza sativa
cgcggtctctctctccaccttggccagagcagtggcggtggcggtagggagcgacggtggtggcagacgatgtcggagcactgatcgccgtcgtacgaccaaagtagcgagaacacgcaggacgtggagaaggggagagagagagtcatccccgtcaccgccggtgccgccgtcctagagatccctcgccgagctcctgtcctgccaccaccgccgtccaccaccgccgtccaccaccggtcgccgtcccgtgctccttcgctatccccgggcggagaagaaaggaagaccggggagagagggggggagagccatccgtcaccacgagttgcgtggccctggagcgttgcgatgctactgctggcttcttcctgcgatgctactgaggttgaagaaagcctctgtctaggtaattctttttgggtgtagctatatgtatggcgctatatttttcatcaaaaaatagtcggtatgtatttatattgtaagtccctaaattacatacgtaattttagtgtatttacaatgtaagtcttaaaattacatatgtaaattcgaaaattacatactattacatatgtaagtggggtgtaaatgaggtgtaactactgtgtaagtggctaaaaaaatcgattgtagcatatggcgccatatttctagcaactccgttctttttcttcttttctctcactcactccatcagctgctagctttgctagctaggagtagctagctgcttgtgctcttgctgtcgagaggaggaagaaagactcgaggtggttggctgtcatgttgtgcatggctacattcagagccccgacggtgatgtcatcgactgcgtgccgctgcacctgcaaccggcgttcgaccacccgaagctcattcatttttgtttcgatttgcagtgatcgtttctatctccggcgacgtttcttgatcgtgtttgtgactgtgtgcgcgtgcaggttgagccggagccagaggagaggcccaaggtcggcggcgcggcggtggcgcatggggaggcggcggaggaggaggtcgtgttcccgatggcgtggacggacgaggacgagtcgtgcctggaggggacgatgccgatgcggcagacgacgaagcgagacgtgctgaggtccagctcctctctctatttcaggatgaagcagcctcgtgcctgcgtgccgctggtgtcgtccgcgtgaggaagaagatgggatgggggttgctaacaggtggggtccataagctgactcagctagttaatggaggagccaccgccacgtaagtgccacgtaggacaaaaccgcctccgaaaccgctgagggaggtgatttcctctggttttcagagaagaaggaggcattatacctggttttccggttgagggatgttattcatccaagagcaagagatgagggaggtaaaatggacttattccttctgccaacggaggtgtgtcgtgttctctcggccgttggtgaagccatctgctgaaaggaag

SEQ ID NO: 7459 - DNA, 1501 bp, Oryza sativa
tgaaaataatgttaataggtcatcaatctaggtgaaaactgttagctagatgttttatttttttcttttaatatataagattttactaatttttaaaatgtgacacttggtaatttaacatgtctctaaaaggtcatacatgatgactttgtatttttctaatttttattacgtagaatgattaagatgacataatacatattgtcaattttttaatgtttcagtgttgttcgcttgttggtctatgttaaaattaagtattttaaattttacatagtaaaatatgagtaacataaatcaacggttcaaataaattaaaaataggatgttatttgggttgtcaggtaaagaataggtggcagttcaaataacacattttattttttaaagtgaaatattggtaatattgattctaaattatttagctgtctaattatgaaacaaccgttcaaacaaactaaataaaaacagatatactacctctgtttcagtttcatattataagtcattttgaacttttttaagtcaatttttaagtttgaccaagtttatagaaaatatagtaaaattttcaaaaataaaaaacatattatggatatatatggaacgttatatctaacaaaacaattttgtgtgatagatgttgttaaattttttatatatttggtcaaatctaaagaaatttaattaagaaaaaagttaaaatggcttataatatgaaatagagggagtaaatttttaaaattatgattattttgctatgtaactattatctttttttttaaattgttagttaaaaatagatttgttatttataaaagcatgcatcagatcattaatcatttatatatttaggcatgggacatgcaatcaagaatccacagccattctcgtgagatagaagtgaagaaattaattattaagtaataaaacaaaaatcttaactactatagagaaaaaaaggaaagagatgaggagaagggattgaggggaaggaaatgagaacgtacggtagtggttgaggaatgatttttttatgagataaatccaattggcccaccagttcaagttatatattttttttaatttattagagtgccacgtggtggcttaggagtgtttataggaagtttaatgaacttttagtatataataatagatagatagatatatatatatatatatattatatgttgttaataagtatttaatttatttagatggcatgcaaacttgcaaaatgcaccgtctataccacaataacatattgcttatatatagcaaaatattggatgtaaaattgtcaatttaattataaatagagcaacgttttaatagaatataaattagctatgtacatttaaattatggtcaacttaactcgtttttaatttgataacataaaataattaagaagagaaagagatagagatataaaagaataggaagaggaagagacaggagagcgtactacgttcttatggttttttctttttccggc

SEQ ID NO: 7460 - DNA, 1501 bp, Oryza sativa
aaaattccactaaaaatcctgttagtgaatttcgacatgtagaactcaagaaaaattccacatgtcagattcgattattatttgtattactttcttagggttttctcttgatttgcaccggcattttcttagggtcatttataaattaaattttaggcttgggaggagaacttcagggtgtgacatccactctctcttaaagttgagcgttcgccacctcaagattagcatgagactctttggtttgcttgtaaagccgtaccaaagcctcatttttctctctctccttagcaagttcactcttgagttcatgagaccgctctttctcacgaatgagcaattcctcttaactctcaaaggttgcatattgatcctcaattctcccaagcaactcactcaagtgtggtatggattccttggttatggatttgaacaactcgtcatccataacctcatcctcaacatcttcctccccatcactactaagatcaacattaaattgttggaattaatgaatgggccttagcccactcgaagattaattctttggaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggccgggcagggcaggcggcgcgtgtgcacgacgtacgcgtcgaatggtccgaaaaattggctcctcacccttgcgcagatgcagcctccttttgcagttttgttttgctgcaaattcggattcgattttgttttggaaacgttccgaaaaatccggggcgtgcaaatggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgccttctactctgtactgcgctgtcgctcgtaaactactccatcccgctcgccagcgtgcaccggcgatcgggagagcaggtctccggaacctctgccttcgacgtcctgcaccaggagaaggcggcaataaggtttttgggaagcgcttcgcgcgactactccctgtttgttcgcgacagctcgccttcctcttcgctcgcgtgtttcgtgccttcgtagacacctacgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatccaaaaaccttattataggcactgtgattttacta

SEQ ID NO: 7461 - DNA, 1501 bp, Oryza sativa
ttattaaaaaaatttaagtaattattaattcttttcttatcatttaattcattattaaatatacttatatatacatatagtattatatattttataaaaaaattttaaataagactaacggtggttaagcatgtgcttaaaaaaaatcggtgtcgtcaatgccccgcggtcctttctgctgccaacaaacgggagcggcggtggcttggctcacggtttgagaaaaggtctctgactggtgtgtgggcccggaatactgtagggccagcgtgtcaagggcgtggtatagattatatcgttgacctcgtctgacaagttatcttgctgcattgggcgacatagatattcatgtcgcttattgttttgcaggagccgtgttcaccctcatttcactttatgaactgtatagttacgtatagttacagacatgaaaagttttagtatgacacattgaatatacggacacacatttaaagtattaaatgtacaaattaccgattccgccgataaactgcgtgacgaatttattaagcctaattaatccatcattagcaaatgtttactgtaccgtcacattgtcaaatcatggcataatttacatgcaaattatacaattgttttttttccatccatatttaatattctatgcatgtattcgaacatttgatgtgacagaatttttaaaagtttgaagggaaaacactgccatcatatcaaatctggccttgcctctatgcgcatgcagtggggatggggaggagccgggagcaccgctgcaagcttgaaagtgcatctaggccctaatgattttaatgattgattacaatgagattagagatgactaacatttttattcaagcaaatgtgaaggttgttatttcctcgacgtgttgtaatacaatgcatatcccgagaatgcgacatcgcgttgcaatgcggcaatgatcaaatggtatattgtatctttttcctcgcattgtgtcgtaggaaagctgtactattaagggggatgatgcatagacatataagaaggagtgcttagtgtaaccttttaaggaaagggttagctaagacctggctcttagtgagctcctcaacggagagtggaatcccctcaaggatttgaactccgggatcaagtttgcaagcttcaccttggcaatatctcttcatccctctcctctagctttgcttgcttgtgccactattggtctagttgttgtatgtgtctttgattccatgtggtagacttctagatctagagacttcattttgtgtgcgctgctctgtgcattttcggaagttccgaaaattcccagcctagttccgaaaattacagcttccgctttacttaagtttttaaattagcctatccaccccccctctaggcctaattgaccttttcaattggtatcagagcctaatctcctaattaggcttaaccgcttggagagatcatgtcgggtcacacgggggatggtaatgatggtgaaaagggagc

SEQ ID NO: 7462 - DNA, 1501 bp, Oryza sativa
acaggataacaaaggatggcatagtagggtttcatttgcataaacagcatttaataaacatttcagaatttaataaaacagttaggtaataattaatcaatattaatccaacgctatacaacataccctgttgcataggcccaatcattctgaacaaccatcccggctgtacagttctatctccaaaccaggagctaatcaaattattaccagttatatcatcttttattatgatgagaggtgtgagactaaacacgaaagacattgttagacccgcccataaccgcgggcacggctattcgaatagttttactctggccagaggtgtaccactgtacccacaagacacagccccacaacatgtcaccatgtgccttaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcatgaaccggtccttaattgtcatgagcacgactctcaaaaccatgtgctcacaacccaccattatcaggttttagttggcaagtaattaattaaccaatcacgattgaccatcgtgaactatcattaagcaatcattaaataatagtgaatcataagttatcccaatagtgtgctaatgtttctaagtatggctaagcaattatatctaatacatctagttgaaccaatatatatatagcccaactagtcaagttataacaacccaaggtatcaaggaataaagtaatcaagaacaaaagggctataacaaacaataggttaattccacccaatgacattcgaaaataaatgcaatagttgaatagaaacaatagctttaaacgggatcaacatgcttaaaggattgtttgcgatctgtgtgacttgccttgctggccttggaactcttcaaattcttttcctgcgaaaacggactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagcggctagggttagcggtggaccgggcgcacggcagcggttcacgggaacgaacggccgagatcgatccatccaaaacggacggccgagatcgaacaggtctacggcggctcacggcaaacggaccctga

SEQ ID NO: 7463 - DNA, 1501 bp, Oryza sativa
aaattgtccgggcacaaaatggcgaactgtgattgttgttccaagaggaataagtgcatcttcagtaacaggaaactcccttagttttctctttagagggactccttgtgctctgaagtggcccacttcaggttttgttagatgtttttccttcttttggcctgctccaagctgataaataccaggaaaagagttccagaagttaggaacagatcttgcaaaatggaaggcaatggaccaaagttaacgatcaataactctagagatttaccaacaagtttacgtttgggccaataaaataaagtctaagagcacacgtttattacgttatgtatctgaactattcacggtggagaagagtcatctacaggtaaagcaaatacaagacatgtactccttgatgccaaaatcccagaaccaggtgcctgatctataaataagttgttgtgatgaatttcggaagtggcagggcctcagaggtaaaacaatgctactataaaatttcaacattgtcatttctacacatttttctatccacaacgggaatagacatttgcagaaaattgctacatggttttcatttcttttgcagggatatgcttcagttactgtttacagtacatctcaatgaattaccaaccaggtattggagaggccctacaatgtgtgatcagatttatattatttcctccgtttcatattataagactttagcattgtgcacattcatatactgtctagattcattaacatctatatgaacgtgggcaatactagaaaggcttataatatgaaacggagggagtatatatcatttcatgtctaaatcgaacctcaacactcttggaagccgaaaaatctccctctaaattattatgactccaacggaagagtgaagaaacactactttcatttttgaccccagcacttaataatttccagcgaaacgaactcagctgatccactggctcgcgatgtcatcgaaacaagagttcacacagagatcagaaacgcgtagcacctgaagcgcgaagaacccctccttctcggcggtcttgacctggcagacgacgttgtcgtcgacccagaggacggtgatgggcaccttggcgccccacttgtcccacatcgccgacatgccgcacttgacgccgatcacgccggtccgccgcgagtccgggcccatcacccccgcccgagcctctatgatccgtccccctcccgatccctcgccgccgccgccgccgcccccggcggcggcgtcgtcgtcgtcggggtgggagacgaggggctcggcggagaaggggcggcagcaagggggcaggcgtgggcccgcgatggagaggtggcggaggcgcgcgaggaggcccctcgagacggccgccatggtggaggcgggtgcggcggcggcgaggctggagatggtggtggtggtgggtttacgcggcggcgaggaggaaggttgggtagggtttagtgagcttcggaggccgaggggaaa

SEQ ID NO: 7464 - DNA, 1501 bp, Oryza sativa
aaaaagatctttctatgcggctggcttaacagcccgcatggaaagatctttttcgcatgcggccggcttaacagcccgcatggaaagatctttttcgcatgcggccggcttaacagcccgcatggaaagatattttttccatgcggtcccttaagccgcccgtatgcgatgatctgcgcctatatatagggagcgcggggagccaaaattttctaagtcccggctcccgcgaaaccctagccgccaggctgccaaaatttcccaagtcgccgtcgccgtcgtccccgccaccgccggctcctccccaaagtcgccccgccccacgccgtcgccgccgccgccgtcaggacctctcccccctcgcctttgccgtcgccgccgccaggacctctcccccctcgccgttgccgtcgccaccgccaggacctctcccccctcgccgtcgccgtcgccgccgccaagtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccaccccgccgtcgccgtcgccgccgcacggacctctcccccctcgccgttgccatcgcctccgccagttcgtccccgccgtcgctcggtaacatttccttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgggacttttgttaaattgagatttatgtataattgggacttttgttaaattggcacctatgttaaattgtgacttatgtttaaattgagacttatgttatattgggatttatgtataattgggacttttgttaaattgagatttatgtataattgggacttttgttaaattggcacctatgttaaattgtgacttatgtttaaattgagacttatgttatattaggatttatgtataattgtgattttcgttaaactgagatttatgtataattgggacttttgttaaattggcacctatgtcaaatggagatttatgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagattta

SEQ ID NO: 7465 - DNA, 172 bp, Oryza sativa
tccacggccatccccgcgagccccactgcgtgcgacgagcgaggcgggggcgctgcgggcgggcggatctgagggacacccaccgctgctcgccacccagtcgccgctcgctcccgccccctgcgccgcccttcctcgctgccgcctcgctgtagccgccgccgccgccaga

SEQ ID NO: 7466 - DNA, 1501 bp, Oryza sativa
aaagtaattgaaaaggatgaaaatacaagtgcaactacaacgctttccactatgccaaccacttaaaaataccagaataactcagaagcacaagaattataacatggtacaatttagaccatggacaacaaagaaatctcaagtttcaatccataaatacacaacatttttttctggaacatggtgaataatatatcacagagattgagtataatgtacatgacaaaacatttttttttctggtacaaaagacttgttattcaatgagacatctgtatgagattacttacagctccctgctcgattgtagcagaaaaatccaccatgcaactgagtatgaatgcaaatccctaaaaactcaattaccaatcagattgtttggatacaacagcaaaaacaaacttgaatctatttatcttaatgagctacatcttccattcaactaccgaagtcacacagaagaggcaacaaaggcacatagttgcacggagcattactgccagtcacttttggcttttggctcgatgtagttaatttatggatctatctttgaactataccaaaatgataataattgagaagcaacatgttacttgatctattaactcatcttcctcgggaaaatcataaattgatgatgtgctcaagtttgatgaacctacaagcagaacaatgatgtatagatgttgttgttaggaccaatttaacaaaaaatggctgaaagaatacgtgccagatcctcttatccaatatagcaagcacaccatcgcttcagctgtcttgggagttaaccagctttgataattcgatataactctctttcctatactctgaaggttgattcagagacggaacggcggaggcgggtatatatagctaggatagatcaggccatgcgagcaaaggttagatactcagaagcgttagcttgccaccaatttaggatgtccgtttcaaaaaaaaaaattaggatgtcaaaacatcacttcgagggcttatacatatatccatcatactcagaacatatttcagccgtcatctgaatgtcatggttaagatgttgatcccaatcagccaaccggtcacttgtagatactccaatatcaacatcagcactgcctgttagatccgtagtgaagttgatattagcactcactgaaagcctctcgaaaagcattcttgacattgacaatcatagactcggtatcattaccaaatgcaggcctgaaacggaactcgagaacttaagcttaaatatagggtccacgataacaggtagagatagtgccaaccaagaaatcttcaaatacttctcaaatttcttcttcctggacttgatcatcttagatatttcagtgttcacttgagaagcttgttaacggttgttaaatataccaaatttacgccgccgtcaataccagcataaatctaaaaatataaaacatccaatatagtggttgggtttatttctaacaaattccacgagtgctgatgtatattt

SEQ ID NO: 7467 - DNA, 1501 bp, Oryza sativa
cgaaactcaacataggaaataagataaaagaaagacaaattaacgtatgaatattgaaaagtacttgtactattcaaacctcaatgagtcattttcttttctctcggtgtcatttttttttgttaaaattctttctacagcgttttgcattgaattggaaagaatatgaggggatagcctatcgggcgattagaatccgtttctccgcaggtttggttcaattcgttgtctgaaatgcacttttcaaacatcgggcatagccattttgcccatttccatgctttagcatccagcttattctttactgctcacaccattgggcctaaaactgatccatcgttcagcaaataaaaataacacaggtggagaaactctctttactcccggtttgcaatggcctttaatcccggattgcaaactaggaagctcagtaaatctttagtcctggttgatataattggaacttaagattgatctttagaccggttgataatagcaaccgagacgaaagatggtaatgctatgtggatggcgctaccatctttagctctggttggtgttaacaagccggactaaagttttttttctttttctaattgtttgttgctgcttgtatgttgatttcaaaccaaactcaacaacaaaatcatttacattcaaaaaaacatcacaaaatcatccacaaattcaataacaaaatcatctacatccaaaatcactaaaaatactaaaaataatctttagtcctagttgataatactaaccgggactaaagatcaaaaagtttcattgggcttttgagccgaggctaaacatattctttagtcccgtttgtaacaggaaccgggactaatatgatttttggccgacacacgaaaagatcagttctccagtagtttaataatttgttgacaaaactttgtcctagagatttcaaagccaatgctaaaaataattattgtcattgtcatagtgtacccttctgcaagctcctcgtgtccatctgtcaataaacagtacaacatgttccatgataacagtataatacgttccatggcaacggtaaaagtaaacagcttgcttcaattcttggacttttgtttttgagagcattaaattcttggacttacgtgctctatttcaacatcacattgcacagtttgacatgcattcaggcatccagcatcgtctttacgtgttctcaactaagcttctttacgtgtttttttaagaagggtattttttacccgtcctctacatccaatcggatatatacggccattgaaatagggaacttagccccgcaaacaacccaatctgaaattcgctccataggagatttgaactcaggaccttggggtactactcaggtcactataaccactagtctacatgtcctttcataagctgcttacgtgttatttgcacagtttaaatttctccttgaaatttcaccttaatttgctcgacgtgctatatatataagtgcccatttctttcc

SEQ ID NO: 7468 - DNA, 1501 bp, Oryza sativa
cagtatttttacatggggaagagcaactgcatgtgaaaatacagtattttcgcatgcgggcgcttaagctgtcataatgcaaaaagttaaatcgaatgaaaatgaacaatccaaaaccatagtgtaacgccccacttttcgcgagacgttaaaagctaatttattaaaaatcctaattgtgaaaatttcgttctttgagtgtttgagtctaagttgtgccatagatctcaattaaaaatccctcccttgtctgcataccctgttatcaaagatcgtctcctcaaaatttccatcccaatataatcccgaagttcgatcccttctattcggagttccatcctgaaaccccacccgtgatctttgtcgaatgcccgaaccctaacccagtccaatgattcacctccgagacctaaatactcccttgtttccttcaaaccgactctcgaattcgaacttaacctctcaatttcatctctccctctctctctaccttcccttgactctctttcgaataattgatctcaactcccatatttgtaatctccctccacctatcgctctgtcattcgttgaaaccatttccgagtatttgctccgaatcccctggtgcagatccatattgaattcctttttatgaaacccaattcccgagatttcccctctctttgaaaccccatccaagtaattctagaacaatccccgagtatagatctatcccaggataatatccgttccaaataatctcgtctgaacccttctattcagatttctcttctaaatcccttacccacatatctcgtcgagtagtccaactcaaactcccaagttacactctccttctctaaattatttgactcgtctccgaatattgttcccttccttgactccttcctattatcccgagaccaagtatcgacttcgaaattcgaatccagactccagccctaaaaccttccaattaaatctctctgtgaaagtctatttaacctccctcataggttggattccttcttcctttttcctggtccacttcttccttctattccagcccatctctctccctctccctaaagtttggacctatcaatctacctacaccaatccgagagttcgaatttccgtattcggattcctcttgtaaaaccctatccgcatttgtcgtcaatcctcaaaattcaaactcattgattggttcatttcgtccctctctctttcgatcgatctacctatctacctatccatcgacctatctgtctctcgatctaatcatcgatctctctacctgtcaacccatctaactatccgtctaccgatctctctgttgatctatctatctctacgatatccatcggtccgtccgtctacctatctatctttgaaatctatcccaaagaaataccgaattcccgcttggatgcattcccttgactcctccctgttttcctgagaccaagtttcaagttcgaaatccaaattcaatttccaaatctcgtttccttcc

SEQ ID NO: 7469 - DNA, 1501 bp, Oryza sativa
ttgaataaactttgaccaacttcaacaaaaatttgagaaaacccaaaaatttcggtcgatatattgatttgccggtggggaccaaaattgcaatcactggtatccctcattgaatgtgaagtttttgagaatgacataaaaactctagctaattgaattagaggtagtgtaatacagtaccacaatctccggggagtaaacaatcgtttgcttccagcgccgcaccagcattgacgacgttctcctgcatcttcaccggggaagctaggccaaaactgaggtgtggccatggagaaagaaaaaacggtctcaatagttaacagaggcacaaagatattgcgtgaatattcgcgtcgaacgagatcccgtgaatcgcttatctggacttgcttcagcggccacgttgattttctttttgttacgttgcattcgctatgcgcgaacatctcgttgatgccccgcgtgtttagtgggatttcaaaattcttactgataaacattgctgattaatctttgtatgtttctttttttttactcatcagttgttgtttttttcgataacataatgtggagtacgtgtttctcaagtaggctgctaagaaataacaaaatattttcttccgttggttgctaggccaacagccaactgcatacatgagatattttgctttgaagtaattatggcttgctttgaagtaattatggcttagtgcaggggtggagctagagtattgagggggtgtctgagagcccggtcaagaaaaatttgttgctatatttgatctattttcaccatgtgttcacctccatcaatcataggctgttgttaaatctgatcacctagctttttggaagaaagcctgaaacttaagaccaaagtcttatacgaaagaaagaactaccaaaagtaaactatatcggtcagaccaaattgggtatgacccgatgtgttctgcagtgagcccaaagcaccttgtaagacctctgataccaaccgcaagtaccacacatatttgaatgagtaggatccatatgtacaatcatatatatatatagccactcactctgaatgtgtccatgtccacgattggcatctttcaatataataaccacaacaccaagtaataagcaaaggagaaacctttgatagaatagttagccagttattaacttcaacctaagcatgttaaaccactcgaaggcaatgaccaagcaggatacttgtcttggggactcgagctataacactaaatttcacagtcatctcaattgctcaaaacttatactcttgcttcactaatcctgtgaaagcaactagcagcttgcactttataagcaaaacataaaaatattagagcatttgtgtcatatgaaaaataattctatagagcccattgaagaaaggactaatttttaaccaatcccctttaaaattctaacgaaatagactattgtagatgaatttcggagggagaataagcatgaggccccacctcccgtc

SEQ ID NO: 7470 - DNA, 1501 bp, Oryza sativa
gatgtttctttgccacgtggtaggttaggagcgtttgtagagtgccacgtgacgatccaggagcgtttgtaggaagtttagtggacttttagtactccctccgtactcataaaggaagtcgtttaggacaatgtttaagtcaaaccctaagaatataaatcatgaataactttcaaattgttgagtttgaaaatgtaaaaattatatgaatatatttgtcttgaaaaatactttcataaaagtatacatatatcacttttcaataaatatttttatagaaacaagaagtcaaagttgtgttttggagaccgtgtcgttgtcttaaacgacttcctttatgagtatggagggagtatataatagatagatagatatgcaagtgtgctacatcatcatctactagtaattattatatagattattttaaatatcatataaatatgacatatcatttataatattgttgtatttttagaacttaatatatatgtaatcaatgtcgaaccattatctccacatcatttatatattatttaaacatatatatctatcatgtataatatgcattcatctatatattccacggcaaagtgtggtgtatcgactaggattctatataagtacagcagctgtaagcattaaaggctgcctggaaccacacacaaagcaggcagccaagcatagcccacagcaagctcgaccatggcgtccctctcctccctcctcctcggctgcttcctcctcgcagccgccatcttcctccaccgcaacggcgcctccaccactaccacccacctccatttctacatgcacgacgcctacaccggcccggctcccaccgccatgcgcgtcgtctccggccgctccttgctcgacgatggcggtgacgcggtgccgcgtcagttcggcgacatcgtggcgctgaacaacgcgctgacggaggggccatccgccggcagcacgcgcgtgggcacggcgcaggggttcgcggtgcgggtgtcggagggcggcatgtgtggagattatggatacccatatctacatgacagttgtaatttagtcggatatacggtaccaaatatagatggaatatctctatgaagactcgggttaggttctaaacttgtatgtcaaggaaatacccgggatcttagtcggttacgtttgtattttatctataatcccatattccgttaggatatggattgtattttgtaaagcggactccttcccctatataaagagggtccgtgtgcctcttgggcgcgattctttttcccaatttatacaatcaataacacactcggcggaatcatccccggacaggagtagggtattacttcttgaataagaaggcccgaacttgtataaaattcttcgtctccaaacccatccactttcctagcttgatagccacccccttttattattgccgaaatcttgtttcgacagttggcgcgctaggtaggggtagcgtcaagttctcaccgactaagtgcga

SEQ ID NO: 7471 - DNA, 1501 bp, Oryza sativa
ctacattctctgggaaagaaactcttcgtggtatttgaaataactatactattacaggagctatgaaaaaaaataaaaaattaaaataattggaaatttttaatattggacttgttttgttatatattttgagtgaagtacgatcgttcaaatatgtagatgtttaaaataatattgtcgatgttttaggtcacaactacatggtaaggggattgtcggtaccaaggtttatgcaagattgaggtaaaagagatagagacaaggatttttatacaaggatttttatacaggttcgggccccttatttggcaagtaatatccctactcctgttggccgaagccggtgttgctatttattcatcataatcacaccagtacaaaatttgggataatctatcaaccgttgtcgacttggcggcctagaataccatgatgtagtcgacaacgggatagtcttcctccttgaatccgcactcggcgagattagagatagcgctagatcccttgttagcctctacaggcactatattgggtttgtctaggcttatttttgatgttgatatctggcagcttgtcttggcgtgtgtttgcttgtattggtctgtgtctatcttgattgtccccctctcctcctagggggtctatttatacccataggtgtccccttgaccaaatagaactatagggaccaatatggatacaatccgagtagtccctatagtttccatatagaactctacttgtccttccttattcaaaatacctttcataagtgaggcctaattccatataagacttgatatgtggtgggtcccgccgtgcttaattaactactattaggtacgtataagacttgatatgtgttgggtcccgccgtgcttaattaactactattaggtatgtggtatttataaccatgacaaatatatataccgttgaaaagatataagtgattaaaaaaatactactccctccgtcctaaaatataagcatttttagcatagtgtcaagtcaaacttttaacattgactattaatagaaaaaataaaaaatatccatcatgtaaaattgatgttactagatttatcattaagcaaactatcataatatgtattttttttatttacaacatcctatttttatatatcatcttgaagactgtgtcgaagtctaaaaaatgattatattttacgacggagagagtacatcaatggtactgtttctcatagcatgtgaatagcatgctacattctttttgaaaatatgagtatgaccagataagatactttactatttttgataaggccaagtttatatgggactaaaacttttgataaggcccagtttacatgggactaaaactttttagttcctctccatcgaatgtttgacgctaatttggtctattaaacattaactaataataaaactaattgtataaatgagagctaattcgcgagatgaattttttaagcctaattaatccataattagcaaaagt

SEQ ID NO: 7472 - DNA, 263 bp, Oryza sativa
caaattgtaaaaagtattcataaaggcatggggcgtatccatatcttgccctaaagatttgagctatccatttcaatatcccccgccccataagggccagaatagcgggatggtttcatactcttgggatggcacatgaatcgactcaaatagtatattcaaagctttaacccatatcaaaaattccttcatagtcaagctaagatgtatgacagatagaaccttggctgtaagataagtcgacaatggtcggagcacggtca

SEQ ID NO: 7473 - DNA, 1501 bp, Oryza sativa
agactccatatcgctaaaacaattagacatatacacatattgcattacaattgaagatgttatccaatttcaatcccattttagtacggacaattagccataaacacatggtgagcttctcaaattattttgtacagcaagtaccaaagtaatttaacagcgaggataagaaaaagatgattccataagaatgtataaaaaaacacacacagatatattaaaaatggtgatacttatgttctttttttttaatcatggattttttttgttcaaattatatgctggaaagctacaccaaccaatgaaaaataaatttaggatatatctgagaatatggaattattttgttaacattaatgatttgtttattattttgttaacatggaaataggtgtgtatttacattattcgggaggcgggaatcgaatgagaagtccatttatatattaacttcttgtgtcacacatgcacataatctgatttcaattatctcactgatgtatgctatagtgggagggaggaaaattaaactgcaagtatatattcatttgtattcattatttatctctacttcagtaactttttcacaaatgcataataggctaatagccattgataatttaatattaggattatttacattattcaggaagcggcaattaaatgaaaagtccatttatataataaattttgtgtcacacatgcacataatctgatatcaataatctcactgatgatgtatgctacagtgggagagaggaaaattaaactgcaagtatatataagaaaaaaaagctgctcaccgagtccaggcagacttgccgtaggcacgtgtccaggcagatcgagcactcgatcaggggaaagggcggcgaggacttcctggcaatcggctgcggtggctgaatgttttgcctctagcttcttatctaaggcgttggtttggttgattctggatcgctggatttgataaatgaggtttgtaggattataattggtgaattatagggtagaagaagatagtatatatgccggcagtccacataaactatgtagattcccttatttgaccagtgaacattagttagaatatagattgaaaatttaatcatgcatgaggtccattcaacttagaagctaaaagaatatacaatatagattatgaaatgggattctgcaattttgtataaacgagatgatgcaataatctgaattttttttaaaaaaaataaaaaaacacattgtggagattatgggtaccccatacccacacggcatggttatccgactagtaataggggataacatatatgtatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggggggcagggagcccctctaggggca

SEQ ID NO: 7474 - DNA, 1501 bp, Oryza sativa
  unsure (1)..(1501): unsure at all n locations
taaacccctagggattgaagtattagatcaggctgtcaataattatcgtagcatcaatcgaactcggaaatacatgcatcgacgaactgatcatttatgcatacgtactgcaanattaaatggcacttcgtgaacgaggcgaattcagactttcagaaaaatgtaacgctgaccgtgctaatataagcttcagaatcccaaatgcataccgctcgtccaataatcaatccaacaagcatataccctataatgctctcttctagagctagcctagacaagtgctccattccatgaccatgtagatgtagctagccttatctgctcaacaacacccatcccattcaattgtccaccgtctttagctcttgttaaacctatctttttcagatagatcaaaaggggagctacgcatgcaagaatcatgttgcgacagtaatggtcgccatggccttcgattcctatatcataaaatcatttctatggatcaagtggtgtcgccaatttctaggatgataatgggtcggctggtaaagttgggaatcatgcatatacatcagactatcagagtgttcagctatccgcactgatgagctgtaggctgttctttttcttccagcctccaactgatatattgtactacgtatattaatttgtagctagtcagccacaatgcatgagcattcagtggactaaccacattgggttctctatgattagtgctaatgcattggtgatcactttgtgttgcttgcctggtggtcctctgagggacacgtgtgtcaccttttcgtttttctttgaaacgtaggtttccaagtgatagaacattatagactagctttgataatggtggcaacaaaattaatcgatcactatcgctcaagagctcagttggtgagagattcggtgcgcattggcacgaaccaactaggtttaatttggctctatggaactcatattaaaatgcacttcattttcttaacgaaaagtaacatatccctccattttctctgtagaaaagtcatagtcactgatgaagactgcatatatgtattgtagtggatcagcgcaacagggtaaatatatgcatggtgcatataatttcaaacattaatattggaagaatggacgtatatagtatgaaaatcatcaaagatttgtttcagagtacgtacttataattcaaatatcatacttcaatgggtacaacaaagaaaccactgaaaaaatatttttctaaaatataagtcactacaaaagtaaatggtatttcttccgctttcaaatatttgttcacgttaactattactattccaactttggccatttaataactcttaaaagactagtccatgataaatgaaagtttcatggttatgtttaatgtgtgtaatacatagtatgttattttcttatatatctataatttttccacataaaaggcaaatcagagtttgcaaatgaacaatgtcttacgccagtcttttttttgaaggagtga

SEQ ID NO: 7475 - DNA, 1501 bp, Oryza sativa
tacttagatcatgatgctgtttcctaagggttacaatgttttacctccattaggattgagtcgactagacgttagacataacaagcaatcatgaggcaagaaagttgtagcccactagtctagctcgcgagccttagccacttcacatcaatctagggccactcacagcgcgccaccaagttttatcgttcttcacatgccacgtagatcaagaacagtataagctgcatgctccacagtgcaagttacatatagcgggttaggtctatatccagctttagctaatatattgacgtgtaatcattttaggtgttaaaaaaaatagttatccatctttagggttgagtgacgcaagaatttggccagagaatcaattgtctccctcctagacaagtccaatggcgactctgttcatcatttggccagaggtgtcgtaatcaacatgcccgtacctaacggcatcatgtcggagtactaaagagcccagctacgattcatctacggacgtcgtccttactaatcccgaactcgatcaatcaaaacgtaacctttcaggtattgaaaacttaccactactccagtaaatcacagcgtgtaatccgctgtcacaaaacacaaactcccaacagacacatcaagggcgcaattacactctcaccagcagcaacagtcgtcctcgagaccgatttgtgaccgcaattaaatcactcgctcatcgtacagtacgtacgaacgatgtgcatcgaccgtcgatgccctggatggaatggccgggccacttccttcgcccatggggcaaaccaggcgaaccttccccgaatcgcaggccttcgcgcacatggcggcaatgccgtcgtgttggctcgtccgtccggatcacgatctgctgcttccgcgcgaaccgaactgcactgcaggccatgaactgtaaagccgaggctggccgcggccccgtgtgacgtacgatccgcgagcaaagccgagcaaaagcgccacaaaagctgcacactttaccacgtactcgcatccatccgtccatcggcaggcatcacctgcccggtttacgggttaccgctttcgcggatgcccccccggggatgggtgtggtgtggtcaagtaaagtcccccgcgtctctggcccccacaccccggcgtaggcacgcggcggctggatccagcgtgcgtccagccatgcatcgcccccgccccaaatctatccggcgctctgcagcgacgcgctccgtgccgcatttacttctttaaccgtgtacgcgacgcgccaccccagccggcatttgcccgtcggataccacctgtctgcccgcagctctgctattgctagctgccccggccacgcccaagtataaataccggctcataggcaagtgcttcgccatcccattccagtgaccaatccacactgatcccagtagctctcattgtcctcacgcttcgactcgcttgctagatctttgggttcttgtgtgttgtgatcgcgcga

SEQ ID NO: 7476 - DNA, 864 bp, Oryza sativa
cagaggggttcacgtggcaatgtgaaagtaaagtagggaactcccatgacgtgctgtgggttccacatgatgtagtaggtgtgaaagactgtgtggggtcaaccaaaggcggaattgttgctcgctctgcccctgcccctgcgtgaacacgttggtgtgcagcgtgtacggctcgccggtcacgttccccaggaactggaagtcgatctcatcgtgggtggaaccctccggcgtcatctgcagcccaaagctcagaagatcactcaaaccatcagcttcattactccactttagtgccgtttttttgccgaatttggtagatgaataaatgatgaagtgatgagaccgtttgggaaggaagataagcttacgtataaggtggtcccggtgccggcggagttgccgggaccgagcttgatctgcatgtcgatcttgcctaagaggtactcgctcttggcctggaacccagagccgaagctcctgtcaagcgtaaggtggagcccacgcccaccattgtcgatcttgccgcggccctgcccccacgacacctccgcgtcctggaagaagttgcctccatgcgcaatggcccccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgta

SEQ ID NO: 7477 - DNA, 1501 bp, Oryza sativa
aaaaaaaataatattgaaagaagaatccacataagaacccaatatgtgattaattaaaattcagaataaaaaataaaataatatccaaaattagataaattaaaagagagttcaagtaggaatacaattttgaaacaaccgaaatctatattattataaaaattgaagatgtttttgccggtatcaaaaaaacagaaaaaaaaaacttctatctaaaaaaacgaccgactcctccggtggaaaaaaaagaaaaaatgagaaaaagaaattctatgttaaaaaaaaacgtccgactccataaaaaagtccgactatctgtggagaaaaaaggcaagaaaaaataaaaaaagagaaaaaaaacttctaccgtataaaaaaaataaaaacgaccgattcctcaaaaaaaagtacgattgcctcgaaaatgactttttgtccgtaatcttctcttctcttctacttctacttttttttttgaaaaaacctctactattatgaaaaatttaagatgttcttttgtcggtattttggtatgtcatccgtgtatgagtcggtttataaatttgttcgcttttgaaaaaatatatatcctttgagttgattcttaagttcgtccgcttttggaaatataggagtcgtataaaaaaattcgcatgctgactttagacgaacagactcctaaccgcagcttatgattttatagaaatatatagatccaagcgaattctcacagtgaattaagactaaaatagttgtcatccgttgcagcgcacgggcttttctcttgaaaataaaaaataaaaatattaaaagaacacaatacgatattaattaaaatttaggaaaaatttttataaaattacaaaacaaaaaataacttttcaatttataattaaataaaatttatgataaaaataaagactattgaaagaaaagaccatctaaaagacctgacgagataaattaagtaataggcctatagtagagtagagtggtggcggttgatacaacatataaaaactgttaataaaacaccaaatagaatcctaataacgattaaaaggagggacggtaggaaggccgtgaagcaaacgaacaaggtgattgtcgggacttctaaaaagtaaaaaaaaaccccaatgataatcatattcgatttttaaaatctcaatgataataaaaaggagaagcagcgggcggggtgtacaggagtatagttgcagagccgccgacggttgacgggacttctaggaaataaaaaatgaattccaacgatagttatgttcgatttttaaaatcacaatgacaataaagagtaagcggcgtacgggccatagaggagcatagtggcatcgtgtgacgagacttctaaaaattattaaaaataaaacccaacaagacaataaactctaaaaactataaggttcaatttttaaaggttcggaacttctaaaaagtaaaacaaaaacaatgataatcatgtttaattttaaaatctcaa

SEQ ID NO: 7478 - DNA, 760 bp, Oryza sativa
aaattctactacatttgtttttttatttaacgttggttagtttaaaatgaaacttttgaactaaccaatgtcatctaaataaaaatggagggagtaaaatttaatttttaagctgtggcagacaagccaatgatcagcacaatggcaagttgaattagccgcaagagcatttgttctgggcttctggccgaagttcacacacgcctatgatcagtagctctacgtaactgtaaagctgatttctgacgaagaaacggcccgtaataagagtgccacaagcccacaatgtacatatctgtagaacggccggtggcttgcattgcttcagtactccatgcggctttggcaagttagaatgagctgtgaattagtcaccgacataatctgctacttgcatatcactttaaccagactctccaattaattacaaagcacatggttactgtatatacagtagtactaagtgcagcttcagcttaaattaaccaaacagtttaagaccatcgaagcccagcacattctcaaccctcacgccaccctacactatatatacccatgtaaatgcgattgccaaacatcacgtcactttcacagatcatcatcctgatcaatcgaaacagaaactgtatctagctagctgcctatcttgatcgccagccaagcttttggaagactcacgcaacagctagctagctagcacgaagcagatagagtcgtcactgagcaagcaagcaagaagagtgatcgatcgatcgatcaa

SEQ ID NO: 7479 - DNA, 1056 bp, Oryza sativa
  unsure (1)..(1056): unsure at all n locations
tatgctagcttggtacccttgtgaaaatggcttttagccatttgcaaatatcatttctgtagtagtgttgaagtcctagtaaaaaaaatgcgataaacaatccatccatctcgtaattctgctaacatgattcctccgatctcacaattctgctaaaatgatttctccgagaaactaccgttcaattaagatgggttttactcggtttttcttcgtagatcggatgcatcggccagtttatccattactcgaaaaagggacttcacgggaatacgcattttttcaggtccattttatggtttcccttggaaaacttgtactagtaattaagtgatcatggcttcttacatacgagtacgcagtgaccatatatttttaaaaaatagtataatttacggtggtctttttacttgtaatattctttaacaaatatattaagagatgtgcttctatacttctaaaaaaaggttgcacgaaaatcaaaccacataggtggctgagattaaaagagagataaacactctaatcttattagcgaggggtattttcatccatgaaattttgagccccggtccactttggagcgataccaaattaccaatgggaacgcgnattcctccacgactacgaccgctagtccgggatgctctctccttgggtagcgccgctcctcagcctcgcaagcaccgcccgcgctttccttgcctcgccacctcccctctctcttcctcccctcgttgcccggcttcctcttgcaaacagcgccgccgctccgccctcttcttcctctcgacgcgcggtgcagcacgacgctccattttgtccatctcacagccagtagtcataaaacaagtatctgcatgccattatgtctaccccgttcatttacagctcaccaccatcacaagtcacatcgaacttgccgttgcagattgcagacagacaaatatcaaacaagccaaagcacgaagggcacaagcttattttgtgttatttcttctgtttaaactttggttcaatcgaattgcgacttggccttaaatgaggtgtagatca

SEQ ID NO: 7480 - DNA, 789 bp, Oryza sativa
cccctctacggcgtcgggggggttggtcctccttgccggcggcgttcgtcgtcgtcgtcgtcgcattgaggggggagaggtgatccgcccgtagtccattccagctcggggaagggggggggcatgggggcaactggtccgcgtggtggtgccgccgctctcgaattcgtgcggggattttggttttgaagagggaggtgacccgcacgcgccgatctggtgaggccttgctcgttttgtgctgttttttgtgcctagctttggtcggaggtgtttgaattgttggggaattttgagcttttgctgtgatctgagcttcaaatttcggtgggggttaacttggcctgggcacctcggaatttctgtttaatttttggtggggtttctttgatcacaagatacttgcttgcttggagctttgggagcccgaggcgcattaaattccacatcttctgcgctgttttatcgggaaattaaacatttcgtgctcaagtctgtgggggggtttttccctcggatttgtcaaatctggcggctcttgttcgaaaattttcatcttgggagcttacgaacgcaaaattcttcacatttcttttgcttcctggcttggaagctgtggaatccaaatttttatgtgctgaattgacatggttagccatgttttttttccacagaaccacatgattttagcaaaatttcgccatttctactttgatccggtggaatctagttgccagatgtgtcgactggtaccttgtctaactagctccatggctatgcgcttgcagg

SEQ ID NO: 7481 - DNA, 1151 bp, Oryza sativa
  unsure (1)..(1151): unsure at all n locations
gagccttgattgccnnttgganaancgaccttgtaccccaatcagtattagaaaaaacaatacagattaattaaattttaactattaaaaacttgaaaaacctagacttatctgatattttaaggtaacctttatatataaaaaagttttcatacgaaatatgttatttaacagtttaaaagaatactaatgaaaattaagataaaagaaaagaacggagtctaagcgtgagggtcggggggggggggacctccccttcgtcctttcttgagttgcttcctcccttgtcatggcagctcttgcaaggaggtgagcaagcaagcagccccctgttgtttgtgaattctggtcacaaatcttttagttgcatgtcttgcgcatcttctctcttgctgtagctagcttccaatgtgcgtgtgtgtgtggtacgaacgggtacgtcccctctctactctgggtgtttctcacatcgatgtgtcacttttgtaggatatgtgtgtgccactgtgtggttcccctcgacttttgtttcccttggcacaaagaaacaaatgggataaaattagcggacaagaggcattttgtaagcttgtatcaaaatcggaagatatatgtagcacacgagcttaattatactcctccatgccctattcacgagaaaaaatatctaataattttaacatacatctaaacaaaattagaggtttggccttacgtggtacagatatacaaccatcgaccgtatactcacgtgcgcatgtacttctactctggatcgatatcggtcctgaggaaaatgcgagcctaacaatatattagtttctaatatgctttcgcaacattcttcccattcaaaactatataaatatatatttatatctcattatgtgtttgtccaaaggtgaaaagagaatgacaggatgcaattaataacttggggatggggaagacacgggaccggctgagtatatatagaacgatggcggatggatctcctctctatctcctgcctacgagctgctttgtttgcttgcaggatttttagctgtactttgctaggggatgccacaggcttctaaaaagtatgcccattttgttcccatgcgtttgttgcattccttggctgcattttttttttgtatggtttcagg

SEQ ID NO: 7482 - DNA, 1224 bp, Oryza sativa
tcccgctcctttggtgtgggcattattaaatgaagggagaaggggtggcgtgtgcacaagcgcaaggctacaaaaagccttgctcaaaagtcagggcctcgcaccgtacgtgctgtttcatcggttttcagagcccctccggccggaattaccgaatagccggtacggatgaaaacggtcggaaacgataccttaattttgttttttttgttttttttaaaaaaaagcgggtggaaatggtgggaaaattttcatattaatgaattgaactatatagtatcacttcggtatcacggtgatatgaattgaaaaaaactaaattttgacaacaagaaccgtcggtaaatatattatcactattaattttacggaacgggtatcggtacggtcggaaaatttttataccattttcacccttagccgaaatccttcccacccgctgcttatgaaaaatatgatttgtaaaacgtaaaaatgatcaaacaaatacctccctcctaaaatatacaaggagtaagaagttttaagaattagatcgtagtgttaaaaaagtaagtgaaattaaacataaaaaagattatgttttcgaaagagtagtataggtgaagaatttaaatggtcgaaggttatgattggttgagaatagaatataggtgaacaagttattatattttaaaataaattttgaatgctatatgtcataatattttcggtataaattaagaactctagaagtagtaagggtgcattctatatagcttttcacaacagctatttcatcgttctctgtgaacacattttccaaactagttctatttttgttctaaaatataatgggatattttctgggtctattttggagggagtagaagttattcctatttatctgttttttttttcacagagtccaaatcttttgtctgcacaattggactggacccagtgtagggaattttttcatttttaaatttatattttttaatacatatagaaatattataccggcaaaaatatttaaaaaatagactctgccgccctccccggaatagaagttattcctatttctatgttttttttcaaatagcccaaatcttttgtcctcacgactggactggacccggtgtagggaatttttttcattttcaaatttatatttttaatatttatagaaatattataccggcaaaaatatttaaaaaatagacactgtcgccctcgggcagg

SEQ ID NO: 7483 - DNA, 185 bp, Oryza sativa
  unsure (1)..(185): unsure at all n locations
gcggacacatctttctccgaaaagtaacgtgacgaacagctgatctgagctggaagtatcgtaacactactaaccaatcagcgactattcttcttttttcacaggcacgtcgaaagacaagcagcgggagcagcaggccgcatcgagaggcacgccaccgccgccgccgcngangacgcagcagc

SEQ ID NO: 7484 - DNA, 1501 bp, Oryza sativa
gtgtggaattacaggggtgtatctgcaggctgcgatattttactggaaaaaaaatatctaaagccattttttttgatatttcgaaccatttaattgactgaaacaaaatgtacatttagtcatatgctctctactaaacgtgcattaggatgctagggatgttctttttttaaacggtgggagtaaaatgtatatataggttgactttaactgattgaccttaaacatagagttgccataggctgtgttcggcattccctcttcccaacccctatccctcgttttccacgcacacgcttttaaaacggctaaacggtgcatttttttaaaaaagtttctatacgagagttgcttaaaaaatcaaattaattaattttttaaaaaatagctaatacttaattaatcacgcgctaatggaacgctccgtttttcgtacagacggttctagctgggaaccaggaatagcgaacacatccatagtctctaaatctccacgtagccctttctgaataaaataaagaccacaaaacgatcatcaaattttacgcttgttatctacttgtattagaatggatatagatgcattagtgatttatatgcttcattttatagctatataaataatgtgaaaacttagttagaaccacatactacataggatcctgcccccaaatatcctcgagtacattggaaacctaccaccaccactggcaattaacaattcctctattcaccactaaccaattgctaaccgagtgccaaaatccaccccaagaccttcttcagtgcaacagataatcatagaagagagagaagaaagataaggattagcagtaacactagaataaatttaagcatcagggcctaaaaaatgcaccatgaaaagagagaaaaggtgggaaagaaagcaagcacaaaaagaaaataaatatagattgagtaacaaacaagccaaagctaaagtctttcttctctctcctatgcctacccccttgctaatcccctctctctctccttatttgtgtgccttccaagtgcaaccctaacaagtctcctacttaaaaaaagaaaaaaatatatcgttttgctaatttacttttgtcattcttatttttgggattgctaaattctcctcctctaggagtacactagtacagtacttggatatcccaaaaacttttttttatatttatttgtagttggatatcccaaaaactatttttttaatatatatttatttaaggcaggggaggggaggagaaaaggaaaagagggagaagtaattaagcaacagtgaggccggagctatctatctatccatctatctatcatctactatccttcctctctttcctcctcctcgcgcagccgcgctcagatccaaagccgcgcgcgggggagggagggaggaatcgcggtgccaagaaacgaagccctagccccccctagatgcgcgccgccgcttgctgctgctgctgctgctagggttcttgtacggaga

SEQ ID NO: 7485 - DNA, 877 bp, Oryza sativa
  unsure (1)..(877): unsure at all n locations
agtggtgaaanctgagacactgagtccccnattnnaaantagaactttacaaaaacgacggttatttacatgcgcttggacactctatttgatatatccgttttctaaatatgtcacaagaactatttggtaacaaaaagaaatacgtatgcgagtatgacttatgggactgacttctatgaagggaaataatatgatcaacccatcttcctttccttccttcacccagggttaacaatctcaacgaaaaccatttgattttttaaaactttaagcttcttgaaccaagctaaagtcagttctctaggagaactttgaatgttttttgagaaacccaaatttgaaatagttaatctgattgaaattccttggtgttcgatatccttaacaagattctaaaccctgcttttgcctgattatccgaacatataattttaatcgacataatgtattatagcaaacaagcggaactatttgtgaccgcaggacaatagccgattttgccctcgccaaaggcgctactaatattaatcgcgcggagaggatgaaggaccaatttgccctcatatcttgttgagccaatgcatggagactgatggacccttccctatccatccgaataacgctcagcttcgacaattaatcaacatggtcgattctccttttgcatcatcatcagtggcgaagctacagggggggccggggtgggccaacacccccctatcagatttgggccgaccccccccccaaaaccctcttctatctccctggtagtggtaagcccaatagcccaaggcaagttctcatctcagcccaccattaggaaaaaaacgcctcgccttcttcgttaattcctcgtctcgatcaccccgctagc

SEQ ID NO: 7486 - DNA, 511 bp, Oryza sativa
ccagatcacacataaatgatttttcctctttaacatacacaaatgatgtgtcatctgatcaagaagaggaaaaaaagggagcacacaatcaccagatcttggcttggacaagaaacagaaaaccataacatacttgaacaagaatacagaaagcacacaatcaccttctgatggcatatactaatcaacttgctagaattaatccccttgatactattagtggcacaatccatttatgatcccaaccacttaatccatccaatcagagagagtgcaaaataatgtggggtcttagctgtggcactgaacaaagtgacaaaccaacaaccatcccctacctggccttttctaattaagccaccctatctctacacagacacacaccatctatctacttacatctatcacctcatgttctcacctactaattgattaatattaatcctgcaattaaatacatatcctatgcaagataggcacttgttccctcatttcttttccataaagtagg

SEQ ID NO: 7487 - DNA, 802 bp, Oryza sativa
attcctgcagcccccaaatgcgtcctgggcgaagactaaatggcgaagggtgcatgccgaaggaggatgacttcgccgtttcaaccccagctccaaggaggcccaaggggccatcccagccgctctagcccattggccagtgggccagcgttcgctaattggcccgttagaggcccatgtatctcaattacactgtatacccatacaagtgtccctttcataagggcaaccatgtaaattcccctgtaaaatctaaaccctaatagggggatctgtaataggactataactagacccctagggccatgtaaagggaggatcctaagaaaaatccttgaattaatacactttattgttcccaacaactgttgagtaaccacgtccttcgacgtatgcagttgtcgtatgcttgctaatataaatacctttgaatttggggagaatatcttcatcaagtgtggcaaccaatatttcatgaatattttgttcacaaaatatattgaagtgttgcctagttctaaacttgttgccatgatgattatcgtcttgaagttaatttggcgaatgctaggtagatcaaatctcttgcttaatcaaaaccccaagaagttttctagtaatacctcacaaataccggaaaaactttatccgatctttacccgtttagtatcaattttctaaatacaaacctagcatgttcatcataaaccacaatggtcatgaaattaataaaaatattcctaacacatgaaatttcttatcataattattttcttcaaaaatataaaataattgggctaga

SEQ ID NO: 7488 - DNA, 1501 bp, Oryza sativa
atcctaataaaacatgcaagagccctccagcatctctgtatttctctctcttctttttgttgcaaaagaattatggctcttaataatggaaatcggatgatccgaactaattaattcaattgtgccgtaatttcacccaaactctagatactctgattacaacaaatgtgcatatagtatatttcacattatttgatgagctctagtcatccatggtctcggatcattcatctgagcaaaaattgaaattttacactctactatagctgtgttctttccggtaagttccaaattcacctcccaaacatagcctgtgtatttttctagaatcctaagttaaagcacataatattaaaggaaatggcactcaacattcacaataaaacttatatatacattgtatgagatttcctaatgtaggctcagccaccttagatcatccatacagccgtgtttataacggatttcaataagattttcataagtggttcatgcattgtctcattataaatccaatctaagccataggttacacaagttatacataaatttgatggtctatatgattctctttctaattgatagccttttcagaatcctagaacgggcttacgatttttcatgccgtcaacctattttttttctctggtggctatacatgatcaccgccagcgaaaatactctaaggggtggggggctatggactgccagtgaaaatggatattcgctggcagcaaggttaagagggccgctagcgaagatgtacaccttttcgctggcggcgcacttaaacatctgccaatgaaaatttgattttcaccgggggtttttctgtggctactaaaaggcgacattaaaaaggccacccattactcctcctcccctaaagaagcagatactattggcactacgccagatcgtcacacctctgacgggatacctgtgacgggcaaacgatttggtcactagtgaccattacctctgacgggtcagacgggataacgtcaccggtgagccatccggccgcggaccgtcacaggtatcccctcacctgtgacgggccgaaaggaaaacccgtcaaaggtataccagtgacgagttttgcttccaacccatcactggtatcccctcacctgtgacgggccgatacattagaagccgtcaaaggtgatgggccgccacctgtgacggctttcatttctggcccgtcacaggtgaggggataccagtgacgggccactgaatagaagcccgtcaaaggtatgaccaatacctttgacgggctttttttatctaacccgtttgaggtgtgttgggtctataaatacccctcaaactgccaactgctttccatcccgaccattttactgttcacaaatcggttgggagggcaaggggggcgattttttgctaaaattcaaggtaaaaaacacattattctccattcattctcaacatatcgattatcatttatttttcttcgtatgttgttgatttcaga

SEQ ID NO: 7489 - DNA, 1501 bp, Oryza sativa
agccgtacccgcggttatgggtgagttgagcaatgttcttcgtgattagtctcacactactcattaatggtaataatgtgtaattaatttaattcctggtttggaatggttaattcctggtttggagggttaatttgttcaactggggttggttgttcaaatatggttgggcctatgcaacacgggtgtgttgtatggtgtttatttaatattgactaattattcaactgttttactattctcttaaatatttattaaatgctgttttctgcaaatgagctatattatgccatcctttgttatcttgtgcacttgcatatttgctgtgtggcttgttgagtatatcatatgctcattcttgcaatattcattcatcagaagaggagtatctcagtgaaggtgatgatctggaggattaggcttgttctggttaagttgcttgtggagtggagtcgccatagctgttccgtagtttgttatagttttattttccgctgcgtagaatgttatttttctttgagaggaactatctacctctgtaataattttaatttgcaaatattcaatagttatttatttgtactctattattaatttgtcattgtgtgcctcggttgattcctggacgagggtttatcacacatgtaagcgtttggaattttggatagaaattccgggcgtgacaatagtcccggttggtgtcataaaccgggactctaaaattcaacgcgtattatataatccctctcccttattctctcctccacaaccggcctcttcgcagttatgctctcctccacaaccggcctcttatcctctcctccacaaccagcctctcatctcctcatatcgatcccttcctcctttcctcccctccccctctccttctttttggaaatgggactattgtggttttgggtcgacccaacaaagatcagctttctagtagtggttccttctctagtccaagagtccgcgctgctcatgcttgtactgcgggggatgttagagtatatggataagatcgtattgtatccggtttgccatggtaggataggattagtttctatctctatctcttaaagttatttaagacctaatctatgtaataacctatatataccggtcctttgaggctcaatacaataattcacgttacccagtatatctcttttcttatacaatccaacagaaaaacaggcaggtagtgatcttgaacctgcctgtaggagaatgagagtagcatagagagtcacaccaagtgtagtagtgggctccttatatgtgctataaattctcttatactttaggccagagatagtacgagttccagaacatcctggtggttgtatccaagaaaatatgtgtcccatacatactcgcacatcacctttgtcgctgtatatgatgccgtgatgggctttaagctagcagtctatgtgtaccgtggaggatgagtaaccaaacacagctgtccttaggctatcaagtcatgtaagta

SEQ ID NO: 7490 - DNA, 1501 bp, Oryza sativa
attctaagtctagtgcatgctttggtttctccctcgacttgtttggatattggtgcttcatcgtcaaattctaccgctcttgctttaattaatgacatgtccgatgagcaactcgaacaattcgaggaggaggactgggctttggctgctaacaagatttctcaagctatgaacaatgtcaggtacaggaaaagaggaggtcaaactcgttgctttaaatgtggagcacttgatcacattcgttgaatattttggattttcagtgcaatattttgaattttttataatggatttttgtacaatatcatgaaatttcctatagcgtatatttaagctttgtgtgtacttactaaattttaatatttagttaggagttatcccaccaattcctttgatacaaacaaacatcccatggtgcaatcaattgttttttgccacaccgcgctaagtgcaagggaatcttgattttctttttaagtcattgacatgtagggatttaatttattggaatataatattgccacaacggttgctgtaaccaaatatctgtcaagttgatcaaactagcctaattttagatcaatgtagcaaactatggttaagtgtggctggcaatcaaacatccctggagtatttatggtacaaattagatgagtgaaaaataaagttatcatgggatggagagaatttgtctagaagaagtaaaaaaaaaatagacacaacttggccgcttgagtgttgagatcatggttcttgtctttctgtgtgccatattgccttgttggcagtgattgcttcttgaaatcatttcatttgtaaagtatgacacgctaagattttatgcgtttacaggaaagagataaattaacagaagtcaatggaaatatttggttgaatcaagaaaataaatagactcaaccacggttagtgacctggccatgctattgagtacggacttgaacaatgacataagtagtcgtgcaaggtattgacataaacaatgatataaggaatccagcgggcatgtgatgaccgcagactttcagttactgtttataggtcatgtagtccctccgaaaaaaaaaaaagaaagaaaacacaacctaagtaccaagatactccctctgttttatttatatctatctagattcattaacatcaatatgaatataggaaatgctagaatgacttacattgtgaaacgaaggaagtatcatacattctagtacaacgaatatggaatagtatatatactccctccgtaaaaaaaaagaaaacacaatctaagtactgagatgtgatacattctagtacaacgaatacggacatagtgtatatgtctagatttaggttgtttttttttaacggagggaatactcatcatattatatgattttttagctaaggacgcagtattaaattcattgacattgagagtgtgctccggatgcccctatatataaatatataaatagacagagggagggacagggagagagaa

SEQ ID NO: 7491 - DNA, 1501 bp, Oryza sativa
gctccctcaattgtccctggcacggcgactccctcaacgaatggtgctgccctcccatcatgcggcgctcaagagtggacttcacccacaatgagcagtagtggcagtggccttctctccttcggtgtcctcccctctgtgttcttggattttatttttgatatgtggatgttgattttgttcttgaatgttgattctgtgttttttgttgttgaccgatctcaagggtgatggggggcttctcgactttttggatatgtggaacatcaaaggtgttggtttagaaagggtacctttagttccttctcatcactcggaatgcattgatatcgcgtctatcttccatgttcaccgtcgactatgcccactgggagttgttatttcgtttgaaccgttgagggaaaagaggatcaaacctttgtttttgcagctgtcgctaggacgtctccgaagatgcacggtggaaagactctgggaagtgtgttggaattaatgaatgggccttagcccactcgaagattaattctttggaaaatcacaaaagcccacctcatgagatggcatgcatgtggagtttagtaccaccttgcttattctaggagagggggacctccttaaaagggaggatgctctcctagccacttgaagcatgtgtggtggagagaagaggggaaacacacgcgcgcgctcgctcgcctggcctggcagggcagggcaggcggcgcgcgtgcacgacgtacgcgtcgaatggtccgaaaaattggctcctcacccttgcgcagatgcagcacccttgcgcagatgcagcctccttttgcagttttgttttgctgcaaattcggattcgtttttgttttggaaacgttccgaaaaatacggtacgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcatcacctcggtacgtgttcaatatgttgcgcatatttgatatgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 7492 - DNA, 1501 bp, Oryza sativa
ccgccgctgccacgcccaaccccttttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaaaaaagggaggggaagaaggattacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcgaaggcgagttttcctccgcaaagctacatggagtgcgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccgcca

SEQ ID NO: 7493 - DNA, 154 bp, Oryza sativa
  unsure (1)..(154): unsure at all n locations
ccgtatgatgtcancctactctgnacccactcatcatattatatgattttttagctaaggacgcagtattaaattcattgacattgagagtgtgctccggatgccactatatataaatatataaatagacagagggagggacagggagagagaa

SEQ ID NO: 7494 - DNA, 337 bp, Oryza sativa
cttggtttgctcgttcttgccatctctcatattgtgcttgagcttgtttttgcctgatctacttgcatgcttaattaatatagttggtgaccttatatcttgcttagatatcttatttgtcaccttttgattcatatacattttgtttattcgtgctacaagtccatagctagtgttttattccgttatccgctgaacctttcggttgagatcggaactttcaatcccataccaaaagttccgatttgaaccgaaagttctcatctatctaatatgctatgaagttgtggtaattttttaggaacgcctattcaacccctcccccaccccctctagg

SEQ ID NO: 7495 - DNA, 304 bp, Oryza sativa
caagatgattaattagcatgtttgtttgtgtcttcgatgatatctttccctattcaatttttgttgttgcagggtacccgcgctcgccgtttcatccggtgagcatttcgtcgagcagttggtaggcggggggagttcggggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgatt

SEQ ID NO: 7496 - DNA, 782 bp, Oryza sativa
atgcacctgtgtacctgtccgtgcttagcccccgttctatgggccacgactagattcatccatcgtctatagtattcatccatgcatgcaccgcccccgtgagctccgtgttgcattctactccgtacatttgtgatttgtacgtagaaaatacggtagaacagcaaaagaaaaagtgaaatatgttgggcttggctggacgggtccggcgttttcaatgcaccggttagatggtcctgttaataactcctgtactttgccgtgcatgttcggcttgtctgataatgaatctggtccgggctcctaattgaagcttgaactaatgctttcatctgatcatgacattgacaatgccttctgatcttaatactggggaacagtgcatttctgttgttagtttatatgctagggtgttggtgcttttaagatcaaatggattttgaatagtggcctaaaaagacacatttttgcatcgcataattctagcgaaccttggctttttgtctatgctttttagactagtgttgaataaaccatgattcatatggttgtggttgtttaaccaaataatccgaggatgatggctagctgcttcacggtcggttttaggatgatcattcattcggcatctgcttgtcttccattagaattttaaactcaaaactacggccaatcatttggcctacacgtcctggccattaggatgcaataatgtcccaaaaagaactgacccaataatgaggtctgaagtctgaacctgtcacgcttgattttatcggtgc

SEQ ID NO: 7497 - DNA, 350 bp, Oryza sativa
agaaagatattgtgattggttcagaaagaggtaggtgggaaaagtagatagtggatagttgtgattggttaggaagagaattatagttaagaaattattatattttggagcaaattctgagtgctaaaagttgttatatttgggacggagggagtaatatgaagtgataactattttgaaataaaattgaatcctactattttgagataaaatttgaatcacacagggacaactattttagaagtatagaacgtgagaacagctaaagtgtaaagtatgtgtatttcttgtgaatttatggctgtggctctcattttctgcttgtgttttactgtgtgtgaaatgtgtgc

SEQ ID NO: 7498 - DNA, 499 bp, Oryza sativa
agagtataatagtagaaggtttaaggaagaaacaattgcgaagagtggcctggcaaccccaaagagggtagggccgacacacgccttggacccaaagcccaaaggcgccccaccccttcttgggtctttgctccaagggattggttaggttagcccaataggcctcacctaaccacatttattgcgatttggctgagcgtgtcacgccgcatataacgcagtgcagtgcacttatttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgatagtcatggtcagatatatgccaggcttcatcctaaccattacaggcaagatgttgtgtgaagaagggcgaacatgtagattgctaagctgacacgtggtggacaagaa

SEQ ID NO: 7499 - DNA, 1501 bp, Oryza sativa
tgtgtgtgtgtgtgtgtgtgtgtgtgtgtgtgtgtgtgtgtgtgtgtgtgtgtgtgtgtgtgtgtgtgtgtctagataagctaacatataagaaaggggcaatactagaaagtcttatataattaaccggatgaagtagtatatttcatgtgaaaactttctatatgaaagttgttgtaaaatataagataaatctgtttttaagtttataataattaaaactcaactaaacatacgttaatcccatatcattttacataaaacacttaatcttcatctttacccacatcgttttgtgttaaacacttatttttcatgaagaacaccacctagtattgcatatggatgggccgagatcttggttattgatgtttacggaccgagattattagattaaggcccattgaaacatatcctacgaagttcttttaacaccctctcctgaagaatacgtccatgtttccgcatgttgtcggcgaaaccagaaaatggcatccaatccatcaatcatcaattatgtacaagttctatgatctatcagcaaattcaaccatagcatattaacatggcttgaacacagctcatgccgatggaagtgtataatcacaaagaacgaacacaggcaggagtaatgaacaatgaaactgtaataaatacaccataactccacaagtgtggaaggttcactattgcagtgtcagtttctccatttgctcggcgtcaatcattcaagatttgcaaggatttgatgaccaacttgagtaaaacagcccaactacaaaagggcacagccagcaatgcatttaacttgagtaaaacaaatatcagaaacagtaattctctgtagtctgtaccctgcatttgctcagtcatagctgctctcgatttcttatgcactataaatatgaaacaatgtcagatttaggtgcacaagatagcagaaacacaagtaccaagctgagtgaaatggcaagtggagaggaaggaaacacaagagttctccaatgcagtgaacttatatatatcaccaaagatgtttgatggcattcggcaagtttccatgattcatcattgaataacccgagtaaacctgcttgtccaggcaactacaacttttgaacaccacagtggtaaaaaccagatatactaaccacctcactaaattagttaaacagtgccttcggttgggatttgacaagttgagccctccaaagcaaaggtaaactgggaaggagatagtgacctgacctccagagttcagttcaatagtttaaaaacaactgatagcaaggtccatctgctagaagaggcctcgctggcgagcaagcgcgatcaggtccataggaatggcaggagtgctatcccttgtgggaatcatgagaactgccttgtacagaggatcaccatccttgttctccacttcagaggtggtgcgatctgggcttggggttggggtcctgatcttggcaccccacctcacctttcttgtgcaaaccctagg

SEQ ID NO: 7500 - DNA, 1501 bp, Oryza sativa
ctaatactcagttctatctctggtttgttctccaaaagatctgcaaaaccagcaacagttccaaaggaaccaaaatttcatcctcggccggaaaaacagtcatggtgagtttactttcaagggagctaagaaaatgtatttacttatgaagttcattgaatctaatccagaataaatatttctgcattcacaaattgaagcatgctcttaatgcttcttatatttcaatggtgtctgacagtttatgtcgacagcgatgcatggacaccggaatgctgatttcatcatgtcttcatgatcagtcgactgtacttgctgagaaatccaaggcattgccacgcatgttctagattctttgaactatctgaaccggaaacaaaatcacattaaatttttgtatcttcagttgtcccctccagttctttttatgtacatgccttatcagtagctctgtgcttcagatgcaaccacaccgaggttgagaagttgtacaaggaacataaaagtggaaattcaaacaagaatttctatgatatgctgcagtagtattcttgtactcaaaaccttcgttcttgccaaatcaaaaataccatcgtgttcatatatataccttgggtcttagctcattttgttctggacttcttgatgaaaatttttacggcgattttcactggactgaaaataattggctgtaaaaacagtaaactggaactgaccaactgagcatctccttgtgtgctaaaaaggagctcatgtatatgcttttcaagttttaaaatgatgtatgcccataatattcctattttgttccctctgctgaatgtttggtcactgtataagtttgtatgaattactccctccaatcataaacatttggcatgatttggtcaagtattggaactttgatatcaaatatttctcaaatgtttatttttttaaaaaaaaattgtgtgtattgccttgaaaaaataccaatacataccataaatctgttatattgtataacaaaattattcaatgtaaatttgttaggtaaagttttaaaaattgtctagatttatcctaatcaccaaatatatttttaggaagtacaaaataagattaagaactaaaaggatggagtatatttgatttctccaaacgaaatttatcagacgtcaaaagaacacatgagatctactacatagtactccctcattctcataaaaaaacaaatatattcatattcatattagtgacatatactaataatatgaatctaaatatgtttgttttttacaagaccaaaagagtacaacctagcattcgttttatgggctccattaggcccaaaaagagcccatgggctagaaacgaagtcaatcaatggcccagtgatcccgcggtccaagtccaaccgccttttctgactgacaggtgggacctccgcaagctaagcttcgcgcacccaagccctctcttcctcccacttggcaggcatcccaccctccagcctccacgc

SEQ ID NO: 7501 - DNA, 1501 bp, Oryza sativa
cctcggtgccgcgtcgtcccgcccgcgcgaccgttttgccgtgacttcattcgtgccgtcaacgccgctcctctcttgtggtgagcttcccaccgtgttcttcgactcgatgaatgcagtgtggtcaccctcatgctctcgcgcttagacgccgcgccgcgcccgtcgccgttcgccatagctcgccgtccgccttgccctgccccggaggtcgctcaccgtcgccatgacttcctaggctagctcgtcgccgcccgtcgcttgaaacgagttcccggaaccgtgtagaagctccttccccggtgaattggacttccgttgccccggcgagttttccccttctctcggccggcaatggccgccgctgcaatccgccgccgtaggcccttctcccaccgattccttgcgccgtgaccctccccgtgtccccttgaacctccccggcgagccgccgaggccgcccgcctcgccggctgcgcccgcgccgtgccacccatcccgccgccgcacggctgtcgtcgccggccgccgtcgcgccacctctccctcatccgagccggtgaatggaaccgccttgattccctctcgcttccggtgcccgccgcctacgccggttcgtcgccgttcgccggcggcgttgcgccgtcgtgagccgtccgatcccgggcagctcctcctctctcctgcgcctacgtggaagtccacgtggacgccacctcagcccacccggccccgcttgacctcggtcagccgcctccctccgttcctcactcgcgcgcggggtccacggagagccgagaggctgcgcgtgggcccgccgcacaccgcatccacccgcgcgccgcgcgtggaccgctttcccccgaaccctagcgccgccctcgcgtgcgcccatcccaccgtgggccgtgtcaccaataagcgggccccacccgggaccccgcacggtgcaatcggtccaccggacccgcccccatttctcccgtgccctaatgggccgacttccgcgctcgcccggcccaatacggctcggcggagccgcgcaagccatcgggccgcgccctaagccgcccaacgaagtctgattcacgtccctcctttatttctttccaaaaaggatttaataaatcctttttcctttagacagaaattccttaatccttccaaaattcatatctcttgatccactcgtccgaacgcctccgttccacttccaataattccgtaaaattgagatctattcaatggcactattatttagtctaaataggatattcttttggtcttttgtttaggttttttatcgtttgcgtatagtcgcggctaccggatttccgtcgatcgtggatttctcgaagattcgtgaagctccgtgaaggccttgagcaaggcaagtcaccctttgaccaattgctcctataattggaaaatcattactattttgtttgcaagttgcattattagaatcactcacgtttaatttgcttggcctcggtttgtg

SEQ ID NO: 7502 - DNA, 1501 bp, Oryza sativa
cgtgaaaaacgcacaacaattttcacaatgggcacgtacgttgagttagaatctgatggccatgatcaaaagccagaacgaacaaaaacgcctaacaaatctttcaccaaaagcacccagctcatcacgttatccgaacggaaagatggtagatatgagagatgagagaccaggtcatcgccaaaaaccgtaaaagcaaaccttgtcccgtgcggacacccattccccccttcccctttctgttagacacccgccttcacgtcacgggagcgcatctccaccgcacgatccagatccgacggcctccacgttccggggcccacctgtcagtgagcgccagcgtggaggagggggcacgcacgattcgtctcctccccatccctctaaacccctcccctcccccccaccacctccgccttgcgcgttgtttcttctcctctcttcgtctctctctctctctcgtcgcgttggatttgacgagctcgtcaccaccggctgcggcggcgaggcaggcatccgcactcctcggcgtcgggccgtcgtcgttgtccgctacctggtagatccgcgtgttcccttcctcgtcatgtctcgtgtctggatctcgcggaggcgatgcgtttcagattcagtggcttgtcgttagaattacgtttttgcggcgaccactttttgatcggtgaaaaagcgggaagtgggtgttccggtggtggattcgtgctcagtttggggatttttttttgtgggggctgatctgggtgctacgtgcgcgcgtgtgatggaacgctcggttggtcgtgcggtgtagatgtaggcctgatgctagcgaaatttgttctagatccaagctggttgatccatgaggattgctttagaaaaaaattttagggatgccatagttttagtgggacttcatatttgtcatatgagcgttacatggccagcagccagttaccctgttcatttatcgggcgtgtgattcatctatgcatgttgtcagattgacatggaaagcgtgtcatgtattcattctgtgattcatatgatggatgcggatcatcagcttccttttgtgcagcccgggcctagccagagttatctttttcaccgaactgtttcaatcaagtctgcatgaggaactgagaattttttttattattatttcattgtgatgtgatcatattgtttgatttcaagttcatgcagctgaataagcattcatgtttgcacattatttaagaaagaagcctattattgttcatgttaatgtgggtttccattttttttttcaattgcgccctcctgtttatggtgaagaataacttctctagtttgttaggttctattatgattcagtgttttttttcttaaatgaagtgtgatatactgtctaaagtctgaactaccaagtttgaaatttttttacaagacacatgttttataattttgtgtgcattgtacaaaatcttgacctatttttttgcttggtcacaggaaaaga

SEQ ID NO: 7503 - DNA, 1097 bp, Oryza sativa
aaatttctcacctcttttgacccaaaaatttaaaatattgccttcagtgtcctatagccaattacataatttttgtagtgtccatcagccgtgtcacgtttttgcggtgtctcccaaccaattacacgtttttttgagtatcctgtagcaaattttgcctttaggtagacaaaagatgttttgttttgaataaaaaagaaacaatttaactagattattttttagagagaatccatcgtgggccgctgactttgtccatgttctataatatgccactgagtttgttaagttctacagtatgtcattgtattttgcttaaattctataatataccgtcaccgtccatttagattccgttagtactgtacaatttgtcctaatgattgaaatatccctaggaaaagaattccaaaatttggccgaaaattcccaaatatcatattataaaccaggcagagaagttgcccatctcaaactttgtaagttttacaatctatatgataaaattgtacaatgctaacagaagttaactagacgacgatggtatgttatagaagttaagcaaaatgtgataccatgttagaacttgacaaacccaacgacatatcatagagcacggacaaaatcaatgacacacaatggattatctttattttttatggttgttcggttaactgcttatctactatgatacggcatttttagaaaaaagaaggttaaatcttatactataagtccatatcttacacattaaattgcatacacttataatataattttcaaattataaaatgccctattctcattttataggagaaatatgcttatctactatgatacggcatttttagaaaaaagaaggttaaatcttatactataagtccatatcttacacattaaattgcatacacttataatataattttcaaattataaaatgccctattctcattttataggagaaatatggaagaatgatttattatctatttaattaactttacattcccgacctcaacggcaatcataacaatagtgtgcatcacgatagaagaggagaaaaagacatgtcatataaaggcaaagcggaggaacaa

SEQ ID NO: 7504 - DNA, 1501 bp, Oryza sativa
cccatcgttgttgacggtgacagggacggtgaaattttatcaccgtggggacggggacgcagacgtaacccccgacagtgaattccccgttgccatctctaccaagaccccaacgcgtgatcccggaagagcgaaggacgacccgtcttggtcatgatgggcgaggttgttgttccgtgctggttcttactatttctttattgggagaatttgaaccataccacacaaattttacaaaatttgtaatatgccaccctgaaccacatgtcattgacaaaccctttattttactggagtagtatttacctttttcttaactgagaagtagtactactaaatctaccaattaatgtagtcaaacacaccgtaaaattacactgtcaacgtggcatgtccgttgctcgcctatgccgctggccttgaagaggtacatgagttgctctaagagcatgtacaatagcaggctataaaccagctataaatatattttaaaaagataaaaaaaagagagagaaaagcagcgggctacagacctgtagctagctgcagcacggactccaagacaggtaggattagatattaatagtatagtaagcaactattatatgaaatagctattacattagctatagatgatttgtagctattagttggctatactattaaacttgctctaaagtccacatcctgccttgctcttgcacaaatatcagaggatcaagcggctgaaaaatcggctataataaggtcaaaattctgtcgacataatttttagcttaaaccaaaaaaatagcagaaaaataaagaaaataaacattattgatcaaaagaagcccaacaagaaagcctagcaggctggctccctcaaattcaaacccaatttgcatggttgcctaatttgtgcattagccgtgctgtgattgatgctaatcgatatatacttggttagtagattgtactgcatatgttttttcacaaagtatatcacaataaatcaaggaaattgctaaaaaccatgtcgcgagttctaattcaataagcgtttcatattataagactttctagcattacccacattcatatatatgttaataaatctagacatatatgtgtgtctagattcattaacatttatatgaatatagataatgccagaaagtcttataacctgaaacgaaggtagtaccatgttattgatcatacgtaccaaatattgtgttcgtgttgtaaaacagttttttttaccctttttcattccgaatacccaatctcaaaatcctaggcccgcccctgggtccgagagttccacgcctatattgatcccaagtaatccaacaactccgttgtatgcattttacttcgttggttgaatgtgagattgtgtagtaatactacatagtattacggtgttggagaggctatggcgctctgccaattgtacctaccatggctagcaccaccgaccaatctactgctatggggccagtgccattgccgtacg

SEQ ID NO: 7505 - DNA, 1501 bp, Oryza sativa
tctgagactcgatgtgccgcttgtaccctgtcttggcaattataattatatgacattgcatccatttgcagcttcactggccagctccaagcagccttcttgccgggcttcactatcgtttgctggtgcattacagtactatcgccttccattagttcttgattatggcaaatttctggccgaactgctgacttgtgttaaagagtgtaaagtaattcatttttccctatggtggctacgaattcctcgtgctcaccgacctgcgacccgtctcaccgagctgctcagcgattaattttttgagatgatgaaatgcgagtttgataactatttatacgacattgcagaagtgtgagatgaaagtcgatcagatcggctacctctacgaacttcaaatttgagggtcttttattttcactaaaagatttttggtttttggtatttctaccatttcaccctctctggtagatttggttattgtgtcctattctacaccggtcgagtactcaatgctaaagtgtgcctatacaacagggtaagtacaaacatgtactgtagtatcaactctctgtgcaacagtgaagattaatttgcccatctgttcaggcccgcgactactgctgccctgcacggtcgtcttgatctacaattgcaaggagaaaaaatgtcggacgagcgacagctgagattctaggagatcctgacacctccatttcctattgaagcttaatcttgtcgtttacccggcatctatatccacatggatatgctatgcatatctacttgatctattcatctcggagttgtgaatggcataggtatatatatggagatgcttgcgtagtggtgtgtacgttgtcatctgttgaagtgtatcgatcggcctaccatatcaaagtgttaattcaacacccaaaagtacatgaagcatcaatttatatagatggcaaaaaaagttactggtagggcttgatacacagtactaaaaggcaagtattccttccgatcacaaatacttacatttcttaggagaataaccgatcgaaattagaatatttgactataaagtaattttaaaatacatagtttgaaaacataaaaatggtatgtgcaaatttataacgagaggtacttttataatctcataaatttattgtaaagtaaatttgaggtcagagtcataccttaattaaagagacccagaaaaaagacgacttcatgcttggttctcacgagcagggagcagaaatagatcttatctgcatatatgattgtatgattttcgtcttattgttaacacagccaattaggcaaactcgcagtccattcaagataaagcattgtaacatgtctatattgttaccatataacatcttctcttatctataaaggataaataatcctactgtagtttacccatggtactcatctaccgcttccacagctgttgtgtatgtaggatcgaatcataagaactaagccaaccagaggggggtgaatg

SEQ ID NO: 7506 - DNA, 1501 bp, Oryza sativa
gagataatgctcttgtactcttccagcaggctggggttcaccgccggcacgttgccggcggcgaggcgtggttgaacgtacggcaatggcactggccccatagcagtagattggtcggtggtgctagccatggtaggtacaattggcagagcgccatagcctctccaacaccgtaatactatgtagtattactacacaatctcacattcaaccaacgaagtaaaatgcatacaacggagttgttggattacttgggatcaatataggcgtggaactctcggacccaggggcgggcctaggattttgagattgggtattcggaatgaaaaagggtaaaaaaaactgttttacaacacgaacacaatatttggtacgtatgatcaataacatggtactaccttcgtttcaggttataagactttctggcattatctatattcatataaatgttaatgaatctagacacacatatatgtctagatttattaacatatatatgaatgtgggtaatgctagaaagtcttataatatgaaacgcttattgaattagaactcgcgacatggtttttagcaatttccttgatttattgtgatatactttgtgaaaaaacatatgcagtacaatctactaaccaagtatatatcgattagcatcaatcacagcacggctaatgcacaaattaggcaaccatgcaaattgggtttgaatttgagggagccagcctgctaggctttcttgttgggcttcttttgatcaataatgtttattttctttatttttctgctatttttttggtttaagctaaaaattatgtcgacagaattttgaccttattatagccgatttttcagccgcttgatcctctgatatttgtgcaagagcaaggcaggatgtggactttagagcaagtttaatagtatagccaactaatagctacaaatcatctatagctaatgtaatagctatttcatataatagttgcttactatactattaatatctaatcctacctgtcttggagtccgtgctgcagctagctacaggtctgtagcccgctgcttttctctctcttttttttatctttttaaaatatatttatagctggtttatagcctgctattgtacatgctcttagagcaactcatgtacctcttcaaggccagcggcataggcgagcaacggacatgccacgttgacagtgtaattttacggtgtgtttgactacattaattggtagatttagtagtactacttctcagttaagaaaaaggtaaatactactccagtaaaataaagggtttgtcaatgacatgtggttcagggtggcatattacaaattttgtaaaatttgtgtggtatggttcaaattctcccaataaagaaatagtaagaaccagcacggaacaacaacctcgcccatcatgaccaagacgggtcgtccttcgctcttccgggatcacgcgttggggtcttggtagagatggcaacggggaattcact

SEQ ID NO: 7507 - DNA, 1501 bp, Oryza sativa
gtcgactactgctcgcgccatgatcataagcactatataaataatcggaatcttgttaagagaatttttctttaattactcttaattacacaagtagacgtgtaattacattactcttaattacacaagtagacgtgtaattacgtcatgtacacaacttgtaatatactaccatacagtgaagagatttttaagccaattaaaatattcactataagtagaaaattttacatgcaaatattataaatgcagttttgctataaatctgtcgtcaaattttttacttagaatttgacatttttcaacctaccgattagcacctgattagggcaaggcactgatcgtttttagctttgccactgtatagaacgaaagtgattgaacgataatactactttaacacgggtgagagatctcccatgatgtatatttcgcaacagtgttttaaaagttgcaagttatagtataatttgtagttatatgtaagttgcaatgtaattactatataattgtactatgttcctttaaaatataaagttacagtcctatataactaaaattatatttataaattcagttgatatgacatgtaagtatattgtaactttgataaaaatgttatgtaaataaatatgtattcgttattttctttaaaatataaaattatagtcctatataactaaaattatatttgtaaattcaattgatatgacatgtaagtgcactgtaactttgataaaaataatgtgtaagtaaatatgtatttgtcattttcttttgtagtctgttggatgtaaatctaaaggtataaaaaatctgggtgatttttttttgttaaaaatcactcgacaaatggataggcagttccttataaatgatgagtggcatacgtaggggtggcaacagggaggggcgggcccaggttgggacatgaatgtccccccctgctacctagggatgggaacggggcgggttgggctacaacggccctgcccccgaacctctgcacctggccctggccccgagtggagatgcggggccaaattagctgagggccccgcaacccaaccgggtccccgtattgggtagccactccatccgatcagcacgaaaaaaaaaactttccatgatcgcaaatactttcacacatacatatttccatgatccatcattccatccatgaactaaatgcatggatgaccaaaaatactttcacacatcaactcattcaactacagcaattcaccaagataataaaatcatagtctcacaacaattcaaccaccatactaaagtcaccgtctcgcccgtgccgctctgctcgttgtccctgcgagtcgcccgctcgctttatctgcgcgccgcaactgcgactgtgcgccgtcgctgcgcctttgcaccgcccactcgccgtgctgcacgtcacccatgcgcatccccgccgcgttgagaccagaggcagagggctgtgcgaccagaggggagaggggacagggaaaca

SEQ ID NO: 7508 - DNA, 1026 bp, Oryza sativa
aaaaataggcgaaaaaagatcgatcggccgaaaacgtttaagtgttggtgaagaagacgagggcgcaccgggaatatatatacccctggatctttactcccgattgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaagattaatgacaattacttcgaaaaattatttttgtctgtaataaattaagtggataaatcgtaataagcaaataaaattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 7509 - DNA, 1501 bp, Oryza sativa
gctggagttgcttattgcgattcatagtccactcatcatcatagggaatgttacgtaggacctcaaacatcattgacttgatgtgttcaacacatagtacatggaaaaattaacatgcgatgtgtcgcctctatactcgatctaaatctgaccaccttcaacacattcatgaacgaagtgatactttctgttgatgtgtttgctccggccatgaaatatcggattcctctttcttcctcactccgaacatgatcttgggtatcggttcatctttgccggttcatggttcctttatgaaccgatagtgacgaagctccatcaccgccgattcacaattgttatgcagtgagagtagctcgatctatctatatatagagccaaattattaattatgcaaacgaactaaagatagctgaatagagtacaatactccctctatactcgtaaaggaagtcgttttggacagcgacacggtctccaaaacacaactttaacttcttgtttctataaaaaaatttattgaaaaatgatatatgtatacttttatgaaagtatttttcaagacaaatctattcatataatttttacattttcaaactcaacaacttgagagttatttatgatttatatttctaaggtttgacttaaacattgtccaaaacgacttcctttacgagtacggagggagtatatcgcatgagagttaactgtatcactaccgtggatatgcaaataaccacaggctagaccgtcgttcttgcgtttaatgggcattgacaccattattgtctaagagtttggggcataggaaaacccgctaattccactctttccgagacatgccatgcaataatcaccatgtgctccaagctaagtacgcgcaggagctcggcttatatatacatcagcaaattcatgcagtatgcattatgcagtgacaaccaatcagcttggctgcatcacttcaaaatattggttcggacatctaataaagttgtaaacaagataaatttgttcggaaaaaaaatgtaagctgccactaatgatatatttgttcgggctagtactagtatttcatatatgggccagaaagtcagacggacaggtgcgggcccagttgtcagacagaagtgcaggcccagttgatccgcggtgtgttggactccagtaggagcagccgacctagggctacgcggctgtagctatctatctcatcgggggatgcgtgcaacgccgccaccgacagacacaccgcgtgttctggacgctgcccttggagaggagatggagcccgcaaatccgccgattccgccgccgccgccgccgccaccgcctaccaggaagcctaccaggaagaggggaaggggggcgacgaagggcgacgacccggtcccggatgaagcagcaccaccatgcaagccgtcgctgcctctggccacggggagcagaagggggcgcagccatgtacctccgccactcggagttggaggagacggcggcg

SEQ ID NO: 7510 - DNA, 1501 bp, Oryza sativa
tcgggtggacggggtcgacggtgctccggcggtcggcgtgcgaaacggaggggtggacgaggtcggcgaggatccggcgaagccgaaggaggcgaccccgaggggagaggtggtacggggcgacaacggcggcggaccggagctcggcggccccggcggagagagagagcgatggcgcgagctcgattccggcggggagaaagagcgatgagtggcgaaaccgttgaagggaggcacgcggagggtttatatagggttaagatagggagggggtgcccggaggaggggcaaacaggcgcgggagtcccggccgccattgatggcgccggcaaggttagggggaaagtttccaaacgaatccgagggagagagagagggaaaaatggggggaaagagggagggaatcccggggaatatttcccccctcttgattgcacgcggggcggacgggggcggcgggattcacggcggcggcggcgctagggcgcgggcggggcggcgggagcggcgggaggaaggggatgacgggtgggccccacccgtcagcgagggaggcgggcgggcccgcccgtcagcggcacgcgcgcggggaggaggccgaatgggctgcgggggagaggagagagagggagagaaatgggccgagccggcccaagagggggaggggggaaaaggactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacactctccgcccacccgggcccctaccgccgcctgtgcatctccacttaccagctccttcactggcccgacgccgtggatgcctagctgtggagattatggataccccatatctacatgacagttataatttagtcggatatatggtaccaaatatagatagaatatctctatgaggactcgggttagattctaaacttgtatgtcaagaaaatacccgggatcctagtcggttatgattgtattttatctatgataccatattccgttaggatatggacggtactttgtaaagcggactccttcccctatataaggaaggtccatgtgcctctcggggcacgattcttttttccagtttatacaatcaataacacactcggaggaattatccccggacaggagtagggtattacttcttgaataagaaggcctgaacctgtataaaatcccttgtctccaaacccatccactttcctagcttgatagccacccccttttattattgtcgaaatcttgcttcgacagttggcgcgccaggtaggggtagcgtcaagtttttgccgactaagtgcga

SEQ ID NO: 7511 - DNA, 1501 bp, Oryza sativa
tcggattcgtttggaaactttccccctaaccttgccggcgccatcaatggcggccgggactcccgcgcctgtttgcccctcctccgggcaccccctccctatcttaaccctatataaaccctccgcgtgcctcccttcaacggtttcgccactcatcgctctttctccccgccggaatcgagctcgcgccatcgctctctctctccgccggggccgccgagctccggtccgccgccgttgtcgccccgtaccacctctcccctcggggtcgcctccttcggcttcgccggatcctcgccgacctcgtccacccctccgtttcgcacgccgaccgccggagcaccgtcgaccccgtccacccgagccgcgccgccggctttctccgctccggtcgtcgttcccgtcgtcgccgtcgacctggggtgagccgtggaccgccgattcgtttcccccttccctcccctttctcggccgccgctccgccgtacatatggccgccgccggcgaccataggggcgcgggcgcgccgcctcccgccgctgcgccggcgtggccgccttcgggcgcgccccgcggctgccgtgtggggcccggctgtcagccgcccacgcccttaggtgcggctgacgcgtgggacccacggcgccggccggtgagagcccgggtgcgcccggtccaccgtgggccgtgaggctgcagcgtgggccccaccccccgtggacccggtccgcgcgcccctcccctcggctgacgcaataaatctattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattaccgctttatttaaattcccgcgttagcactgttttatttagccatgcctatttacctttgttaagacattattattgctattgttattattaccttgttcacccttggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 7512 - DNA, 370 bp, Oryza sativa
tcggcaacgaggcggccgacggcggtttggggagagagagagagattgaggtctgagagagagagggaggcggcggcggctctcaccccagagatgcggcggcggcagaggtggcgacgacgacgtacgcgagacgacggcgagatacgacggcggcgtcggtgcggggatgccgtaagcagtggcggtgaaagagaagccgagaaagagatcgatcggagaaaaaacttctaagtgttggtggataagacgagggcgcgcatcgggaatatatatacccctagatctttagtcccgggtgggggtcaaaaaccattggatgggtttttttttccaatttctgctgtaataaacttgttaatataaaagg

SEQ ID NO: 7513 - DNA, 1501 bp, Oryza sativa
gacgccgcgttcagaagaaggggaatagaagtgcgagccgtcggcttagattctccctgtacatgagaacagctaagctccggccggccggtttggtgcccctttaatttcttgtgtactgtactagtttatgaagaggagattgagatggcgagcagagtacggcaagcaaccaacaaatcgccgagttggattttggtcaacaatgatcatggatgccaatattggtgcctcgtcggtgttagcggtggccacccaacagagcttcttcctccgtttcacaatgtaagtcattctagcatttctcatattcatagttatgttaatgaatctaaatagatatatatgtctagatttatttaaattcattaacattactatgaacgtgggaagtactaaaatgacttatatcctgaaacggagggagcagctccgtttccacgcacgttttggttctctctcatccacacgtaccgtactagtgtgtttatattttatcatacatgcagctcactcgtggcgtgcagcggtgtggcacagccgcacagcacagcacagcacagcacatccgccaatcaaccacacgcatccgagttccgatccgcgggatggccgcacgttgcccgcgtgcgagcgtccgcgagcgagcgcgggaccgcggccccggcgccctccgggggcggcacggtaggcagcagcatgtcagaatatcggtcgtaggccttagcaaaccgttttgcgtggggttatcgtcacccccaccgtttggcggttatcgcggtaaccgcgtggttaccgtgaaaaccgtacggttatcgcgaggtataccgtggttttaaaaactaagaagatttaccgcacgtaataaccacgtggttttgtaaacattgtttactaccgaccagtgctatgctatcgtgttacgcttaggctgcattccgaaagacggaaaacaaggttgtttattagcacacgattaattaaagtattagcaaaaactttaaaatagatatcaatatattttttaaaaataactttcgcatagaaatttttgaaaaaaaatgcattgtttagtagtttaaaaattgtgtgctcggaaaataaaatatgtgagttgggaaagtgaaagaaaaaactcagccttaaaactgtatccgaaaagtacaagaaaatgcaaagaaatatcctacatgtgtaacagacatgtagtaacacacggaaaatcaactcaagatttaatgtacaaattgaggaaaaaaacaaatctagtgtgaactgtttgaacactatttgcagcacaaatttatctaaaacaggccagcccacgtgatagacagataaaaatggaccagtggccgaccggttacgggcacggctaggctgcaggtagctatagttgtttgctagcccacaacataggctgtgtttagatcagcgcaaagtttagatttgggttgaaattgaagatgatgtgactgaaaagttgtgtgtgtatgacagg

SEQ ID NO: 7514 - DNA, 1501 bp, Oryza sativa
ttttggtggatctgtgtatgaatgggctacaagtgtgagctgacttctcccccgttctaagctcataatctgggaaagaatcaacaaaccccccactctatgggcaaggtcctccttttatacttcaaggggataccacacgcacccttctctttccaaactggactgttctttttctcttgaatgggcggagatcagcacggttgctgtccgaatgacgctccgatgggacagcccacacctacctccacttccgccgggagtgagcgcgtcgtgggaacatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcttaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatacgtggcgcagacttcctaaagggggcgggggtgcccccggccctccgggccagggcaagcgcaacccgacccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgataggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgcca

SEQ ID NO: 7515 - DNA, 1501 bp, Oryza sativa
gtacccgggtgcacaacgcttcgtttcatccgaagctgacctttattcatgtacaaataaatttggatcataaatcaacacaatttgttgtatatatagaaaagtatatatgagagatataaggcatgattacgcgtatagaagataaagcaatcacacaagaaaaaaagtctattgaaattaagtgaaaaatgtgacatttagtaaaaccgaaatactagcaaacaccgataaccatagttacatactcttatcacgagttagctcactgatctcatggaccatctcctctagttttttatacgatgacccaccaatctccatggccttcttagaaagcactgcgagttcacttactctagtagatgcccattttccttcctctccaaatatcaactcccttgccatcacctgcacttcttcccttgcaaccaatccattttccatgtcatcttctcttttctgtggccaaaccctgagcccaactcttagcatatcaaccacaaattttgcattcagtttctgctcagctgccattgggaatgcaagtattggcacacccatagagatgctctccaacaccgaattccacccgcagtggctgaaaaaccctttgatagacttatggcttagaaccccgacttgatcgatgaaaccttggtataccttccccttgtccccaaacctattctcgaaatggtcctctgaatcaaaccatttggacctgaccacccataagaaatctagaccagactgatctaacccgagcgctatctcctctagttgagtccgacttaggtcagcctgtgaaccaaatgcgacatacagcaccggtcggtccatggcgagccgcgagtcgagccaatccgatacatcccggtccatattccggcccagttcggatgcaagacacagaggaccgaccggccatagcttcacaggggacatccggctccaaccgtcgaagcatagcggctcgagctccacgaaggaattgacgataatgccctcgctggagtccatgcttgccttggtctcgcacgcgaggtcccaaagcgggccggtcggctccggctcgtcgatgggcgggttcaggtcggctcgggtgagccggagcccgggcaagccgtcgacctcgaacggctcggacggcgagccgacgcgcgcgtgcggcttgtgtgccgtgaccgcgccggcgacgtacgtggcgaaggcgctcatgccgtaggagacgagccgcggcacgccgccggcgtcggcggcggcgagctcggcccacgggaggaagccgtcgtggacgagcacgtcgggcctcggctcgagccgggcgaacgcggccgcgaacgccggccggagcgcggcggacgcggcgaccacgtcggcgagctgggacggggacgccagctcgtcgtccatgctctgcggcggcgccgcgccgtcgttgaggccgtcgtcggtggggaaggggagctcgacgacggcggcggctccggctccggcg

SEQ ID NO: 7516 - DNA, 1501 bp, Oryza sativa
tgtcccatgatgtgactcgtccatagatggtggtggttggcaatgaagaaatccagaacaacaagaacgggatgagcaatgacatggtcctgatagagggagaaacgacaacgacgagctctggtggtgaacatgaccggatgagtgcatcaaaacacattcctggacgagaggattcgttttccttgaactcgcggaaagaacaaaagatggagaaaaaacgactaatattgttcatcatcttccctagccaacacaagaaacagaataggagggaagatgggcgatggtgctctagtgaccacggcggtgagtaaggtggccggacgtgtcccacgatgtaactcgtccatagatggtggcggttggcaacaaagagaacaagaacaatgggaacgggccggcaacaatatggtcccgatagagagagaaacgggaaaggcgagctcttgtactaaacacggccatgtgagtacgtcaaaacgtgttcccagacgaggagattccgcttttcttgaatgcgcaagagggagggaacgcaggggagaggagggatgccaaggagaagatgtcacgggagaggaagaggacgtgcggtgagggagagatgtggggtgctgtgagggaggagggaggcaggagaggagggccgtcaggagaagaggggctgcgggtagggggagcgtgtggagatcagggcaccggtagggggagagaggcggaagcggagaggggaggcgaagggggaggggggtgacggacgaaaggggtggcgaaagccttacgtattttttaattagttatagatttgattgacatatgggcctctcatattttgttttaatcttttttagttttcaattttgctcttttattttttttatcaaactgccacttaagcgccacgttagtaccatatgggacgaaacctagtcaaaggagccacgtagatatcacatcagcaaaatctggaaacaatattgctaagggaccttgtttgcagtggttttttagatgcactgtatctggttttatggttgttaagggatacaaaatgaacctattccacatctcacggtcgacacacagtattcaacccctgtacatcccaactggacatatatgcccatagcagcccagcccaaattcccaaatgcacacgaccctgttgtctcgccaattgttgttggctggcccccaaaagttgaggaccaccgatcctagagcatgttttagaagataaataagaagagagaagagcagcggcctatagatttatagcaagttgtagtacggactccaagacgcagtgtgtgtatgacaggtgggaccaggtattaatagtatagtatataactattatatgaataagctattagattggttatagttgaattggaggtagtagttggctatactattaaacttgctcttaaacttgctcttagtgtgctgtcatgctgtgcataactagcgatgctccaacaacacccacgctaat

SEQ ID NO: 7517 - DNA, 1501 bp, Oryza sativa
  unsure (1)..(1501): unsure at all n locations
gggctcncttggtagacacgtccgaccccccggaaaaagaaaaaaggtctacccactcaaaaaagcccagactgaactcaccatcccaccatttttctctcctcaccatttcagcccactggcccaataggaaaagaaggcccaaaatggattggaaccctatcgtgatctgcctttcctcctcacaaccttctcagcagccagccgccagccgcaaggcagccagggagaggaagcccgcggcgccgcgtcaggccgccagcgccagtcgcctcgccgtcgccggtcggcggtcgccctgcgcccgcccggcgcccgaccgcccgtcgtcctccggcccgccccgtcgcccgtcggccatcgccccgcccccttgcgcgcggcggcgcggcccgccgtgcactcgctgactcgcgatttcgcgccgtgccgccgcccgtccggtcgtcccggcatcccgtctcgtcgcctccctagtccggcgacacgccgacgccagaatgccacgccacggcgccgcaccagcccgccaccgccactggacgccagcgcgctgaaggtaagttgtcttggagtaatggagtaccataggaacttactacttctacattaccagtttaccacagataaatagcaataatgactaagtttccccttcatgtctagtcacctagatgtcatgtggttaggaattaggaagtaggaacattttggattaggaaataggaatataagatattaggatttaattcatagttgaatctagcctctaggatattgttcatggttaaacattttttatttagaatttgatccattaatgattcatggttgaatatactatattgttgtattgtaggaaaaagacatcatcaatcattttcaaaatatcaagaaacgaaaagttcttctctaaattgttaattttttatcattttgtcattttgtatgctctataaatttgaaatgttttgttaattaatagtttagtattgtactttaatatgcttaacgcattcaatttatggtcaattctatccatctatgactttatgaaattttttctatctcttttaatttcgaatacccaagttgaaaacctgggcctgccggcgactgtgcggcagcagtgaaggaaaagaagtggggcgtggggtggaagcggcgaaggcggggggcggcatcggcgaaggcggggggcggcatcggcgaaggcgaggtgcgacagcgtcggaggctgggtacagcagcgatggagggggggggggggtgcggtagcagtggtttgtcctggtactctgccgtcgagatctacagtctgcctgcctccggcgtggctcgcctatcgacgagctccattggcttcccttggagttcaaccattgaagagctccactgattggcctggtatgtatttcgatatccacttcgattagagggtatgatagggagtttagccatgaatgtgatgtcaatctggtgcctgaattttctgtactag

SEQ ID NO: 7518 - DNA, 1501 bp, Oryza sativa
gaagatgccccaacacatacagagtaggatggagggaggtggtgatcggcgggccttgctagcactggcaaggcgggggtggtattacatattaaggttgggcccgtaagggaccaaaccatagggcatgtttggttgcctgcatggtacctggctcgcatgcacggatgcaatgggttgtcatttggttgcatgcatgtcgctcctagcatggacgaacggatgcaaaaagcccctccccccccccacaccaccaccccgagtcaagctaagttggaatgctcaatttgagcttcgctactcggccaggcccacatgtgcaaggataggctatggggtcaacaccttgctcctggacactcctcatttctccccagcaagcgatgaggcaatgaagatggggacaatgagcttgatggagggaatggtgcacgatggatccaccttgctgctacatccctcctgttcaagtagttcccgcaccttcaatcattggccaccatcgtcccgcaccttcttctgtcgccggccgccagatccaatgcagcgaggagtggtgggcggagggctgcgatgggtaaataggcacatcagcggtgtcttcccatcgctccatggtcgttgtcgtcatcttcatcgaggcacgcccgtcatcttcatcgccccaccactcgcctaactggatctggttggcattgcttcccatcactactagatctgggaagaggagcgctaccgcacctccatcacactactgacgccacttcactactttctcaccggctgccgccttcaacattagatctagtggccgttgtcctctctttcagccatcgcgatgcaggatcccatggccacgagctcgccaacattagatctagtggccttgagctcgtgcccatcggatctggtggttctggcggtggtgagtggtgctaaatggcgaacaggcgaatagaccaacgacgatgagacaaagctcttctcgagtcctctctcctttttctttatttctttttccctttttcctttttttctttttccacctaattgttgtaaaaagggccgctccattattgagggtcaaacactattgtattttttgttaagggtgaagtgcacgggtggtctctaaacttgtgtgttatataggtccctgaaatttcataatatacttttaagtccccaaacttgtcctggatgtcatataggttcaaacaggttccaacccgctccgtgtcctaaagtggcatgttacagtattgcctacgtgtcagtgggacccacatatcatgtcagtcacatagaaagataataaattaagagtgcgagagagagagagagagaggagaaaaatatgtttctaattttgcttctatatgtgactaacacatggatctcaccggcacgtactataggtgctactatagcataccacgtcagcgtacggaataggttgaaacccgtttggacctatatgatacacataacaacttcaagg

SEQ ID NO: 7519 - DNA, 335 bp, Oryza sativa
ttatagatactcatgctgcatgcctgcattttgactctagaggcatccccttttcgttatatatatatatacatatgaaatatatccttcatatatgtattttttctgaaaaaatcttgggtattcatttgaatacccatgaataactgtggccccgcccccctcgtgccttcattcaccgatgccacaccccgccttcaccgcctccatttccaccaccgccgcgccgccgtgacacacgtgttatttgtttttagggtttgattttcatatgatgacgaagggatgtgtatgatttgtttgtataaatatgcagtgttttaagtataaagaaa

SEQ ID NO: 7520 - DNA, 1501 bp, Oryza sativa
tctgaaatacacacacgaagaaaagaaaaaatagtatatataataatgttttaatttttttttaaaaattgcatcttcactggcgggccacgtgccagaactaggacggtacatatctttgctgtcgggccacgtgtccatccacagaagccttacttcatttttcctagcgtgccacgtggcctaaaacactgtgagccgccaacaacgaattatcttcgctggcggccgacctaaggctaacgcaagtggagatacttctttgctggcggctgcgttatgtccgccgctagcaaagacatgtcttcgctagcggccgtcctaaggctaccgccagcgaagacatctctttgctggcgggcgttcctttctcggccgccaacgaggatgcattttggctggcggtaaataaccgctagcgaaaatcgacattttcactggcctttgctttctggcggctgcgatttccgcccgcgaaaacccaaaatggccaccacgaaagatggttttcgtagtagtgtgggctgaaccaccttgtcaacaacctcagtcactctctcagaatcatcattaacaaccccagagaaaggaagagccttgaccacccttgaatcaatcagacttgtcgtgcagcgtttgatagggcttgggctgctgtccatgaattccaaagagggaatggtgatcatgactccctaagaagtagtagtcagagaccacctaggtgacattacgatgggcctgaaaagagttggttgtaaggccaaaagcagtggtgcaaatactccattcgcaacagcttgacagaacaaatcaagcagacttctgataggtaaagcagggattggcagaccaaaaggaataatctgccaaccaatgttctgaaactctctctcattggaggaactgacagttaggtcgagagtgaaatcctgaactgaaactgaatcatggggcttttcaatctggttctgctccaaaatcatctggttgtcccccaatatcttcattctgattgtgattagcattgaaatcttcctcattgtgatgctgatgcttattatgatgatggtgctgctgaggaggtggcatcatttgccaaatgggcagtaggtcttcatctccaggtagcatatcagtgggttctccattcagcacatagacatgaaaggtccatgtttgaccattgcccccataagccatagtatcccccagaacaatacagtttggcacctcattagcagatttgtatctggctttaacaagtactctgcccagaactctatctctatagtgccagtctatgaattccccacaaagattagtgatccgttcaataatagccccagttttaagattaagcgggatgcccagaatcataagccaaccctccctggtgtatggcgagttcctccagttagctaactgatcatgcctaacgaaagtaccatggaaccaattacctagcagaaccggaccactggcaacaagaatgtctcta

SEQ ID NO: 7521 - DNA, 1501 bp, Oryza sativa
ggtgatgcaacgggaggctccagtactggaggtgatgcaacttgtggctctggtactggaggtgatgcaactggtggctctggtcctggaggtgatgcaactggtggctctggtctagagggtgaagcaataggactatccctcggactggctacgactggtggacgtgacggtgacaccggtatccttggtggacgatcagttccatccgttgaccctagttcaatatcattcttgtgccatagtatgaattggtcgacggcatctccaaggtacacaatctgctcagtagttggaaagtcgagctcgtgcatccggtaagcctcaatgaccgtccggacctctaccttggcgtagtcatccggaatgtcttggcaatgaaacctgtggcctggtatgaacctcccagttgcaacgagtattttctttcccaccctgctgaccggaatcaagagcttgcacggagtatcctccgttacatcatcgaaaggatagctcggctcaggctctaaaacagcagcaccgtgcttcattttctgactccagtatatattgcattcgtcacgagctgctgccctagcctgagttcattttctgactccagtatatattgcattcgtcacgagctgctgccctagcctgagagtcaatctcttccttgtagcgatcacgcttcttgtaggtatgagcatcctgtttgaatccatccttccagttagtctttgaggaaactccccgtacacggccagagtgctccggtttgcccaaggcataggtcagcttgtcccggtctctatctggcatgaacgtccctgcctgttgctacgtgacgatgttctttatcttgacagctacctcgtggagcttctgatccttgaatactacatccccctcaggggtgaaggccggtgttcttgcacgcacccagttcctgcttcgtgggttgtgatttttcataggaacgggtttcccagccttctccatctcttcatcttgttttgcccatttcttcaccgcttgctggtaattggtcgatcctaaatgatgtggatattcattccttcttgctagctcagccatcttctggctcttctccttttcttctgccgatgtcttaagggcaacgaactcatcccactgggcctgtgttatccttccgtagtccttaaacggcgtgagtcccttctggacatatttcttattttggtccgttttccagtttcaccacagcttccccattgtgttcaacgcataatccttggctttatcgtcgtctgtcccctctggatattcaaacttgctttgcagcgacgtccaacagctgttgtttcgactctctggaactttcttccaatctttccatgtgatctccacgatatccctgaccaccgccccacattggttgctatacttcgaacatgagtcttccggtgacaagggttcccctgtctcactcatccgcgttagcacgcttacttccttcaacaacatgatgtgacca

SEQ ID NO: 7522 - DNA, 1501 bp, Oryza sativa
agtttcccgttgcaacgcacgggtatttttctagttagctaaaaaatcaaaaaaaaaagtgcctatactattccatttaaaaaagtgcaaatttcttcgcattgcaccgatgaaaactgacaaaaatggaagaaaaagaaggagaacaagctctacaccttttatatggaacccaatcatagatttgaggtcaaaaacctcccccccctaatttgtgtatgtttagaagagagagaacgccgaaaaaaatgggcttgtgtcgggttggtggctatatagcccgacgatcatcgcatgcggtcggattatcccgtgaacgggataatgcgtgcggccgacagcccggcgtcggtccacggatttttccagccggagccacttatgccccgcctggaaactaacggggctggcgtccaagaaaatcaatcctgtagtagtgcatggtcgcctctaccgctcgtcggagtttcatgctcagacctgcttcagtgccgcgcgctcaagcatgagaccgataatggggaagaggcttcgtcattgccgcggcctactgtacaagctgaaggcggcgattcaagggaggtgtacgggggcgagtaccagcgcgccgtcgagaaggcgagggagatcttcttctcggtgagctgcattcctgaaccccctcaagctcccctcatagatgttttttttgtgtgttttcatgtaataatccatgtatatggatgtttcattagttagatcaaagtgcttctacgggtttccaaaggtgtttcattttttctttgattttttctcagatctttgttgatgtttctgtagcttaaatcatttgtttcatgtgttgaactaaattgtttcatccagtgatctgatagtgtttctctattttttaagcgtttcgatgacttaaaccatttgttgcatatgttgatcaaaattattttatctagtgatttgactgtgtttcacattttttaagaactgaaacattttatctagtgatttgatcaaacattattttttcaaaattgtttcacatttttctaattagtgtcccaacatccgatattacgggactaaaaatagcccctgtgaaacaaataccaccttagtttcttgccaaacttgagtaaattttataaaactgtagatactttgcataatctatcataaaactatagatttaaaaacttatttcacaaaagtagagatttagtgtttttttaatcacaaaactacagatactttgtacaatatatatcacaaactgcatatttaagaacttgtttcacaaaattatagatttaatatcttcatttgtcacaaaactacaggtttagtgtttttattatcacaaaactataggttttagcatttgaagacactaaatatgtagttttgtgataaatgaagacattaaatgtatagtttatagttttgtgaatacactgaatttatagttttgtgaaacaagttcttaaatctatagttttgtgataga

SEQ ID NO: 7523 - DNA, 618 bp, Oryza sativa
aaagatacaccttttttcttgttggctgatgcttctctaaatcataacgtcccaataggctcaaggatgccaggctcataatttacagagtatgcattacaaaaatcgtatgccaatttttcagctgcttgcctttttattccagacagcagctgcaacaatagggtaatatactgataagctgattagtacttgaacgttatgcttttatatttgcaaaatgcaagcatgtaacgtccgcattgctagaataacaccgagtaaactgcaaattccatatcaaaattatagattgttgaacatttggactgttagctgaagtctgaagatgaacacatgcggtgcttgattgacatttatttcatattttttgtttctctggtaggaattgagctcaggagaagaagttttcactacttctgatgttgagagagcgctgtggagctcagcagttgcatccaagtctcttaaggcgccaccaggaaatgaccttgagaacaagtcaaagactcatggcaagagaaaacgatgactcttgctgccaatgttctagttgagctaggagttactgatggtaggtcttagaacttagattgttcattgtatgaagttaagcaa

SEQ ID NO: 7524 - DNA, 1501 bp, Oryza sativa
gagagtttgttcccacttttttatggttttattccgagttaatctggagagtttgttcaatgttgttgtttactaaaataattagttaccatgactgatatgcttatcgaacttacgtagatatgtctgggtggatacgtggtctgaggtgttttggggttgctggagttgctcctccaagaagcacactagttcttttatggcgtgggacatatatccactacgctgctcaccatcatgatcataatgatatgttcactggctcaaataatcttcttgaactttgtactctcctcagtgtcccatcgatatattgcaatcttcttgaactttgtactctcctcagtgtcccatcggtatattgcacaaagagacattatcagtagcaaatcgttgaactgagacaaactcagtagcatatagtagattctctcttcttttttacactaggtaggtgttcgtgcgttgccactgggagaaattgatgtgttccagcacacgaaaaacgaaaattggtaaaataaaaaacatccacattaaatatatattatgccaacatcattatttttgttgtggtttagaataattgtagtcatttggatcaaactccctctgtcccaaaaaatgacaaaccctgggtttccgtgtccaacgtttgactgtctgtcttatatgaatttttttataattagtattttcattgttgttagatgataaaacatgattaatactttatgcgtgacttgtctttttaatttttttcatatttttttcaaataagacggacggtcaaatgttggacacggaaacctagagtttgtctttttttttttacggagggagtatatttgaatggacaatatcattcacactttagaaataattatttatcataattatacctaactctagaagataactaaggtatcgaaataagactagaaaaggcttatacggaataatctttttgtacgcataaaggcaatagagaagcttacatttacataggatcattcacgaatgggcctaaagagtgtctaataagaatataacgcacaggacgcttgcaaaaaaaaggaggaacaaacatctatctatagatgggcttgtgctgacatcatctatacgtgctttgctccagtgcaagtcctaaaatatcaggtttgtacgtgtcagtcagtttgatactataactgacaagatagataaattgatgataaaagaaccgatcagccaataagccgatttgatatggtcttgaacaattggctatatgtccgaggtaaattctaacgctcagataaataatgatataaagacaatagaagaacttgaacaatcaatccaatcgaccgatgataatataatagagtagatatccaatgatatgtgccgaagttgtatttatcgagagatattaatacatgggtagatactagtctgtttgaaattcctggctcttgaggcgccgaagtgacctcttccaccgcgccgccgcctc

SEQ ID NO: 7525 - DNA, 1501 bp, Oryza sativa
ctattttttaaagtaaagttatcaaagatgtagtacatacatttagtttcttttcaaattttagtaaatatataagaaatcttgtaaaaatgttagtaatattatattattaatttactaaaattttggtaaggtttattctggttacaatctgaatagcccttatatattagtgaatacatgtagtgttgcagacgatgtgtatatgcgcctatgaccagaggcctcgggcatcgcaatccttccaatgatgcacatacatatctcaaccatttcctgtgaaatattgaaaaattttgcttgatttagttcggtgaacttctttccaaacgattatgtaccaccgagacgtagaaggtacgctttggactttctggtgcagctgtaacaagcatacagatttatcacagagccgtgttggcaaaaatgaggcagatcgtagctagagagacctaacaccgtacgtgccaatcgtagctatcgcgatggttcaataattagggtaggaaaaaattgaagcgagtgaggacggacgacaggttagttcgccaatagtggttggcaattagtggctcgtacgtaccaccaccacatctcggtcgtcgctagctgttttgtactcgactcgaaaatcatcggaagaaaggtagctatatagctgtggctacagcaatttagccggccgatcgatcgatgatgacccaatgcgtgtgcaaacgccctgcatacatatatctaccgtgtagaagtggcaagcggatagttgtttgctggtacattcatacgcatgtccccgatccggcaacacgcatgttcgccgccgtacgcgcccatctcggaacgaattaatcatcgtttgatctcaccacccaacgaaacaaattaaggcattccaaactcaaaacattagaaatagtttccataaactccatattattaagaaactagtaatagacactattcttccaaaataaacactattattctatacctaaatgtaatgctccttatctcacatgatgtcttggatgttgtgtagaaatcatgtctcatgcaagatatggttttcttctcttttctcatttattcacttgccacattattttttatcctaggtggtagcttatttaatactatggacgtcatcctagttattgggttgggaatggcataagagacgcacgagattatatatatcacattaactgtgccggtgcatcgccagcagattgtggtagctagctcatttaccacacacggaacagtgctgtataagctatagctccttttgcccttgtcgatcgagaatcggtgtatcatcgtcgcatcggatcattgcacgtcgatcaacagcaaacagtgaggaccgacctactcgttgcgaaagcggctagctagcccgctgtgtacatgtagggccgggcctttttgatgaaacgcgcaggcgatcgaacgaacgtaatcaacgtacgtcccgccgttgattggaggacatgggagg

SEQ ID NO: 7526 - DNA, 1501 bp, Oryza sativa
ctttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaa

SEQ ID NO: 7527 - DNA, 1501 bp, Oryza sativa
accgccgtcgcgacggctcggcctataaaaagctccccatttccgctattgtccaccacctacggaacataaaaaaaggctggggtagagatgggacgggcagggaaggaagcagatggatagggttgggggtaggaggggaggggatagattcggttgtttttcggaaaagcccttgtgtttttcatatttacaacactacccctaagagcagaatgttctcttcttcgtgtcgcatttctgtaaaaattaggggtgttttctataaaacggaacatgatgttagtcggtgggaggacgtgcgcgctattccgtccaaacacgaggactttttttttgcataaacaccaccacgcggcatttactacgagaaaggttgtgcgtggcgtacatacaggacgagaccggcacaaccggtggaggaaacagcgaaaaaaaaatcatgtcacccaattgaggagcttctgcacctgcaaactatatgggacaactacagaggagccaaaaaaattccaaaaaaaaggagaaaaacgatagctttaggggtttaacatattaaagatttcatccaaattttgtaactaattcaaaacgattttactatatactaagcgattttggttggatggtagtagaagggtttttctaataggactaaagtaacagagataagcgattttgtttggatgaggaaaaaaaagatgtgttccatttaatcgaaatctcttaatatttttgggacggagagagtgtatgttgataaattttctcttcaaacttaacaaatcaaaaacagtgtaattgtaattttaaacaataataattggtaagaaacttttacctaattttaaaccatcagatttatttcaagatccatgcaaagttgtgaaaaatatcatagtacacaaggtgaggagatttggtctcgcagccttcactttaggaaaatagcatgttatccttggatatacaaattatattatagttacatataatttacagtataattacactatgattattttgtttacatctggtaaattttagggaaaaatttactataaaaattttatgtagctaatcttaattcaaaattcttggtgtaggtatgaaccgttctactatttctttttcttgggggtgtaatcctgtacgttgatttctatcggacggcgtagatagcatccgctggaaactttgccgctattaaccgagccgagctgcccattctcccgcggctgcgcttccggcttaaaccctagctctatggccgccgccgccgccgcctcctccatggcgaagcgcaagcaacgcaaggcggcgacggagcaggaggtagagaaccacgacgaggccactgtcgccgcggaggcggggcccgagaatgacgggcacacggcgcacgccgccgaagaggctgcggccgctgaggagggtgtcgagcgcgaaggaggaggcgagggcggcgcggagggggaggagggcccggacgctgcagcca

SEQ ID NO: 7528 - DNA, 1501 bp, Oryza sativa
gttaaaagaaattacaaagtaaatttaaattttcaacaaaatttgaataattttggtggagagtcaacgggttttaaatatttttttctcaaaaaccacatacctcggtttttagctccgaaatagtttaggtgtatttggttggtgggatataccggataagactaatcagtcattttgttgtagggatgtctggttgatgagcaaaaataggatatggctaccagatagagaatattctatgtagatgctggatatctagctctgggcaaattggcgggatcacgcggtctagaagtgggacgagtcgcgcgactgggtatgagtgcattttccctgccatctgttttatcacggcattttggccaccatctctttcttccattcttgcggcagcacaaggagcaactctcgagggcgccccgcggcacggggcgacacttgataacgctcagtggagcgctgcggtgtaaggggatatgttactatttatggtgagtgacatgtaaaccccaccactctcgagcccatatgttagccaccaagtcagtggaaagttatatcagataatctcgctctgggcatagcacagatagtgtaaagggtgtcgcaggggcggcgtccgagtgtccaacagtttggcggtgaggtagtgatgtcctgctacatcaacattgatttagatatattcgtgtgttcttgctttttttctgtattcgttcaaatctgacgaccgacgaggtagtgacagccgactgcacccctctggactatactctcaaattcttagcatgcatgtgttgttatttttgatgtattagttcagatatgatgttccttacccattgtatggcttttgatttgggtgtctgcaaggtggcatttgtgttcttatcatttgtaaataaatagtggataaaattaatttacacctggagaaatattactcacaaaacatgcaagtcaaggtgagagatagtttatcgactggggtatcaatgcagatcatccatcctagcaaacaaaaaaatatatcatcccattcaacctatcaaacatcaaaaaaaaaaagaaaagaaaagaaagaattactatatccataaaaatatagatggacatgtcctcggtgaactctggttggacctctccctctcttgtggtggcgcaccaccacctccagctgccccggcatatatgctcctcccatgtcctccaatcaacggcgggacgtacgttgattacgttcgttcgatcgcctgcgcgtttcatcaaaaaggcccggccctacatgtacacagcgggctagctagccgctttcgcaacgagtaggtcggtcctcactgtttgctgttgatcgacgtgcaatgatccgatgcgacgatgatacaccgattctcgatcgacaagggcaaaaggagctatagcttatacagcactgttccgtgtgtggtaaatgagctagctaccacaatctgctggcgatgcaccggcacagttaatg

SEQ ID NO: 7529 - DNA, 1501 bp, Oryza sativa
cgtcgtttctgattttttttagtcaaacatttttggatttgatgaagtttatataaaatttagcaacatccataccatcaaattaatttaattaaatataacattgaatatattgtggtaatatatatcttttgtcacaactacagaaatcataataagtaccagttgaaaatcccacgtagatgccgaatttcctagcgggcacatcacaggcggtactaatgaggaggacacaaatatgctggtttaactgacaccattgagatatacggtttgaaaaaaaaaagctggctcgactcgagttgagctgatgattgaaagccaccaaaaataaatcgaaaaattcaacaacaaaaaggagacaagttcacgatagagaatcaacgagttcatagatcaaaatcaaaatattcatcgataacttcacatcattgaatcaaacatcatcgacaagttcacatcaaataattcaaaaaccaaattaaataatgcaccaattacactggagaactctgcccgccgccatcgcgcattgaagaggaaggggaggctgccacaaaggagagaagggaggctgccgcccctgcataggggagaaggggatgtcgtgggcaggtgagggaaacaccgccgaggggagatgaggtggatgtcatcccgttgagccgcgctgctgaggggaggcgttggtggacgttgcctcctccgctcgctctgttgcctttccatcgagcccccaccgaggggaggcactctgaggaggcaaggccatggagaggtgagggaggtgccgccgaggggaggcgagatggatgccacctcctcccacttgctcagccatcgtcccttcaaaccgtgccaatagatgtggggatgtgggggagagattgagaaggagagagccggctaggtggagaggaggctgccttgcctgcttgccctgctagggagacggagctagccgccgcttgcaaaccggacttggacgggagagaggagatgggagagggagatggagacttgagagggagacaagagacaggaggataagaagagagcgaagagaccgagaagataaggacgagagtgaccctattcagttcggctccttcctagagtgttggttgtttaaaaaaccgatgctttttatcttgtataaggtgccggttgttattaaaatccatctatgtctgacaacacttattggtgctgcgtaatattaaaaaccgatacctatatcgtcacataggtgtctgttctcccaaacggtgctatatgagcacacgttcggacgagaaaaacattataggtggtggttttattttttcataagtttagttagacttaaaagagtaaaaaaaaatcaaaacaaattaaaatatgaaacaaagggagtttgctgggactttataatttgggtaaagttcaccagctgtctctcaactttacgtcgagtttgtataacatccctaatccccaatactagaaatcttcacccctt

SEQ ID NO: 7530 - DNA, 1501 bp, Oryza sativa
tatctgctgcatatgtgcagggcctcttggcatatatgtatgtatatgtcttagtgatcgatcatggcaacagatcttaacttttgttgaagttgttaattttccatcacacaccaggttagacatctgctatgcatgtgcgctctagctatacacaatcctttctccttaatgcacatcagatcttaccacttttaactcttctcctttttcttcaggtgcactgcacctcggttttgttaattgggtgcatgcatctatgcatgaaaataaccatatatataccgatgtttcattaaatttttctatatgctaattaaatatgttggttaaaattgtcagtttttcagttcttaatataaaacaggcaaacttgccattttgatcagaaccaaagtattatatgtatagaaatttcactatttccttgcaaaaataactgtttttctatatgatggaatttcatttggtatatatagtagtacgtggagttacgagcagtgattgcaattttggaatgaaatcgggaaaattttcaaaatttcggtaatttcgctcctcaccggcaagcacatatctcgtccgaaatttttggttttttttttgaatttggtcgaagtttattcaaattcattcaagagtcatcaaatttccaaaaatatcggccaaaaaaatactgaaatttcggtgatttcgattctttcggcccccaccagcaaaaactcctgtttcgaaattgcaaacccctggttatgagtgcatggttacacacacatgcgttaggccctatttctttcagtttggaattattataatccagattattgggagtaagctgaaagaaacagacaacttattgaagtagcttattataatagccgctatccaagcctaaaggattgagatgatctttacaaaaagtagattccccaagaactcatcaaggatcatcaggaatcgcatatatatcatccatcctaatattccaacgccgcgtcgaaacccaaaccgttggatcggaaaccgactccttgttggcaacacattgtccatccgatccgatcataaatcgactctttaaataaattaaacaaatgtgattattatcaagtcccatgatatcacaagatgatctctcgcttggtttatttctggttcataccaggatctttgaaattatgattggatgcattcgcatctttgaaccatataagatagatagatagatagctagctggctaactatatctatctctatatctatgtagaaatattccattattccatggaaaatcaacataggatgagccaagaaagccagtgtggcctgggtataaataggagtacatatcaccctctccaccaacacaacacactcactgcaaaccccaccaattaacatcatatcacattgcactactacaacttgagtatatctagctctagcttcctcgtcgatcgccggtggcattgagtgtagagctagcggcggcggcggcga

SEQ ID NO: 7531 - DNA, 1501 bp, Oryza sativa
gtattggttgagttttgtttttttttttttggttaggagtacttaactgtgtatatgcccattacatatactgggttgacacaatttgagtctatgatataggaagaaattgtgtttgaaatatggcttttgttttatttgttcataccgctacttaaaaaatgattttatttctaacgccacacttcttaattcgttggtggatgaaagaaaaaacgctagtgaaaatacaagagattcctagttagtgaccacttgtgaaaaatacattttcgcaagcggtcgtcttaatatgtccatttgcaaaaataactctatttttatgtgtaatctcttaagtggcactaaataacaccgcccgtaaaaagatttggctctcaattcccacgcatacaccttcctcatccgcttcctcctcgtccttcctcatcctaccccatagccacacacttctctcctccaccttccacaccagtggtggcatccactagcggcgggcggagcttgggcgaggctcataggttgtgtcaaagatcgggcgaggcgcgcaaacggcggcgacttggtttggcggcggatggaccagtggcagagctcgagcgaggcacgcatggtgactcatgtgggcggcagtccggccactgtaactcgcgtggtgatgagaatactaggtcctgatcttccgataggtattgataactctcgatttggtggaaacttgacacacacgatctggcttccgatcaacacgatctgaaccctgcaatcgtagcatcacatctcctctggttatcacccgtgtactaccgggttgacctcgctgagaaggctaatccctgcatacgaatcgaagaacacaagcaagaataagatatattgcaacacaattgcatataaatgattaagcactccaatttggggttccataaaccgaactagcggcgaaactgcaatggcagaaataatctaagcaaaacccaactctaaactatgaaagctactgaacaaatatgatttgggacgtcctagggttgccctaggacacacaccgcattggacttagcccacgacacaattacatggcccaataccaaatcagattcggactagatgatgtatgtggcttgttttgtagattcccgacagctcggtgagatttttgatgtgagaccaacaccatctcaaagtatactccataaactttccaacaagtgcttatgggccccgagattccttatagatcagtggctaagtccgtttgaagttgatgctgtcaggaggtccgaatccgaatccaaaacgtgtagaacttttctcttgttttttgtggaccaaaaatgatgtggtgacgtaggagtggacttggagaaggtcttggtttggtctccaatcaactttttttatcatccatgcattccttacactcgttcgcttttccttcatccacacaactacctctgcaaatgagaagatataaaactcatggtgtaataatgtttgt

SEQ ID NO: 7532 - DNA, 536 bp, Oryza sativa
ccagaaagatggggtggggtaagggggggggggctccgggacatcgaagcctctctccggaggtacactttgtttattccggagctcttccccaaacacattttaacgacatattgcaggatagttagagttgtgtgaatgcacgacttcattatatactggccatgtgattgatccacgtaatgaataagaaaaaatgtttaacagcagaggttatagtcgcatgaatgtgcgactgcatagattagtatttcttgaaaccggaggtcagtgcagctctcaacagatagatatggtggaacaattttatttggtcagtgttgagtttccttgacatgcactgtgcattagtaaatgtatatgctctacacacagaaaattgtaggctttttcttgacagaattttatttgtttgtcaagtccaacccactcagcatcaccaagacattgacagtaatcaattcccaaaactaagggtctgttcactttgatgccattttcaaccttaccaaattttagtaaagttgccaaaaaaa

SEQ ID NO: 7533 - DNA, 1501 bp, Oryza sativa
ccaggctgcgtatatttattcgggcgatggatgggtagctaggatggatctataaatgcctgaaatattgtgagagttcaatgcaggcaggcagcagcagatcgatcgatgaaatatatgtatgcatttgctgcattatatcgtatgcatcagatcgatcagagagagccaagtaggaaggaaggaaggaaatccgttgaatgcaccgactgctcgccgatcttaaatttcttgctctgccgcagctcagtgcaggtgtggccttgatgagttctatccatccatgggtcctgccttgtttcattcaattcagtgatcgatccaatccatctctctcaattcatcaggtctgtacgtgtgtgcagctctgcttaattaaattccttagctctgagatgtgattaattgagatggcgaaattaaatagggtaacttgaaagtttccgagtatagaaatacactatggaaagtttagtgtacgtacaaactatataaaaacaacaaaagaatggtcgcgacgtttaatttgaaatttgacattttcgtttacttgtgttttgagcaaagctagcggacaatactcccacgcattgccaccgatctatcgtccaaccctagtccactggtgagtggtgactttggcatgcagttcccagaggactatgatttaattggttgcgctacaaataataaaccctagaaaaacatagcaatcaaacggtggtactaatatacgcggaattttagatcgagcgccgcacaataatccctcctttcggtttttcctttttttaccacctcgcctttcctccgcatcccaccttgctcggttacccatcttttcgttttttacaaccccacactttccgtgtttcttttttcttttttccatctcattcgtgctccatgaaagggcatggtaaaatattaaccatcgagttttttccggttttcgttccttctatccattttttctgttttctcgttttagtaaaatatttaccgtttagtttttctttccgatttttctgtttttctagtgtctcccacgtttcataaataatgaatttactatataaagttttccatttactcctaacttcccacatatgctttttcaaaaataacaaatttaatcacataaatgttccctttaaaagtaacaaatttacttgcataaatgcccccacatcgtacgacactattcctatatggccataaaagaattattactagcttataacactagtaattcttttactagtgatataaatattatttagactgtgtggtctacgagtaaaacaattaccacatttctcttgatatagcccatgatctcgtagaatatgtttactgttgtattcaatgcatagtataagagcaaaaactgatactaagagtattggtaatctatatcacaaaatggtcgtacgaatgaaaaaattacatgctcaatcacacacgagtgataaaattactaatcaaactagaaaaaaaa

SEQ ID NO: 7534 - DNA, 1501 bp, Oryza sativa
aaatgcattagatgctcaaatgcttgagatttccatcatgtcattcatcatgaaattccctcttccaatacatgcaatggcaaaagcagtgaaagaacaactatacaggacagtacctgataggatgaggaagaataattatcaactgactggaaggcggccaacgtttgaggtggaagagttgtcttattcaaataagacagtgtttcttcagtctgatcagaagttcagaatgcattactaaccattttttttcagaaaattagtttgtccaatcaagcatttagaggcctaatggctaattgacccctttcatgggactggacaaaaatctaaccaaaaagaaattatcactttaatccattttatattcctcccaatgaacatcatgcatgactccaaaggttccagcatccattccatttcaatttcagagattataaccagaatatgagatatagctttatgcaacgagaagacacagcagaatagcctaccaagacaccgggttgggtagttggcgaacatggccatggcagtgctctcactgtcgggaatgattagcgagtcgagcccctggagccctagaagctgtgtcagcttcaccacctccaccccctcacctcgatcctcctcagcgctgcacccaccggccacaaccgtataaagccatcaataacccaagcacgcagcatcaaagcaaaccataccgaccatgctcgttgtaggagacatgggcgttggacttgaggcggagcgcaggaacagacgccaacgccgatggagaccttcacagagagggatcggaggagcgtcgtgggacggacggggatgcggtgacccgtcttggtccgagcaaagcgcacggtgaggaccattggctagggcctgcagatcatcagtgaggacccgttggctgggacgcgtgatgaatcaatgaggagggctggcgcggcagatcagagcggatcccactctgtcggtggtgttgctgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttaggaaatatttagcaccaacaactggtatcagagcgcccaggttcgagtagggcgtgacggagtagcacggcgtatcggtattgtcaattgaagctacaagtatggcttcaagttcgg

SEQ ID NO: 7535 - DNA, 958 bp, Oryza sativa
aagaagaaaaagggccgaattgatgggtggtgggcccccctgggggtatatataggggtgtatcttgtggacgagtgatatctcgactagggtatttagatggtatgtggatcgtcggtacagggtatatgcaagattgaagtaaaagagatggagacaaggatttttatacagattcggaccccttatctcacaggtaatagccctacatcctgttggccgaagccggtgtttctctaattcatctgaaatacacaagtacaatatttaggataacctatctagctgtcgtcgacttggcgacatggataaccaactcgtagtcgacgacagggtagtcttcctcctcgaatatgagctcgtcgagatcagagatggcactagatccctcttgccagcctctgtaggcactagattgggtatgtctaggctaatctctgatgtcgatatctggtggcttgtcttggcgtgtgttggcttgtattgatctatgttgatcttgtggcttggcccctctcctcctatgggggcttgtatttatacccatatatgtccccttgtccaagtagaactagggacatcaatatggatacaatccgagtagttcttatcatttccatatagaactctattcatcatttcttatccggaactccttttatataagaggtatgatcccgtataagacttggtacatggtgagccctgccgagtttagtcaactactattagctatgtggtatctatcaacgtttgatgtcgcgattccagtatttgcatagtatgaggatagttggtactaggatatatgcgagactgaggtaaaagagatggagacagtgatttttataaaggttcgggcccctgaattgtcaggtaataaccctactcctgttggccgaagctggtcgttgctcttattcaccataatcacaccagtacaatatttggggtatcc

SEQ ID NO: 7536 - DNA, 296 bp, Oryza sativa
ccatgggggggtttccctcctcccgcaacgggcaaggggcgcgtctgcccgcctcatgttgccggtcagtggcgcggcaaggggccgggctgcccgcctcccgctgccggagccgccttgcacccgcctcccgctgccggagcagccttggggcacggctgcccgcctcccgctgtcggagccgtcctggggcacggcagccctgccgccggagccgccgtggggcgcggctgctcacccgccggcgccgcactggggcgcgggtcccagccgaccggcgctgcccagcagcaagc

SEQ ID NO: 7537 - DNA, 1501 bp, Oryza sativa
gcccgtgcgactggtacttcgacaccgtcggcgagctcatgcggctgctggtcggcgacaccggggtcggccctgcggtgttcgaccgtgcgtcgttcgagtcagccttcgctctcgaatgggagaactgaactacagcaagttcaaagttcttcagattttccttggtttatgtctcaaactaccggtcaaattagcagtttgttcgtaattcaatacatgtcccagcaaaattaatctgaagaatttgtgattgcagaatttcgcactagattcataggtgaattcaaacaagttttactgctagcattttcttcattacaggatacagggctacatccgaaacaagcagattcctaacaagacaaacacaatgcaaaaggctcctagccgccgaagccgtagagggtgcggccctggcgcttgagggcgtagacgacgtccatggcggtgacggtcttgcggcgggcgtgctcggtgtaggtgacggcgtcgcggatgacgttctcgaggaagatcttgagcaccccgcgggtctcctcgtagatgagccccgagatgcgcttcaccccgcccctcctcgccagcctccggatcgccggcttcgtgatcccctggatgttgtcgcggagcaccttccggtgccgcttcgccccgcccttgccgagacccttccctcccttgccgcgccccgacatcgacgacgatggaattggggatttttggtggcgatttttggttgatctgtattggggagataggtgagggcgatgttatataggatttgggtgggggagtggggagtggggagccgtcggatggggagcgatccgcgtgagtggtgaggagtgcagcgtgggccgttggattgagggaggcgcggatcggcgaggttggtttcggggagtgtagagtggagaccgcgcggggaaatttggggatttcgtggtgggagagcgaaattttcgcggtttggactatgcgcggcgcgagctttgcgagttttgcgccgtgatggatttcggcagtcggcacagccttgcctggttggtttggtatttttggagctctgggctgggctgcgctgggcgcactggcaaatggcaatgtgctacggatgaggcgatgagcatgtgcaggtttcctcggtaaaaagtctagaaagctacgtgtcatgccgtctttgattacttgtgaatcgttaaaacctggaccctttttcatgcaaatgatatggcctgccatccaggaatcgaagcatggcccggccaatggacttctgagaaaccaaatactactaccaaggttcctctgccaccaccagtccaccacagctccacaagtccacaactatattccacgcaaaggcgaagaagacttgttactctcttcgtcccataatattacaatctagaattggatgtgatgtttcatagtacaacaaatctggacatgcatctgtccatattcgttgtactatgaaacgttccatccagtctaa

SEQ ID NO: 7538 - DNA, 1501 bp, Oryza sativa
  unsure (1)..(1501): unsure at all n locations
taagagaggcagacagcgattgctacattttagtgccacgaaaatctattaggacagttcgaaaagaagccatcacgttcgtggtgaagactaaaaacacttagatcctgtttagataggactaaaacttttaaatccctatcacatcggatgtttggacactaattataaatattaaacgtagactattaataaaacccatccataatcttggactaattcgcgagacgaatctattgagcctaattaattcatgattagcctatgtagtgctacagtaaacattctctaattatggattaattaggcttaaaaaatttgtctcgcaaattagctttcatttatgtaattaattttgtaagtagtctatatttaatactctaaattagtgtttaaatacagatactaaagttaagtctctggatccaaacaccaccttatattaatcagagaaaaaattaagtaaaaaataatttagaaataattgaaattcagaaaaaaagaaatattgaaagaacatcacataaaaaacccaataaaagattaattaaactcagaataaagaataaaataaattctgaaattagaaaaagaaaaaaatgagatttaaataataatataatttataaataactaaaattcggaattaaaaataagaaataatagaagagagtccatatgtataatccaatatgagttgaactaaaatttttaataaataaataaattttggaattacaaaaataaaaataagattcataataatataatttagaaataactgaatttcagaattaaaaataataaataacagaaaaagagtccacatagaatccaacacaagattaattaaaattcaacataaaaaatatatcattacaatttgacataaattaaagatatagctctacttaccctttaaatttcatttatataaaaaaattatacaaaattaccccctccttccttctccctctctcctctcttacccaagattcagttgaaaccacggtcgccggcgacggagctagcagcggcgtggttaggttaatccattgacaggggcnnnnnnnnnnnnnnnnnnnnnnacagattagaaagagggagaaggaagaagggagtgaagaaaggaggaggccggggtatagtttagtacaaattttttgataaatgcattgaagaggtataagtatggcatatctttaatttctatcaaattgtaacggcatatgtctttaaataaacgaataataatgctattttttccaaatcaaagaagtcctaatgggtatgatatagttattttttttaatgtgaggactggtgagcccttatattttctttttttttataggtgaagccattaacttttggacacataatttgaccattcgtcttattttagaaactttgtgcaaatgaataagatataaatcatgtttaaagtttttttagtgataaaataactcacaacaaaataaactgtaattacatactctct

SEQ ID NO: 7539 - DNA, 1501 bp, Oryza sativa
tgagctagttaagtgggacacaattaatgacaagcaagtcgcaataaattaaagcatagacacgaagcatggcaagacgtaataaaggaaggaaggaaggaaattgagatggggtggtgaaccttgacatagacgtcgtcgtggaggcagtagagcgtgccatcgaccttggcggagctgtagtggcagcgcgccttgatgtcctcctcctcatcgggcctgccaccaacccagaggacgcgttgagaggaggatgcaaacgtggtgaggaggccagatctgggatgcgtgagtgttatacctcctggtggcggcgttgcgctggtagcgctgcggccacttgtcgcgcgcctccttggcggggaaggggtcgccgacgaactccgggtcgtggtcgccgtcgctgccgtgtcggaccctgctgggctgcgccacccgcttcctcgccacaccgggggcgggggcgtccagctgcttttgctccgcctccgcctcttcggcctcggcttcctcccccaaggccatctcctccgcatccggctcctccccgcaggcgtcgtcctccatgggcggcttctcctcctcctttacctcgtccttcttcttcctgggcttggtctccgccttgggcctgcgggtgcgcttggtggagggctcgtcggtggccttggcgaaggcgaaggcggaggcggcgcgcttacgcgtgaaggtacgcgtgggcgcggcggcggaggacggggagctgggcgccatggctgctgctgcctcttcctcttgctagggttttggatgggtttaggagcaggagaacctggagaagaggaaatggagagaagaagaaatccgcgtgaaatcgaaggagggaggattcgaatcgatttcagatgggagttgggcggaagccggagcgggaacccccaaaattttcggaatcaatcgcccgcacccgcacctacctgtgaccatgacgagtgggcccaaccgttggtggccccacctgcagtgggtagtggtagtgggcccacctggtttttgggaagggcgggatggttcgaattttcgccttcgaaacgttgggatgcttttccttcctatctctgtctaccgtgtgggcccttcgcttcaaccccactatcagctttcactctgctactttcctccccacacattcacaccgtcggccaaaaggcccggggccccacggcccggcccatatcatggggttttggaccggcccaagcatgacacgccccgactggtgtcgggcccgtgatgggcctcgtcaccatgggccggcccggttcaacatcaggggatgcaaaatcgttaagggacccaaaatagacttattccagcctataagcatggctcaaagagatgaggtacgaacaatagacttactaagccatataagagacaacccaaagacatgacggataaaaatgaacttttttccatttaagagcatggtgggcttttgtgcctacgggccggcccagaa

SEQ ID NO: 7540 - DNA, 1501 bp, Oryza sativa
agtttattttaacaaaagtagcaaccgtataaatttgggcatgatacggtcattaaaataaaatgatgtaacatctaaaattagagaagacatgcaaaaatgtggcaattctatgaaacccaattatgtacctgttgtcatcattttcggtaacaacttgtcttggctgtttcacattattggcattagcttgaactgcagtgccagtagcactgggagtcttcttcttgttttttgatgccctggagaaagatggtattcaatataacatggaaaagcacggggctataaataacatcagatagagaaaactggaacagtggcacctacttatttttggaagttggcgttttccttttatcacctcgtgcattagacccaggtttagcagtggaggctccagtctgagttatactcctagcaagagaaacatactaatcaaaacagaacatgaatgatttactcaaaaaatagtaaattttgcaaaactagaaatttaagatatagtataaaaaaagtatagatttaacactcaatttataagaaaactataggtttaagccatggtatcgcaaaattacggcttgaatctgtacttctaagataactttgtcgaaggttctgtaggcttgcaaaagttactccaaaaggctgcacaaaaaggtaaaaaaggaaatacctgttctccactctacttatcaaaaaaacatccacttgtgcagaactagcagtaaaatcgaccatccgttgcaaatctcgatcacatgatattgtgataagagttctgttattgttcgggagaaagtatttcagtgacacatctgaaacctcaacatgaaacaccttggacacctcatccttgaagttatctagtgacatctctcgtgtgacgtcaacagcgtgtgcttctcctcctttgtagatcaaattgccattggggccagaagtgaactctccaccatactggcaaatggcaacaactagggacccctctgccatgcctccagagttgttccgtaatctacatgttaggaaataaatcaatgtgcatgcgtaatccaggacagtacaataagaaattaagtagtacataaagaatccacgtcactatgaaataaatattattatccaaaattaaatgaaacccaataatatcgatatccctgatacatgaactctacagaagcgtgaattatggccctgctaaaatatttatttatttattttaaaaaaaagaatgattcagcgagcaagtttcccaagcagaacaaaatagcagtatatgttaactacgttcatgggcattatttagggtgaggatttagcaggttttatgatctaccttagatatttatgtgtaattaatgcattaattgcatagtttgtccgtattgcaacggtgaatgttggaacgttggatttgattgaaggcaggtgactgtagtagttcagtgtacacctcttttgggtggaggtagggaagaacgcaagtgatactttt

SEQ ID NO: 7541 - DNA, 1501 bp, Oryza sativa
gctcttatacgaattagcagacaaccttgctgctatatggggctcctctactcacgtatgcaaaactgtacgcgtcatgtatatcaactctatatcgtccctaaccgatggaaattattaaagcaataatgaaatagctgggctaatacgaaattctggattatttgaacttgtttgatttgatattttgttattttccgacatgtaaattaacatcacttagaaaaccatttttaatttgtacatattgcctttatttttataagcgagctaaaagaagagttgcttgtgaaaatgaaaaggactcccccatcaagacctgcccataaaatttgattttcactagcagtcgtccctttaggaggaatatctgatatttttcacaggcaagccttttaggaggctcgtgtgaaatatatccatattgatattgtcacaggcggtgcttgtaagttaaccgcttgtgaaaatcactcaaagcccccctcacgctcacgctgtccccttagccccgtcatgctcaacctccctctctctcatgtatgtttcccatcgatctcctccttcttgtggccgatgacgacgtgagaaagggacgagacgtacgttgctcatgagctcaggcaccgacgttggtgacctcagggccttctggatccacgacagttgaggagatgatcgtccaattaatggcaacattgcgtgtatccagatggcaggcctccaaatctagctagcactacggctgcagcgacaatggcagcttgcaacaacgatgcatggcttcatcgcactggcgatggaatatatatatatatattgcagcgacagcggtggcttcattgatgaattttcaccaatgtggaattttctgcaaattgttttctagggatcgatcggagcaacggtttctggattattaattatttttcaatttctttttcagccaaaagatattttgttaacatacatacctttaggaggtgtcgtcgactatgaaaatcgattttcacacacacacacacatatatatatatagttctggttctgaggcttgttaataaaaatctgacatctggttttaggcggttgctacatccacatgtgaacagtgattttggcagtctggaaaaagcttctgttggaatttactcttttgaaagtcgatcgaggtaacaggtgatgcacatgcatatatgtgttcgtgcttgtatctttcacataaagatttggtatccaccgtccaaaaagatatactacgtactaaattaatcaaagtgaaaattattgatattgttcgttctggtgtgattgtgtgtatgtatgcgcggtaaccatcgagcacacgtgaatgagagtgatgaagtttgaatggagaggaacatacaccgattaattaagggcaaacatcacttttccatgcatatcaactacagtgtttaaccccctgttaattagctgcccatcatatcaacctttctacttaattgttgcatgcacc

SEQ ID NO: 7542 - DNA, 1501 bp, Oryza sativa
gtggttaacaagattgtgagagctaccatcctccctcgcctgggtaacaatgatgacattaggggggtggcttggcacgtcatcgatgcaatcattcagggccgacagttcgacattgtgactctcatgctgcaagagattgccatctccaaggggaccttcactcagggaatctattatgccccttacatcatgaggttgattcaagacaagcttggggctgctaggcagaatttgaagaagcacaagcagtacaagccccgccttcagcttggagctccctgtgctcctagggtggcgccctcctctcatcctggagctagctcaagctcagcacctcctcctcctcatgggtatgatccaaatgccttctttcaccctcagtatgcctattttggaatgcaacccaacgagtacttcaacccggtacttggggctattaataccctaagtgaaagcattcaacgcttgtttaccgggcatgaagctttgcatgaggatgttcgtggcttgcgcacagatgttggagacttgaatgcttccgtggggagattgcacactcgagtgggtatattggattctcgagtccaaatgttggagagctcccaagcttctcatcgtcgtcgtcgtgatgcttctcatccttccacttcggcgtgtcctccttctcctccacaagagtgaagacctttttggtgcttgatgccaaaagggggagaaaagtgtgttttatgttgggttgggactagtagtagtgaggttagtcacctcatatttaataggttaaggaggtttgggctatattttgtgtgggtatgggctattactctatcttgtgtgttatttgtcattttgttaaactctctatgtcatttggaccctttgtggtcttgtaatagcctatgttttatttgtgagcccttgatgtggtcttaatgtgaacttgtgctatgatgcatggttggagttacattgatatacttgtgaccatcttatgcattcggttgattcatatgtgaagttcacattataatttgcatatgtgttgtgctatgttgaaatgtgaaattgaaatgtgcattggctccatatttgctatttgtaattgttatgcatatgtttagggggagcttttgcttgtcaatgcaatatatgtccatctgctctatgtttgattatatatatttgtggtgtttgtcatcaattaccaaaaagggggagattgaagcatctaggcccctggtgttaattttggtaattaatcacaagcgctaattgtggactaaccgttgtctttgaactatacattttaagttaggtccacatcatatgtgcacatggatgattatcgatggattaaaattgacggcgcaaagcaaagggaaagaagacggtaaaactagcgctttaatttagaattaatcgaggtgtagggcgatcaaatttgctagtttatttttagtttcgccgtactattaagaggggtaatgacctagcaaag

SEQ ID NO: 7543 - DNA, 1501 bp, Oryza sativa
aagtagaaatacaatctaaaaatagctgaaattcaaaattaaaaataagcaatattgaaagaagtttccatataagaacccaatacgagattaatcaaaattcgaaataaaaataaaataaaatccaaaattaggaaaaaaaaaagagagtccaagtagaaatacaatttaaaaataggtaaaattcggaattaaaaataagcaatgttgaaagaagtttccatgtaagaacccaatacgagattaatcaaaattcgaaataaaaataaaataaaatccaaaattagaaaaggaaaggggagtccaagtaggaatacaatttaaaaatagctgaaattcggaattaaaaataagtaatattgaaagaagtttccatataagaacccaatacgaaattaatcaaaattcgaaataaaaataaaataaaatccaaaattagaaaaggaaatgagagtccaagtaggaatacaatttaaaaatagatgaaattaggtattaaaaataagaaatattaaaagaagagtttcatataagaacccaatacgagattaattaaaatttggaataaaaataaataaatccaaaattagcaaaagaaaataaaataagagttcaagtaggaatacaatttaaaattagtttaaattcggaattaaaaataagcaatattgaacgaaaaatctacgtaacaacccaatacgagattaattaaaatttagaataaaaataaaaataatatctaaaattggaaaaattaaaagagagttcaattaggaatataattttgaaacaactgaaattgaaaataaaaaataaaaacattaaaagaacatattggtattaactaatttttttaaaaaaatactgaaattagaaaaagaaaaataagatttcaattaggaatacaatttataaataactaaaaatttttgataaaaataaagattattgaaagaaaagaccatctaaaacatatgacgagataaattaagtaacaggcctataaaggagtggagtggtggcggttgatacgacatataaaaattgttaataaaacatcaaatagaatcctaatgacgattaaaaagaagagacgtcaggcaggccgtgaagcaaatgagtaaggcggttgccgagacttcttagacagtaaaaaaacaaaccgcattgataatcgtattcgatttttaaaatctcaatgacaataaaaaggagaagcagcgagcggggtgtataagagtatagttgcagagccaccgacggttgacgggacttctagaaaataaaaaataaatttcaacgatagttatattccatttttagaatcacaataacaataaagaagtaggcggcgaacatgctgtagaggggcatagtggcatcatttgataggacttctaaaaattataaaaaatgaaactacaagtccaacttttaaaggttcagaacttctaaaaagtaaaaaaaacaatgataatcatattcgattttaaaatctcaa

SEQ ID NO: 7544 - DNA, 972 bp, Oryza sativa
agtacgtcgtttggattgtggtcaattcttgccctaccagttatttgatagttttgaatagtatttactaactatttggattgaggccaaattatgccaattcaatagagttgaaacaatacaatccaaccaaaaatttgataggacttaaaaacaaaacaacccatagtgtagaacgtgatttcaccgttactcgcgagggaacattctcaaagttgttatgctagcaaatgctgcttttatccctcttcctgtgtatccaaacaatgatgagatacaattgatagtgaaatggtaaaagatgtgtggtttcaactctataatcatgtgttcaatctccaaaacacacattttctttttaaaaaatatttggagggatatctctccccccaaaacacacattttctttttaaaaaatatttggagggatatctctccctctaaatctcttttttttacggagggtgtacatccaaatgtttggagctatatctctctctctacggagggtgtacttccaaccttgttgtattcaggtgcaggttttgcccttttggggttgggcctcgaatgttaattttaaagtatattgtgcaccttcttaggatgagttcttttcagcaaatcaaaacgacaaacgacatctttcttgtatttcattagcatatgcttcccaaattgccaaacaatatattctgtgcaaaattgtatatatagaagttctctttttgaaaaaaatatttttaagtttataatagttaacacttaattagtcatgctaatgattattctcgttttgcatgcggcgaaaaagattagccaatctgtcttctcgaacgaagcctttgatcgaaaaggtagaggtacctcatctgcagggttacttaggaatccataaatgtaccatatcttcttctctatctttttgctttttgaattttagggacaacatcttcaggtattaatctatct

SEQ ID NO: 7545 - DNA, 1478 bp, Oryza sativa
attcctgcagcccggaatagttggataggagtatgacacatgggtcccatatttttttaataaataaaatgctgactgtactgccacgcgtacgccacgtagaccaaaaccactgtggattgggtcgaggggggtaattcgtccggtttacatagttcggggtgaagaatgtccggttttgtggttcaggagggtaattcagacgaccgcaatagttcgggggggtaattcgtattttttcctttttaaattgctaaatggtgtatcttttaaaaacaaaacttttttatgtagaaattaaacagatcaacttttaaattttcaatagttaatatttaattaatcgtgtgctaattatcgatcgtgttttcatcatcttagccgtcccgtctaagctaaacgatgcctacaggtctgagtcaaatgagcctaaagcccacgtctttttttttctcttacgctgttacgcattatataatatcaagatcttatatttatacactagagtatacttgccaagtttctaaacggtaatttttcagaagctttattagaaaacttctactataaaacaaaactctacacttttataattgttaatgtatactgttttgtacctttaaatattgtttcttttcgaataagatacctctaatatcactgcaaatcggataattcatcgtccattatattcatccgttcagctgaaaaatgttgtgcctttcctaaaaaagtctatgaaattattagatttacaagcagccttgaaatttgaatatattttttttcaaaccagattcctataaaaaccagagaaaaaaaatattgtttcaaacgagcccacgatcgaccagggattgatgaagattaggcaaggcatagatgagatcggagcactgatctcatctatgcgtactggaagggagggagtcctttttcttttcccctttgacgccgtttagttccgtttgctggcttacttgtgcttccttccagagcccgagtccggtcatcggtgtctgttccctttccttaatgggcaagctgacccgtgccgtcgtgcccagatgctgctgggtagctaggtcccgcatgcccagaggctagtaccttgctttacgctgtttgaattccaggcaactctagtatagtcatgtctgtcaactactattactcctctagtaatccattgcgtgaacacaatatggctaccgcctccggggccggtcctatgattccgaggatcctaagtgaactcatcacgatggaccctctaagctatatataaaattttatagtatatatagacattaattttacttgtaaaataaaaacaaatacatacatatattaaatttaacatgtctgataattatcaagaaataaagtcgaccaaaataacaatatatttgtaacttgaaattaatatcattattcattaacttaatgaagaatagaaccacatcatatccattgct

SEQ ID NO: 7546 - DNA, 1501 bp, Oryza sativa
caccacctgccggcggggcgctccctactgggagtaccagcctctttctttttgtcgctcgcaggcctcccctttcgagtggcccgcggagcgccctcgacggcgaggacatggccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaacccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcgggcatccggctctccacgctgatcctcccgagttggaggtgtcgacgagggagtggcggccgaatggcgcgcagcagccgccgctcgccgtgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaagaggcgacgctccccatctcgccgttctcctgcatcacctgcgactggtgatgccacggaattgtcgaccctctcaagcgcctccccctgctttgggctttggcccggaggaggtgggggagtacaagctcgacggcggggattcggctccccgtcgtcgccgctcacactcgaggagaggtcgtgcgcttttccttgctcggccattaggctgaacaagaaaaacttggcgcacacggaagagtctgagagctcagaaaacacacactgagtcccctacctgg

SEQ ID NO: 7547 - DNA, 1501 bp, Oryza sativa
ctgtcgtccgatgtagacaaataaaatgaacgcagagacatctccccatgtgcatgtgcatgtatttctctctcctctcatccgtgagtatacagtacctatgatgcatacaatatctgctaattttatgtatgcatgagactataaacgtaagctttaaatatctttccctcaaaactacttatccaatttacgatataattgtaccattatatttgttgtaattaaatctttacaataagatcttagtcgattatattctaacaaaaaaataaaaaaatatgttttaggttgtgaaaatttaatgtttcatatgtcaaaaataagtgtttcaattgaaatttgattatgttgcacatttaagttttgtgttgcaattgattgttttttaagtgtttgcacatgatgttattcgtatgttttaataaatattttatgatgtttcactaattcatctgaaaaatgttgcatgtagtgttattaggctatttcaataagtatttttatgatgttttactgatttatttacacttgtttcacacggtgttatctagatgttttagcaagtattttgtgacgtgtcatcaattacagcttgttgtttcatttataatattaaaatattgcaataagtagtataatcatatctgtatatttatagtaaatataattgagtaaggtcttgttataaggatttaattataaaatataatggtgaaatcaaatcattgataggataagtaatttaaaataaaaatagttcaaaattttatttaaaatattgttaaaaaagaaatagagatgttacatgtagcatggtagttcatatggatatgcatgtaacctgcgtaagcgttcgtaccgcgtttgagaaaacctgtaacataaagtccaagttcctattttcatgaatagaattcaataagtcgtggtttttatgttggtgtgtccctcaatcaatttggttatgtccttcatatttcgttgtgatgtgattggtttggtctcaaattcgataataattggttctaactatatgagcagaggccgagattttatctagaaaaaaatcgctgtttttctatgctgctgaatattcgctgatctttgacctcgaagaaatacggagtagtagaaaataaaaagaaatcaggagaatatgatccaccattggcagccgagcacgtctcaacacgcacgggacgggacgccatcgtcggccttccgctgcggactccaaaacgcgtataaatcagcgtgcatcgacccacccatccggctcgactcgacccgactcaatcgatccatcccggctcggctcagctcggctcgagcgactcggctggtcgtcttctctccaggctccggagccaccaagccagatcccccacagtatcccacggtcccacccgccttgccttggccgcctccctccggtccacgaatcgccgccactttaaccaagcctccttgatcacactcctaatccgatagcttaatc

SEQ ID NO: 7548 - DNA, 1501 bp, Oryza sativa
actgattaggaggtctgacttcctagtgattagccaattgcttcagtctgtcacaatttttaacgggttcagtaccaactgaaacagcaggtgactaggaaataggaatatcgtgcagccagtgacttggcttggaacagtgacaaactgaagttgttcataacatggagtagaagtcctaggtagaagtctataaaccatctggttatcttgaaaattgaccagagaattttcatgttgatttcttttctgtccaaaaccatactgtcattctattactacatgtagttactgaatgcacagttttctataagatcaaaggcttcatgattcaggtggcaaagaaaatttacagatatgaagttctgggagatattatatgtagtctttctggaacttgcatattttggtttgacatactcctagcatcgtttatcagatatttgaaggcatgtagacagtgaatgcatttattccttcagagaaaggctttactcctattgtgctaatattctctcttttttcccttcttgttaagagtattggcttccgatgttgcccaagcctattaattgaagcagtattcagtccaagagtaccacttggtggaggatacacttcatatttgtaagtggttgatatctattgatgacaaaacatgaaacatcaagtgtataactgctgttgagatgtaagcagccgctggtaatacaaaacatctgatcaatcttctccctcagtcaatcattatatgcgagctgctaatgatatatactagtatcatgtttgtcccgtataactatttcaggtgctgaatcgcttgcaacaaaccgtccaatcattgccaaatgcgaaacagccttagcttgccaacgtcgttgtgcagttaactgatgtttcgtgatccctggttcatacatatgatgatttgacaagcttgacaagaacgggatttttacacgacatttgcggatttgccagtttgcagggataaatcactacaacagttatatgccagaacaggcccgattctgcactggtttccatctcaacacctgtcgttggacatcagggtgatcatggctgaaatctcgtagcttcgctttgcagtgccaaccaggtgtcgctgaggcaatagcaacttttggcactaggcaagtggaaatgaaggtaccactagatcactgtgagagcaattttgtcagcgctggaggtggctcaagtgcctaatcgttaagaattttaaataggaggatagataaatatatcaagtacctgagcgctggaggtggctcaagtgagatttacctccccaagaatgcatcgcctagcagactcccggttggacatcagcctgtaatttgaagccaagaatcgtttcatgtgaattattcgtcagacattcttactagaaaagcaatgcttaactctacttacgaatacgataacagtgttcaagcagtgacagacaaaacactgtaaatgattgttcatgtcttgg

SEQ ID NO: 7549 - DNA, 1501 bp, Oryza sativa
ttgagatgaacacacatgttcagaaacattcagcttatactcaagtgcatagcagagctgaggtagttactgttaaacctgaaacaaaggagctattgaacgctgaactctagtcctttgctatgcttgtcagcaacaagattgaggacaatgattttgtattgctgcttctgaaacatctcacttccttaagattgatagctaagattgcattgatcatgccatgggatctagctgaaagcgaaggacaaatttataaagcttttgggacagtacaagtgtgcaatataaatcaagagtggagctttgcaagttcaaaagtttatttgatatcgacttgcggacaagtcgaatttcaaggagaggggattgttaggatccgtgggctgtacgtgggccaattcagctgctacgcttacaaaggcccaatcatgtctatgagattaatacaaaaaaggcagcagcaacaagcttccaagatcgatcaatcagttggcaagacggcgaacggcgacagcgtcctggttctgggcttggaaccttggcgatctccttccccacctgcagctcctcctacctccaaatcctttgcttagcttctagagtcttttagccccttgtatccttccaccttctacctcaaaaccttccactattgtaatagaaatcagtggcttcttatattggattcgcactgctacttctgagtttgctattgttccaagcgagagaactgggatcctaacataatcttgaccatttagagtcctaggttagggtcataatgacaagagggtcagaaaagggggaagatagagggggggggggagtcgttggttctattgggatgactgtgggtgttggaggactgacggtgggatgcaccatcggcgccgtggggacggaggagaacgatgggtcagcgtcggtggtaagggctaaacaaagcagttggtttggagctaggtggtgacagattatgcggtggagtacttaatggagacgtgaattaggggagggggggaggggctcgccggtgttgtttgtgccttctgcccaccaatgatgcttggtggcggcatcagtgctcgaggaagtgtgcgggggcaagctcgcgtcacacttgtgctgcgtgcggctagggaagaaggagaatgggaggaaaatgataagatcatattgttacgtacgaatcttaaagcatatagttgtccaaaatacgaaagacatgagctacgattttatgtcataagatatactcatctctagctcattcagtagtatagattaatgccctccgtttcacaatgtaagactttttaacattgcccatatttatatatatgctaatgaatctagacattattatatatatagatttattagcatctatatgaatgtagataatgctaaaaagttttacactgtgaaacagaggaaagtacaattttaagctgatgatgcgttcttaattagaaaaccactagttgactagttgtaa

SEQ ID NO: 7550 - DNA, 1501 bp, Oryza sativa
agagatttattatacgatttgttctatatttacaaaagtaaacgaacttaaaaaccgactcaaatatggatccgtatttccaaaaagaacaaacttaaaaaccgactcgtgcacggataacgtaccaaagtaccggcaaaaacatattcaattttttaataatagagataatagatctaacttaatttatttatgcatatttggcgaattgatcatataatcagcattatcaaattttccctattttacataacagtttaaagtgatatgtaaagttttggatatgataaaaattaaatatttcttataggttaaagaacaccttaatttttttaatttttttaattgttaaagaacacaaataactataggaaaattgtggttatctaagatttgttaatgttcaaaaatgttaataatttaaaaaaggagattggataggagggggagggaggaagcacgtacgtgagtacgcccggtggaagggtgggccccatcaaatacgtgactacttgttttggttttttttaaaaaaaaattctaatagataaaaatatcaggtccactggtttgttaaagtgtcatgtgacagtttagaagtatttgtacgaaactaggaatacacgtgacggttttagtgtgtttgtaggaattttaatagattttcagtatatcatagatagattgtcttttccgtggattgttttgtttacttgacaacggaatttcgtcaattgttttgtctaattgaaaacgttttttccctcgatgattttgtcaacttttaaaacgattatttgtttcttccgtcaattgttcttgttgacattctaacaaggtgatgaattctgatcaacacctcatcaaaacgtctccccggaaaaaaaaacacctcataacgtcaccaggaaaagaaacgagtccaaaacactcgagatgcttcagttcagacttcagagatgcctcactcgatcgccggccacacacaacacacgccaccccattcttcatggcgccgccgttgaacgttgccttcatgcgcttgcttgcgattgcgggagcctggacgtcgccgcgcttgtgttttgcgtcattctgcgccaatcagggaaaaaccgaaaatttttcggattaattggcgagcaagttatagtagtactgcggctgcgccggccggcgatgcatgcacatgcgcgtcgccgcgcgctagcttcgtcccgtggctttccagagttcacactacttcattattgggatttcattagccactaatgcagcaatccaacaatgaccgagcgatggctatatatacccatccaatcatcaggagatcaccaagcaaacagacatcacatagaagatcaacacaaagcaacagagcagtgttgctttcagagatagatagctccagataattaactcggtcatcaagtctcaagggcctagttacagagttatccgatcatgacgacagacatggccccagctcgagcgttcgtgt

SEQ ID NO: 7551 - DNA, 1501 bp, Oryza sativa
aaaaaagaaacaaacaaacaaaaaagggaaaacctaatctactggaaacgtaatgtacaatcggtcaaaaacaaaaaaaaaacaaaagaaaagaaaaacataatcatattggaaacggacaatattttgggaatacgcgtgttaacaccacttttagaaacattgaaagacaaaacaatcctaatcaaactctgccgtttccgaattgtatcagtattttcatgccaataaatatataaccaagccaaaaatacataaccacgtttgctgtagaggctagaaattcccacattaatcggagaaaaaaaaagaagagtccaaatagaaataaaatcaaaaatagctgaaattcggaattaaaaatatgcaatattgaaagaggagtccatataagaacccaatacgtgattaattaaaattaggaataaaaaataaatttagaaattataaaaagaaaaaaggggagtttgagtaggaatacaatttaaaaataactgaaattcggaattaaaaataagaaatattaaaataagagtatatataagaatccaatacaagattaattaaaattcggaataaaaaattaaaaaaaatcaaaattagaaaaaaacaaaagaagagttcggaatgcaatttaaaattaacttaaattcgaaattaaatataagcagcgctgcaaataagagtacataaaacaacctaatagtagattaattaaaattcgagataaaaaataaaataaaatccgaaattaggcgaattaaaaagagagttaaagtaggaatacaatttggaagcaactaaaattgaaaataaaaaataaaaatatcaaaagaacacaatacgaaaaataaaataaattctgaaattaaaaaaagaaaaatactaggaataccatttataaataactaaaattggtgataaaaaatcaagactattgaaagaaaataccatctaaaacacatgacgagattaattaagtaacacgcctataaaggagtagagtggtggtggttgatacgacatgcaataactgttaataaaacaccaaatagaatcctaataacgattgaaatgaaggacgacgggtaggccgtgaagcaatcgatcaaggcggttgccgggacttctagaaagtaaaaaaaaaaaccaatgctaatcatattcgatttttaaaatctcaatgataataaaaaggagaagcagcgggcgggatatataggagagccaccgacggttggcgggacttctagaaaataaaaaataaattctaacgatagttatgttcgatttttagaatcccaatgacaatagagagtaggcggcagatgggccatagaggagtatagtgacatcgtttaacgggacttctaaaaattataaaaaatgaaaccaacaagactataaactctaaaaactacgaggtctaatttttaaaggtttggaacttctaaaagtaaaaaaaacataatgataatcatattcgattttaaaatctcaa

SEQ ID NO: 7552 - DNA, 1501 bp, Oryza sativa
tatgatgcctgcgctgtagacgccgatcttctcccaggccggctgtgccatgtcaaagtgcggccgtggtgggttgcaccagccaccattatcactgggaaggttccagttgggcgggcagaaattggtggcggtgatggtaacggtgacgccgggcttgcaccactgcggcgccctcttgcggtcgcaggcgatcttgtagcactgcccgcacgacgcgccgtcgttgaacagcgccgtgctcagcgccgcgttccgcgtgccgtacccctgcgagtacaggttgccgtatccgcacgccccgcccatggtgcccgacgcgtccgcgccgccgtagaacgtcgcgtgcgccttctgccactgggtcggcgcagccaccgggtttgtgggcgtcgtcgtcgctgtgttggccgcggccgtcgatgcactggcgactgcgagcagcaccaacacgaacgctcgagctggggccatgtctgtcgtcatgatcggataactctgtaactaggcccttgagacttgatgaccgagttaattatctggagctatctatctctgaaagcaacactgctctgttgctttgtgttgatcttctatgtgatgtctgtttgcttggtgatctcctgatgattggatgggtatatatagccatcgctcggtcattgttggattgctgcattagtggctaatgaaatcccaataatgaagtagtgtgaactctggaaagccacgggacgaagctagcgcgcggcgacgcgcatgtgcatgcatcgccggccggcgcagccgcagtactactataacttgctcgccaattaatccgaaaaattttcggtttttccctgattggcgcagaatgacgcaaaacacaagcgcggcgacgtccaggctcccgcaatcgcaagcaagcgcatgaaggcaacgttcaacggcggcgccatgaagaatggggtggcgtgtgttgtgtgtggccggcgatcgagtgaggcatctctgaagtctgaactgaagcatctcgagtgttttggactcgtttcttttcctggtgacgttatgaggtgtttttttttccggggagacgttttgatgaggtgttgatcagaattcatcaccttgttagaatgtcaacaagaacaattgacggaagaaacaaataatcgttttaaaagttgacaaaatcatcgagggaaaaaacgttttcaattagacaaaacaattgacgaaattccgttgtcaagtaaacaaaacaatccacggaaaagacaatctatctatgatatactgaaaatctattaaaattcctacaaacacactaaaaccgtcacgtgtattcctagtttcgtacaaatacttctaaactgtcacatgacactttaacaaaccagtggacctgatatttttatctattagaatttttttttaaaaaaaaccaaaacaagtagtcacgtatttgatggggcccacccttccaccgggcgtactcacgtacgtgcttcctccc

SEQ ID NO: 7553 - DNA, 1501 bp, Oryza sativa
accctgaaggagagcatctgcccggtgagatacgacagcgagtgccagtttgcaccccagttcctcaccattggcatccagtcggttgagttggagcccatgatgtccatcgacttgatcgaaccagtggttgcaacatttgtcacgagcacaagattaaagtagtcatgcccattgatggtaaaccgcaccccacccttcttcacacacggaaccctgaaaatatcaccaaatatgttacaacttaaaatatgccataggtgctatatgtcaaaaacaatatgtttttttttctcagtttaaattatatacctttggtacatgaccgggatgatgccagcacggtagatgccaatcttctcccaagcaggctgcgccatgtcaaagtgcggccgcggcgggttgcaccagccgccgttgtcgctggggaggttccagttgggcgggcagaagttggtggcggtgacggtgacggtgaccctcgggcttgcaccactggggcgccctcttgcggtcgcaggcgatcttgtagcactgcccgcacgacgcgccgtcgttgaacagcgccgtgctcagcgccgcgttccgcgtcccgtacccctgcgagtacaggtcgacgtagccgcacgccccgcccatggtgcccgacgcgtccgccccgccgtagaacgtcgcgtgcgccttcagccacacgggcggagtttcatcggtagacggagacggagccatcggtgtcggtggcgacggcgcatcctgggccgcggccatcaacgcgctgccgactgcaactgcgagcaacaccaaggcgagtgctcgagctggagccatatccgccatggacgttatcaataggcgctgaaagattgtagctctgaaagctgcagctgcaagatggttgtgtgatttagctatatatgtcacttttggttctaatgattaactaatcaactgatctgagatgattgtgagatgattaggtccctagatatatatagcctttttttttcggattaattcaacaaggactaccgatgacaccttgagttaattaacgacgcttgtggcgtgcagccgtgcatatgcatgtgcgtgcccgtgcagccgcagcgtggcttgcggtttaatccaacgatttgtgtaagcgcagacacgtattatggcccaaactatatattattctcttatctgtgtactttttcgtcgatctttgcttgaacttttgcttgattatattcgattagaggactatctcttaatttgcttgacttcagattgtgaaatggacggcttaattatttgcagagattattcatgttccggtacttccttgtttaagaaagggatggcgtctgttcctttaatagtacgggtgattctgcatctggccagcaattgtaatcgtgtccaaccgcgtgcaatggataattcgccggaaaagtattttttattgtcgggatgacaaaagaaaggccatccgaacaatattaggatcgaagaaaaa

SEQ ID NO: 7554 - DNA, 1025 bp, Oryza sativa
aagtttgaccttaacgatttatcaaaacacccaagtatatatgattactaggtgaaaccccgcaaaaaaaataacgtgtaagatagctagataacatcagattaagtaaattaatgtggtttataataatttaaatttaaatagtgtgtagaatgatgattcaaacgaaaaactaaggcggcgtgattttatggaagaagaaaagtaaggagatagtttggaccgtagattaatcatctaaaggcaaaaacaattgatgtgatatgatttaattagaggaaaaaaaggagaaagataatttggaccatagattaatcatttaagcactaactaagtgaggatgaactatataagtatataggatatcataaaacataataaagatatacgttgaaacattatgtgaattatattggatgataatttaacatgtttgtatttgaaaagctcttaaattataaaaactataaagatatagcatgtttgcatgatgtttaaatgtgatgattgttagtggatgatgatgtggcatcttgttaattagtggatgatgatttgacatcttgttagtggatgatgatgtgtcatctttgcatgttaagcttaaggagttagaggaaaaaaaggagattaatcatttaagcactaagtgagaatgaactatataaatatgtaggatattataaaacatagtaaatatatacattgaaacattatgtgaattatgtgggatgataatttaacatgcttgtattttaaaagctcttaaattataaatactatagaattatagataatataacatgtttgcatgatgtttaaatgtgatgattgttagtggatgatgatgtgacatcttgttaattagtggattagtagataatgatgtggcatcttgttagtggatgatgatgtggcatctttgtatgttaagcttaaggagttagtaggagataactttatagtactttatatttatagtaagataggataagtggacaattattacaaaggtatatttgtgc

SEQ ID NO: 7555 - DNA, 1501 bp, Oryza sativa
tttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagtaaagagtagttccgtccaaaaaatacagggactagtgaagttttttttttacaagaagtacgagagtggtaaaattaaaaggggatatttattcttttacctgataaatgacctatgtttaatattgttgagagaataataagaaagtaggtagagaaattgaggtaagaaaatatacggagaagttctatatttacaccatattagtagcggtgttatggtatactcacctacccgataagagggagaccaccatctatcttatggaccatcactgttaacctaaattctactgcagtgagaatctatttgctttatgtgtattttttagtgtttatcctactatcatcattaatcagagggtgacaatttagttttcatcagtttacctaatataattagaatccgctatgatgtataggtattttgttagttgtatgataaattttgaatgcaaccaggagtactccctccatcacattttaaatatagctgtaagtttctagattcaatatttaatcgttcatcttatttaaaacttttttatggttgtatttttattataaataatattttatacatgacttatatttttattttttttcgaaagaaaatcaaataaaacgaatggtgaaacgttgaatacgaaaacccatgttgacagcagcggatccacctcccgggcaagtcgggcagccgcgcgggctccgctattaccgtcaccactattgatagctattgacacccataaaaattaatcgatcaccgaaaaatactatgggcttaatgatgatgctggctccaccactgtacgttgaatacgaaacccacaactactcttgaaatgagacggagggaggtttttttttttttgggaacagtactcctttccaagctgccgactgccgttgccgattttgagggctgggccggatatggctgactgactgacaatgttacgtgacgtcccaaagc

SEQ ID NO: 7556 - DNA, 1501 bp, Oryza sativa
tttgttgaccttcctagaaggaaaatcgggtgggttttgagatggctggagtattcgcctccatggctatcgaatgggcgatcgacaagctctattccttgctgccagcatgtctggtatcaacacctgcatcgtcatcgtcttccgcagcgccagctgaaagcgaggaccttgaggttctgaagaggcttgagagaacaatgcacaggatccatgcgacactgcacgatgcagaggaacagtggaacatcagggaggaaacagccaagctgcggctcaaggaactgaagaaggtggcctacgacgcggaggacgtggtggatgagtacgggtacgagatgacacgccataaagtggaggcatttgagcaatctgcaagggctaatcgcagcggcaagcgcaggcgcgaagaggtaaaattttcatcactgcataatctatgccaacaaaaattctatcagatatttatatatgatgtttggaccatgtttatgcatgatatgtttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgcgcgcgctcgctcgcctcgcctggcagggcgtgcggcgcgcgtgcacgacgtacgacgtcgaatagtccgaaaaattggctcctcacccttgcgcagatgcagccttcttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactttgtactgcgccgtcgctcgtagactactccatcccgctcgccggcgtgcaccagcgatcgggagagcaggtctccggaacctcagcctttgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcgaaatgtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 7557 - DNA, 880 bp, Oryza sativa
gccatcgccgccggtatagggagggaggggaggggaggggaggggaggggaaagtgttgagggggagagagagttaagtgagggaaatgagtggtggggagggggtggaggagaagataagacttaaaattttttggggtaggtatgattttcgcaggcgcggtttgggtggtctgcctgcgaaaatcattttcgcaggcgtcgcttaagtggtccgcctgcgaaaatctattttcgcagacggacaacgcacttcaccccgatttatatttttataggcggtcatttggcttcaagggatatatccgcctgtgaaaatcagaccccacgtcgggaaaaatgcattttctaatagtgaatggtcaaacgtatctcaaaaagtgaatgatgttacatattaaaaaacgtatcaagtagttttcatacttgtcgtgtcatatatacattatgtatagaaactatgaacccaatggatggtgctttcaaattaaattctcatccaatcacctatttcctctctccttttatccacatatcctcttatatacttctcttattactccgacttgtctccaatgttctatgcttcagattggtgtacggagttgttcggcacgtaaaatggaacgacatattttcttatgattaattaagtatttactattttaatggattaatatgatttttttaaaaacaactttatatagaaaatttgtgtaaaaatactgtttagctacttgaaaaatgtgcgtgcgaaaaatgagagaggtgggttggaactcactagagatacagagttatacgccacaccgccaatagcccaacagtagctaggttttaaggccccctgtttttctcctcggtctgttttacttttagg

SEQ ID NO: 7558 - DNA, 1075 bp, Oryza sativa
ttaactgcatatatcggtaaatatcagtgctgttgaaaaagtttctgcaagcaaataatatatttgcaaacacatatagatgtacaaatcgtggctcaaggttagcctatttgggtcaatattatttctgcttgttgctgcacctggtgtcataatgtaacagggggttgagctcagaaacagacacaggtttaatcctaagatgcccacaacagcttattaacttgcgcatgtttctctactgaatacatgaaccgcaatggaaatcaggatatacacccatcagctaatagcctcgcccataaaaaggcgatggaggcatttcactttcaattagattaggtaaaaatgtagtaaacaacagtatacctagtgcaagaacaaccaagactaacccatgcaagctgagagttggaacctaaaatgatcatacatttatgaacgaactgtcatcaccaataatattttccctacgagcatcacaatatgcaacctggtgaacagagaggggtgtagtaactaagaaggttggcatgctcctatacaattttgttcatacaaaacatgttcgcctctcttcctttcactttgatgtagatagtggagagcacaatgcttcacaaaagatggggctcacgttccataattttggctcacatagcacttgtgctagaaccacaaaaaagagtaattaacaagggatctccatgtaccatgcactataaataagaagttaaagatgttcacagggcagtgaagataaatgtccagctaacgaagcactctacgcatcacaaaattcagttcagttgtaaagaaagaaaaaaatccacatggaatcaggggcggatccaacttgggacatgggggttcagtcaaacttttgggtgaacaaacaaaaaaacaaacaaactgttactagctagttgtattaagagaggtttaaggctctcaaattaacaaggaggaggagaagagcttcttccagatctagaagagaagctagtagggttaacgaacgcaagcgaattcaaggtcccagtggggtgggggagagagatgaatcagaaagagg

SEQ ID NO: 7559 - DNA, 1501 bp, Oryza sativa
tctttgcaaaaaatgtgctggtgaccaaactaataggagaatggttagggagtctaagattcaggaggtctcttgtggataggaaacatttggaatgggttaaacttaatcaactttgtcagtcaattgaactgactggggaggaggataaagtggtttggaaactgactaaaaatggcattttcactgttaaatatttctataaagcaatgatgattcaaaacactggctttcaattcaagaatatttgaaatttaaaatttctcctagagagaaggttttcctgtggctgatgttgaaaaattgcattttaaccaaagataacttgctgaaaaggggatgaaaagggaaggaggcaaaaaaatgaaactgtggagcatctttttaaaatgcccaatttcaagactcatttaaaacatagtgagttgtgtgtttgatttgaaaccaatccataatatacatcacttgtttgggaggtggctttaggattttcaaaaaaaaaaaaaagataaaaactttgtggtggtgggaattgcaggcagctattgtttggactatatggaagttcagaaatgctgcatgtttcaaaaaataaaagaacacaagatcctttagagctgatatatgctgtttgctcctggatcaatctttggtccattttgcagaaatcgggggacacacaagacaggcttcaacgggacgcggctttgttaaagacggtggtcactgacttctacaacacaagatttggatagaatccatatgtgatgcggatacaggggataggatgaagatttatgccttctagtggctgcagtttctgttttttttttctctgctgaatcttgttcccttttgctgtaagactgttaaagactttgtattcttatttcgttaatgaaatgggagaggtctatcctctctttctaaaaaaaagcccaaccgtggtcaaccaccgctgcgattcaaaaatttcaactcaaattttaaaattcaaaactttcaactcagaattcaaaaactttgaaatcaaattcaaaaattttcaagtcaaaatttgaaaccttcatatgaaaatccaaaacttttaacccaataattattcattttttattaaaaggctaaatgataagattagagaagggattagacgacctaagcatatacaggagtatcgctaagcgctaggattagtgcgcgcagctagcttaccgttgtggcgcgtgcgcgcgcactggcagcccccgaggtttatcctttttttaaaaaaaagacaaaaaaagagggaaaaacaaccgtggtcaaccaaccaccgccgctattccctggcgcaccgggaatctcgccggcgatggccggtagtttgttacggcgcctcactggctatttatagactacagtgcggcggcagtggcactgatcccattctgcgtcgagctgcctagctatcgatcttcgtacgtaaatacgtctccctcgtctccggcgagccaccggccgt

SEQ ID NO: 7560 - DNA, 1501 bp, Oryza sativa
ttattgaagtacttttttaaaactaatttacacatacggttttcatatttttaagataaatattttagaaattattaactaatttaattaataattactctctctgtcctcaattataaggcctatattttttttacacggtttttaataacatactttaactagtatcttttccatttcatgatccaaacaaatataaaattagcatcacataaaagtactttaaaatataaatctattttgaaatataaatctattttgaatttactgatataacatgcataaaatttactgatataacatgcataatatttagtatagatatagttagtataattattaataaaactactaagtttgatttttcttaaaaatagagtgtcctataatttaggaccgagcgagtagttgtcaattagtctatcatatgttgttaattaggatctaataaatcttaatttgtactaattttggagtattgaatttcgcagtgttcaccatgttcgttgccatcgcggtccctttctttggtggactgctaggcttctttggtggctttgcgtttgctccaacgacctacttcgtaataatctctaccattaatttctttattattagaaccttcattaaaaatgtatataatttaaaatctctcgtgcgtattaatctccgttttttctaactgaaatatgaacaattgttttttcagttgccatgcattatgtggctgtcgatcatgaagccaaagaggtttggcttgtcctggtgcatcaactgggtaagtagtattatccattaattatttagcatgtgcatggtcaattaactaacttgataattatcctcatctgattgttaattatatatcttgttaattttaattctttatatatttttggtgcctcagttctgcatcatcatcggcgttcttctgtcggtgttcgcaccaatcggaggtctccgctcgatcatcgtgaatgcccagagttacaagttcttctcttgagtgattaattgagagaaaaggtgttttaccgttcaattaagtgtgttcttaattaattaggggattgttttagataatgcacagagttctatttaattaattagatgaaagagaaattcgtgtgtccctatgagacatctgtgtggattgatatagtagtcgatcaaatgaaggcatattatttatttggcctttgtttgtcgatctagtactctagcgttaatttaattcgtgtcgagtttatcccaatttttgatgatgtttgtgctctattatcacgtggtgtggcattcgttttaagggtttatgattggttcaaacttcgtcctagtttttacacgatttgaacttgaaatcaattactttcaattcgactcttgcgcgagtctcactaaaaaaagttatcgagtaagaatatcgagtaagaaaaaaaaggatgttgctgtaccacgggaaagcatggcagatggcgagaaccaggtacatgaacaatta

SEQ ID NO: 7561 - DNA, 1501 bp, Oryza sativa
ttagttgtgggaatggaatcctctcaatctcctcttcatttcccccaagaaatccccaaaagtttatatggaaattctttccaatttcgcggatcaaatccttcctttttccggcgaaccctacctaatccgtcgccgattccatccgttcccgagccgatctctccctcttccggctataaatagcatcccctcggcctcctcttccgtttgcctcaagtcccaagccgagccgtcgcttgtagcgccgccgccgccttgccctagccgccgccgacgccggtgaccctccagccgcgtcgcgccgccttctcggtcgaccccgacatgcgccgtagcctccttgggtttcgcaagggtgagagctaccccggccacccgttcccttgcgccgaatctcgccggaatcgctctccccgcgctcgccttctctctccacctccggccgccgctccagcagccccgcgccgtcgctgtggtcgtcgccttcggtcgccgctgccgccgttgagtttgcgaggagaagaagaccggcctccacttccccatcgtcgaagaccccgggaagcccgtcgtcaccgtgaagccgatctgttccatcttcagccgcgccgttcgtcgccgtccatcgccgccttcactcaccgtcaccaccctcgggatcgcaggaccgaggtgaagaccgtccgcccttcggttgctgcctctcgtcgccggaaagccgtcgccatcgtcaacccaaggtcgccgcctcgtcgcctgccatctccctcgccgtctgtggtcgcgtaagtggtggtaagggtcgccttgatctcctctctctcccggtgcccttcgtttgcatctttgtaccgtggttcgctggtaactgccgttcccgtgcttgcggtcgtcgatcctgcatggcagccatgtcatcgctggcatcagcgccatcttgaccatccaaaattaatataaatttgtcatctcttttcaatgacatattattcctttttaatatatgtcatctactaaatatgatctaatctttttccggaggatgttttaatcttctgtctcagctataaatcatttgtaaattgtttaatcaatttggaatagtcttttctttaataggtttaattggaattaaatcttgtaaaattcatatctaattcatacgaactcggaatgaggtcgttcaagtctcataattcatctaaattcaaactctacccttatgaactttaattgtactgttcatttggtttttattagtgtttttccttgttttgcgttttaggtttagacttcccgttgtttcggaggatcgttcgttcgttggagaagttcctgaagacgaattgaagacgcttgtttgtaaggcaagtcacacagatcccccaaacaaccctttgagcatgttgaacctgtttaaagctattgatttatttcaacttatgcattgttttcgaatgtcattgggtggtgagcctttcccatttaattatggcca

SEQ ID NO: 7562 - DNA, 1501 bp, Oryza sativa
tgtgacagtacccctcgcacaacacaatccaccacagtgcaccgttcttggatcataatcacccccttataaacaaggtatggactccccagcgacccccgtgggcttatctccgccacttctcagtctagtgctccgcaatgaaccatgctatataaaaggtaaagccgttgcccccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgacctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgaccacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactc

SEQ ID NO: 7563 - DNA, 1501 bp, Oryza sativa
gctactactactagcttcatgtactcatcacaagtcacaagtcacaagtcacaataggagtatagtacacatcaaatcacatcctgtagagattctcccttccctcttgtctccgtttctctcacacacgcatactcctagtatttgtctctccatcagaataggagtacaattaaacatttgcagtagtaggccagcttggtactaataaccggttacatttgcagtataggccgtgtttatactccctcacgcacatttcgccactttgaaattgcggatgataaacaatgtactccctccgtccgagtgtataagaagttttagagttggacaatgttattaaggccctgtttagtttcaggggtgaaaagttttgacgtgttacatcggatatatggacatacatttgaaatattaaacatagtctattaacaaaacatattacagattccacctctaaaccgcgagataaatttattaagcctaattaatccgtcattagcaaatatttactgtagcacaacattgtcaaatcatggcgcaattaggcttaaaagatttgtctcgcaatttacacataatctatgcaattagtttttttcgtctatatttaatactccgtacatgtgtccaaacattcgatgtgacatggtgaaaagtttttgtgtgggaactaaacagggcctaagaaagtatatagaaatgaacggtggaggtttgtgattggatgagtagtggaggtactaggtggaaaaattgaatattggagggttgttattggttgagaggagaatgttggtggagaagttgttatattttgggataaatcttaaagtctagaagttgttatattttgggacggagggagtatgttgaggtagaagaaagtcactcaatatgtttttgttggcctaagaagaagtgaaggtaggtggaaaaattaaatggtggagggttgttattagttgagaggagaatgttggtggagaagttgttatattttgagacaaatcctaaagtctagaagttgttatattttaggacggatggagtatattgaggtagaagaaagtcactcaatatgcttttgctggcctaatatttactccctcactcctaaagtataaacacttctaaaatttaaccacaaggagagatgtggaattaaaatgaagggctgttgaaatttgttgagataagaaaatatagataaagaaattattaaaatgaagggatgttgaaatttgttgagataagaaaatatagataaagaaattaaatgagagaatgttatgattagttgagacaatgaaaggggtaagcagcattattttggaaaagaacttcaatgctatatatatatatatatatatatatatatatatatatatatatatatatatatatatatatatatataaaagacgaacagggttccctgttaactatagaagtagagaaaagtagaaagagatatgtagctaaattgtggtgattc

SEQ ID NO: 7564 - DNA, 1501 bp, Oryza sativa
tcgccgaacacctggttcaccagccatggcgcgagcttagacgcataccgagtagtacaaaaagtagacgagcacgcgaacgccaaccttgtggaaggcgccggcggggcggcggagcaggccgccggcgcgggacgaccacccgcggcggcggacgcggcggagcaggaagccgagcgcgtcatcagcggagtacatcggccgcccacacgggccgcgcgcgaacagcatggcggcgaggacgcccccggcgccggagccagcggcgacatcgaagaaatccgcgagccgcgcggccttgctgccggcgcgccgctgcaccgcggcctcgagccgcaccaacgccgccgcggcgaggagcccgtcctccgggcgcgcgccgccgtcgacggagagcacgcacaccctgttccctctcgacaccggcggcgcgcactgcaagctcttcgtctcgccgccgccgccgccgccatagccgaagaggaacttgctctcgaggatggagaagatctcgtaggtgagcctgtccgccgcgtcatcctggccggcctccatggcgccgctagctcccgcgttgccgtgagttagcgcgcgagaggtagaagaagaagaagaaaaaggcgggagagatgggaggcggaggcgcgcgaaggtaggtggcgcgcgaaggtggcatgtgtccgtacatgtaccgatgtacggacaaatatacggagatcgcgtctacgtatacttttttttcgcaaggggtctcgtctacgtatactcactgtatgaaaccgtacatttgtacgtaggagtacggtttgggtcaatttggtagtagagcaattaagcgtgtaaccgtgcgtgattaatgctattgatgacgcgcacgttaattatgagatgtcgtgctggattattcgtggccgtgactgacattattaatttgtggcgcattttttttaaagacgtacggctgagatttataccttctcttgttgggtgcgcatccaatggccaggatgccttcttctgcctctagcgacatttgatccacctaaaaattcatggaaactcccgggcttttctaccatctgatttcctaacacgagtttgaactgcactcctaacctttctacatatccacgtggcatattctttgaggttctcgacatgaagatcgaggtatatacctttccactattttctgttaactttgttatttagttgttccgagaagttttagagttggacacatgtattaaaagaaatgatgaaactaaataaggtattgtgattgttctataagaggaggtagacaggaaatttgaatagcgaaaatttctgatatattgtgaagagaatatagttaaatttgagtagttatattttagaacagagggagctagatagtattattaagattggcaacgatgatatttctctatttgtaaagtggtgtagagaggtatatatatacatcgtaatgtcagtgatgtggtatacacttataatg

SEQ ID NO: 7565 - DNA, 1501 bp, Oryza sativa
cccattttttctttatgtacgttttctgaacatggggttttattttagttctaaagggaacttggggtttatttcctgatcacattgttacttttatgtagaaactttatgtaactcgccttacctaacaaagatcatatataaaagatctttatcctcctaattattcactccatttacccgtctggagggtggagcagaccctagcagtgtgctctatttattcccattcttctcctagccaatattaacaatgtcttcttttaaccattcatgtacaattaacatcattctttttaatggatcaagtgttttcatcggaatgagttgcatcgggatgaagctctctgcacagcagacatattctgcagaccaagattatggacctaaatcctaaggagtggtttaaataacagtgagctgaaacagtagtgaagatcgatgcagaagttgagaagcatgtgacaaagaagatgccaaagcttaattagttggggtattgtgatgatctatcttatgcggttcctagtagaaatggactgcataaggattatctgtttcctgtttcttgagcacaaggggatcaatcgaccctccataattcttctcgtgtgtgaaaaactaaaggattgcagtcctcccataaatctgagttcatttcttgaggttcccaacgtcaactccttaatttcctagctaggcatacgcttcctggactactaagcgattcattttttataaaaaagaaatatatgaaagttattgtaaaaatttatattaatctactttttaagtttttttactaatacttgattaatcatgtgctaataaataatattgttttcaatgcatggaagaatattttcaatctctcctcccaaacatagcaagtactactctagtccgaaaaattaaggggcggagtcaagacccagccaccacgggcgagtgccagagctccgcccactgcattattacgtaccctgtttgattaacaaggaaattagtaaagttgtggagattatggataccccatatctatatgacggttgtaatttagtcggatatacggtaccaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgtgtgcctcttggggggcgattctttttccaatttatacaatcaataacacactaggcggaatcatccccagacaggagtagggtattacttcttgaataagaaggcctgaacctgtataaaattccttgtctccaaacccatccactttcctagcttgatagccacccccttttattattgccgaaatcttgcttcgacagttggcgcgccaggtaggggtagcgtcaagttctcgccgactaagtgcga

SEQ ID NO: 7566 - DNA, 1501 bp, Oryza sativa
cttctaaggttagggtttcgtattttttggatttaatttttttcggttttttaattttgcgtgcagggtgcgccacccgcacgccaaaatagtgattttcgctgaccttttgctgcatgcgggttgccatgccgcacgcaaaaacctctttcggaccgcacggtaaatggtttttagtactgcacggcacgaactatttcatttaaaaattttaaacatttttcctttttttagaaaattagaaaaaaaaaactttcaaatttcagctcccgggtaaattaatttgtgcgtgccaacatagcatggtaattgtaacattgattggtagactgagtgatctagctcaataatacatataaatatatattttctaacaaatgcacgatgtaaaataactatcattattctcgacaaaggttattacttgactaggcaaaatgattttgatataaatttcttgctctgagaattcgccttcctgtaagggctattagctagcgatatggttttgcagtaccatgtgcaaataactcagtgcgggaaacaacaatacttctgatccctccattttactagattagttgtcgttctagctttatcataaatcaaacatttctatattacgccgtcaaattttaaaattttatgtagtttaacattccgtcaattagatattatgaaattatttctgaaattaaactacataaatttctaaaaattgaagatcggagatacaaagatctgacatagaacaaatctagaacattgagtaatttagaacagacggagtatcttaagaaaatgtgtcaacccttctgtacatgcggagtaagggatcctctgattcaaaggattggtatagggttttttaggattcacaatcctacggattttttttcatatgtatgcctttgattcgtaggaaatgaaagaaaacattccttagggttatatcccttacatgaaaataaggaagaggtctgtcgttcgcgccgttttcatgtgtttggcggtaaactgtgtgcccctttgcgcttcttgtgggaaaaaaaacagagggagatggaatgagaacaccaggggtcacatattagtatccaacaaaccaacagtgatagagatataaagtagtgtgagccgactgccggcggcgcaaggcagcaaaaccgccaattagcggtcagtcatgcgccctcccgcctacacggcacagccatgcggcacgcgcggagaggggggagggggggttgcgttgaaggcaacacgtgtcagttttctctagtttcttcgttgttttttctgattattttttagtttttctcgttttttctttttgtttgtttttctaatatgtatacataaatatacaaagtttatatacatgactttttttaaaaaaaattgtacgtataaattttgtatatacgtgtatatatcttgtatacatcaaatgagtatatgcataaaaaaatatatactttacatatatatactttaccta

SEQ ID NO: 7567 - DNA, 1501 bp, Oryza sativa
taagcgtactatatatcagtgttcacgtttcacaccattcgtttatgtccttgctgattggtaaattgtcggcaaattcagaactttcaaactctaggtctaccgatgatagtgtcttcccacctccgcgcttacgtccctattccattaattggttagttctaaatttcttgtatttggttattattgaaagttgtagtaataatatattaatgacggatatataaaaagagactaaattgttcaatatggtcgagttaggtcaataaattgtggtgaggagatcgaaacactacagcgagaagcttttgcaatgcaaaatgtctaagggagggaaagaatatgaggtttcccatccttaaatagcatatatacctcttaaaaggaggtaccacaattaatattataaattattagttataggttggagtaggtttagaaacttatgtctatatatgttgttgaatttttctccatttttaatgaggtgtagaaagttctattagctaggaggtatatatacttcacattataagtgtataccacatcactgacattacgatgtatatatatacctctctacaccactttacaaatagagaaatatcatcgttgccaatcttaataatactatctagctccctctgttctaaaatataactactcaaatttaactatattctcttcacaatatatcagaaattttcgctattcaaatttcctgtctacctcctcttatagaacaatcacaataccttatttagtttcatcatttcttttaatacatgtgtccaactctaaaacttctcggaacaactaaataacaaagttaacagaaaatagtggaaaggtatatacctcgatcttcatgtcgagaacctcaaagaatatgccacgtggatatgtagaaaggttaggagtgcagttcaaactcgtgttaggaaatcagatggtagaaaagcccgggagtttccatgaatttttaggtggatcaaatgtcgctagaggcagaagaaggcatcctggccattggatgcgcacccaacaagagaaggtataaatctcagccgtacgtctttaaaaaaaatgcgccacaaattaataatgtcagtcacggccacgaataatccagcacgacatctcataattaacgtgcgcgtcatcaatagcattaatcacgcacggttacacgcttaattgctctactaccaaattgacccaaaccgtactcctacgtacaaatgtacggtttcatacagtgagtatacgtagacgagaccccttgcgaaaaaaaagtatacgtagacgcgatctccgtatatttgtccgtacatcggtacatgtacggacacatgccaccttcgcgcgccacctaccttcgcgcgcctccgcctcccatctctcccgcctttttcttcttcttcttctacctctcgcgcgctaactcacggcaacgcgggagctagcggcgccatggaggccggccaggatgacgcggcgg

SEQ ID NO: 7568 - DNA, 1501 bp, Oryza sativa
ttgcagatgcttcacttggaggaaaatagatgatgttgtccaactcgtcgaaactgagctgattggttgataactctgctctaaaacgaagacgaagataatgactcctggaattgactcgttggctgattaattgattacttcagcttgtcgaattttgagagtcttgtatttgtgtagcccccgactctttggttagttgggaaacaactgaacatagagtcgagaactgtaacttcttgtcatcgagtagtcattgcttgattgaagatatgcgttgaagatgtccaagtagaaatcctgaatattggagagccacttgttgtagtaaaataacacggcatcgcatgccgagatgatgaggacatcccttccaacgatacaaccacgcctattgcacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactccggaggacaaacggggcaaatgagtacttgttggaaagatctcgtcgtctactttcagctatgtgtggcctcaccatcaactttgacccaggctgctcagaatgacgaaaatagttctttacatcagaaacttgggcttgggccttgtatcattacagcccattaggggtccacaaaacctagggtttgctcccacctcctctcgtggtcattcctccacctatataaactcctagcagccaccattttgcactttgggttttgttttgatataagtttagctgcagctacttccttgtactcgcgtgtgtcggctagaccacccggatacttgtattcagaaccccattttggtttgtttaagtttgatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcacgagatgtcgaggttcacaaagatgtcgtggttggtgcagtagcaaaacttgcgaagtagcagcaatagagtttgccggtgccgaagataataaagatgaagtcactctaccatgatgacaaagttgcattgccgtgatgaagtgaacacgagtcggtggcaacagaagcaaaccggtagtgaagacgtgcagttgtgaagataaaagcaccagtcggcagcggcataaccagtcggcgatggaagacgatgatgtccatcagtagtggtagagaatcatgcagcca

SEQ ID NO: 7569 - DNA, 1501 bp, Oryza sativa
cactagatcacgcgcactttggcctaagcaaaaagtgcctaagtccctaaaagaacgtgacaggccacacctgaaaatatgggctgcagacatattaggcctaggccaaaaaatatgccttcgacaccctttaaagtatgacgcatgtaatatgctcccgagtaataaatcttctgggtgatatagaccaagtgtagctcatatgaatagcttctgatctgagtgattatcccttatgagatactgcaaaatatataataattgaatcccgactggcgcaagtattcggttgataacccttacggggaataataaatagtccagtctttgagcatagaaaatagacccatgatcatgaattcatgttgcatgtatccggaacaagtccaaattgaaggtatgatacttgtgtttgagatagtaagcccctgatcatatagcttgtccttctgtcgtagttacaatggtccattgatagtagctggcgtagttggcatagagacaagacgaccaatatagagataatattgcccaccagaagtggcaaaaatattggtagtagtgaagatagtgataccaatcaaaagtgatgaagttgcatagccgtggaggtgaagaaaccagtcggcaacagtcaggtcagccagcaatgaatatgaaggcgtccagcgataaagttgtgtagccatagcagcaaaataatcagtcggtgacagacgatgcagctggtgaagtagatgaagatgcccattagtggtgacataataagccatccatgaaggcgagtatatcggtcggtggtgacgaaagctagccgacggtgaagatgtagatacgcatcaaaagcgatgacgaaatccaccaattatgaagatgaagaaaatagtcggcgacgacaaacgcaaccgacagtaatgatgataagcagcaatcatagatgatcaagtataatgacgaagttgcccatcaatagcagtagagtgggctatgttgaagaggcttgataggatgttgatgaagataacgatgtcggtgatccagtcgatagtaaccgtgaaagtgaaataataagccggcgaagacatagtcatccattagcaacagagttgatgtcagggccgatgaagcagaggtgctggtgatgatgtcagtgacaataatccatcaaattggtggtatagctgttgcagatgcttcacttggaggaaaatagatgatgttgtccaactcgtcgaaactgagctgattggttgataactctgctctaaaacgaagacgaagataatgactcctggaattgactcgttggctgattaattgattacttcagcttgtcgaattttgagagtcttgtatttgtgtagcccccgactctttggttagttgggaaacaactgaacatagagtcgagaactgtaacttcttgtcatcgagtagtcattgcttgattgaagatatgcgttgaagatgtccaagtagaaatcctgaatattggagagcc

SEQ ID NO: 7570 - DNA, 1501 bp, Oryza sativa
tttgattgcctctttcccttgtcatcatccttcctccctttgccatagtcactcttgcgaagaaagtgcttgaatctcttgacaataaaagtcatttcttcatcttcactttcttcacaacttgactcttcttcttgttttgccttcaaagctacttcttgatttttgatcatggcggcattcttcaccatttgcctcacttcacgagcttcctcttcttgcatctcatgagacacaattcttccaagaatgtcacttggggtgagcctcttgaaatctttcctttcccgtatcattgatacaagagtgggatttcttggaccaaaagcacggagaagtctcttgaccacaaagtgatttgtcatgtcctcactcccaagtcctttaatcttgttaacaaggatcatcatcctatcatacatctcttgtggtgtctccttgtcatccatcacaaatcttccaagccttccttccaataattcaatcttggcctcacgaacggcgggtgatccctcatgagccattgcaaagtatcccatatctcctttgcctcctcaagcccattgtcacaccctgatttttgtttcaggatttataaattatttaataaattattattagaatttatattaaatgttctttaatttacaagtgaagttaaatgtgggaaataaaatttcctaaatataaagcatggatggatttaatttttattaaattctccatgattaagtcaactctctggaattttctcagatgtttcggagctcaattcttaatttttaatcatacaaagagcatttcagtaattacccacatattaaattaatcattaaatggtctaattataattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaaaaatcggagcaaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacatgctccaccccgccgtcgtcgccggccgagc

SEQ ID NO: 7571 - DNA, 1501 bp, Oryza sativa; identical to SEQ ID NO: 5845

SEQ ID NO: 7572 - DNA, 1501 bp, Oryza sativa
gtttgttatacacatatctatgcacaagaaaacttttgatccagggaacaattaaaattacagaacaaactgatcttgtcacattggagaattcatgaaaaagcaaatgaagtagattcctggaagtaaagagagataataacaaagttgaagaaagtagattcccggtctgaaatgatgcaaacagctcataaaagttgctcggatagattttacggtcagagataagggctggattgtttctgcctacgtatatagaagaaaacttttgctatccaactgcatttgtctttgctttgatttcttccttttctcactttgcaggccgaaagctgagcagatatattaacggaagcccagttgtgtgcaaaatgaaaaataacacgagctccatctagcaaacttaatattagtttgtttggatggatatcgcgtggatgggagatggcaatcgaagttttgaatgtgtttggtttgtgaatgaaagtgaatgcgatagacgggcaaaggaatatcacacataaagatgtggatgggtccacaaatttgttgggaggagaccgttcatctttgctaacctagcttcatcgaggggtggatccaacatgggtgcaggggggactcaagtcccccttacacccacaagacccatggatacccccgaagcattcccttcgattttttcaccattaataataaactaaaggtccctaaatggttggagattgaagaaactgtgtaactgagcccccccaaatttttttcctggatccgtcttcatcattagtaacagatcagtgataattgtttttaatttttatttactaattaccatatcaagattagagttgacaagggataatttatctactttgttgataattagttacaattagattaacgataattaatgtgttttattattgcatagggcctgtttagatcaatttgcggcggcaaattattttgcaaaagttttggtggcaaaaaaatttggcatgcaattttacaggttgttgtttagatgcatggtaaagttttgccattaattgttgttgcctctctcatacacggggcccgatgcttttttggccaaatttgctgctatggactcccaaatgacaaatgccaacttacctacttttttgctaccagtgtttagatacatttaacaaaaagtgctctaaaacaataaaacttttgccattttgaaggaactatacatagccttaatgatcttattattctcgttacattcattcaaccacaaacaaaaatagctcatccgtgagcactgagccaaacacccagtatggatagggagaactaatgggtgggtgatcgtccacaaggatcgggcacccccgtccctctcctaacgtgcacgctcctcccccttctcctcttcctactacaccataatttttttaaagaaaaacaagttaaaaaataaaaaaaatctaatactcataaaaatatattcatgtgcatagactttact

SEQ ID NO: 7573 - DNA, 1501 bp, Oryza sativa
ctgtctttttcttccctcctttcctctatcgtctctatctcattttccccgtcctcattttctccgagtcccgacagcgtaggcggcgatcgtccccgcatggatccggcggccggccagcctctcccccttaggatcccgctcccctcccccgttccttccctcaccagatccggtggaggggaggggcgtcagtggcggtgtggccagaggggagcgcggaggccggcgggcccggtgcgcggatccggcggctggccgccctccccccgcgagatccggctcccctctcctccccttccctccccttccttccctccccagatccggcggagtgggggggggggcccgtcggcagtggtgcggctggaggggagcatggatgccggcggcaagcggcacggaggccgccgccgcctctgacgagggcgggagtggcgtccttggccgacgaggacgacgatgacgatgacaaggaggaggaggaggcggccgggagcggcgacgccaccgtcggatttgttttgttttgaaattttattttttttggttttttattttcccgtgcgggcgacttaagcacccgcaagaaaaatcacgattttcgtagacctttcggtatgtgcgggctgcccacccgcacgtgaaaataagattcgaccgcacggaaaaaccattctcctctaggccaacaacagccaaatgccacctagggtgttgcttgcaactcacatttgcccaactctggtttactggggatttaggggtttgtagacatcgacaccttgttgtcatgctcagggcatttcacagggcatttcaccgaatatatcatgctcatcaatgtattcagcttaagttcgatgatcatccttgatgatatattctctacggactaaacaaatgctggaacgaccttagacatattaccacggatttatggatgtcacctttgatgtaaagacccaataccaactacttgatgtacgtctcttggaataggttagggctgtttcccttaaaaaaagaaaaaaaaagcttaggggatttgtttcaagacaattattttttatttttatgaactccaatgtaatataaaataaatatattttataataaataagataaaataaaggtcaacttatttttaagaggaaggaagaataataggagtacgagcacaaatgctgtgcaggttgctcacatgtcaccttccgctgtcatttctacgcccactctctcttatcttgacttcgccgacaccccttgctgctagtacgcctctacctggacccgcacagtagtctgttgtcgtcctcgatcggatcagctaccggctttccgttgatatctccgcgcttgatggccgccgccgccgcggtcgcctccctcctcggcttcgtcctcgctctccctttctgcttggcggcgccgtccatcacaacgcatggcagcgacggcggcggcggcagctacgtgtcggcggtcggggaccccggca

SEQ ID NO: 7574 - DNA, 777 bp, Oryza sativa
aggggcgtggaaccatgggtcccacctgggccaatggcttaatcgggttggtatatcctggtccatgacattggtataattgaatccgcgccttcccattctaaggaaacggaggattgttttgtcccccaaaagtccaaaacctggcctccttggttatttaacggcataaattattaattataattaattcggccaataaaaaggcccattctgaaatggatttaaacccggacggtggcctgggacctcttcaaataaattggggttttgtgggacagaggagtgggcatttaagcagattgtattctcacccttttgcttaagagaatgtgctatagctattaatccatgatgctagacatgtttgtcccagatagattcatggtgatggtttgtccttcatatttcttattgtaacccgggatcatattggaattgtgcacagcagatactgttcatgatattgtttgatcacaaaagtgaaataacatttgtattgccagatttctgtttttgggccatgtagcaaaatcttgtaagcgtctcaagcaattttagtgaatacttctcttgtggttctttctgttttgaaagtgaagaagactagcagcagaggtgtgctattcattatagctggaagaaatttttatttacatgttctgttatggctctgataagttcattagttggtattcattggcaaatcaaaaactagtaaatgcaacttaaaactcactgagatggcaaatgcactcttaatattagttttcataa

SEQ ID NO: 7575 - DNA, 414 bp, Oryza sativa
tgtctatgtatcagcatatatgatatgttaggatcggtaaggatgcatatcacacgattacaaataccaactccacctcgaagataatatagcatagtatagtgtttgccagcttcgtatgttatggccgaattctgatgcataacaaattttccactatatgtaagctcaaaaatgcaaaaataattaccctcgaacctaaaaaaagtgtatacatgcaagggatcatcaatcctacatataaatacatgcaaataatacacgccctgcttggcagccattgttgcggctgtacctaagctactagctgtggccgcggtgtgcatccacagccacagcaatggctgctcagcaggcccatggtctgtaaaatatttcctggcggcgtgcgggcgacaaatccggcggcggaga

SEQ ID NO: 7576 - DNA, 879 bp, Oryza sativa
ttttggtcccatgttaaaattcttccttggatgtcaaaaatctgcaaaacaagccacgtgcatcatccaatttgagtttgatttgggccttagaccttgtaattatgtcatgggataagtccaaggactggacaccctaggacatccctaatcatacttattcaatagccatcaaagtttagagtggtttttctatcgtcatgcagtttcaacgctagtcagtttgtagaattctaacttcaagttcttaatcattcatctacaattgagttacaatcgactttgttcttgcttgtgtttttcgattcgcatatagagattatccttctcggcgaagtcaatcaggttttaaactattgataaccaaaggagatatagaattatgattggagggtttgaaatcatgttgattggaagctggatcttgtatgtcaagtttccgcaaaaatcgataattatcttcacttgatggaagatcgaacactcccttgtcatcaatcgatcaagatttttgtcatcatcgaaactttcgatgttacataaggcagacgctaggatgtaatttatttgttgcttatgttgcaatagatttccttatatatatgtagatcataaaagggaaaaaaacaatttttactctattaagccttgtttgaccgtggtattgcatatgaggatgatgacatggaaaaatttcccattcccccttttcccccttcttttctcttcatcccccaccgttggatgcgccagtggcagcgtcatgcaagtagcagagatagggaggtagcaaaagaacggtgttggccatcagagaaagaggcacccgtagcggggttggcccgacggcagagcagatgctcaagctaaagccgacca

SEQ ID NO: 7577 - DNA, 657 bp, Oryza sativa
gagcgtgttgattactgatctatatgggcgaattcgagctcggtacccgatctaattttgcacttacctcgatggttttattaaccccataatttgtgagaccttgactagtatttcccctttggcttatatactgaatttcttcccccctatgattagaacaacatatgcgatagaagaagagttactgtaatcactcgactttccctcattgtgattatcttggaagattccaagattggtattgatacatgaagaagagatactatttatagggtggaaacagatttggtgatattctttttaatgctttgagggaataaaaacaatgtaggcaaggcatatataaatgcagtattgaatgcacaagatttgatacgttggatggtatcagtatgacagtaatttcattgtttttatgtttgaatgagttttcaattcctcttgataaactctgaaatgtatcaacttttggtgtaccttgcctcctgggacaaggaataatacacgcacgtaaggaacgcccgttgggttagttccggtcgtgacataaggtgaactagtagattgatagagagcttaatacacttcaaatagatgatattttaatataaagggcaaatttagacgatcaagacccaagtagtggaaacacga

SEQ ID NO: 7578 - DNA, 1501 bp, Oryza sativa
cattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttgcaaaaaaacacaccgtttagcagtttgaaaagcgtgcgcgcggaatacgatggagatgggttgggaaccctggattctgaacacagcccaagtctatccaaaaagtttagacaagaaaacacgtaacaagttggtttacaagaatatgaattacgtcaatcctgcactacatgtatagcaaaatggtgatttctcgtaaatctctcgaatggtgatttaagaattcagtgcaaacctaattcttgctgtaaaatcaaatgttcggtaccacaacaacggaacaataaaaagcacttggtgtaccataatttttgtcactcttgttgaaattttgtaatataaaatgcatgaggccacacgaccttaatgttcaacgtgtcatgcattagtgaaataatagctcacaaaacataacgaatatagctagataacggttgcaatccttaccaaactaacgtataaagtgagcgatgtgtcatatcattatttttctagcctgctaaccaacatgtacaccttccgatcccaaaaatgacaacttccagggatgaacctaaacaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaa

SEQ ID NO: 7579 - DNA, 1501 bp, Oryza sativa
agctatcgtgccgtcaaccacatatttgatcatgttggtcaacatgttgacaagtactcttgattggttgaccaaagcatgatgaacggcataatcaacctggtcttgcatacatttgagcgcctcgagatcttcctcctgattgttgcccttggctttgtcgtctttgccagaacttgtttccgcgtcatcgttgttcgacagaactaccttatatttctggaccatggtgtcggaacgagtctgtgcgaatgaatgcaggaatcgttttgcaagtcatctctcatcttttcaaattctgccttctgctccagggtcagcttgtccattgttattgggatgacattttttggatcaacttctctctacttgaggcttgccatgaagaaaattttacgaaagtcggtcccaccgggcatgccaaaaagtgtgttgatgcggaaaacacacgtactggcctgagagatctgcttaactctagcgcaggtccaaaattgctttcgggttccgagcgcgctagttggtttgatcctgcaaccagcaagaaagaaaaaggaacaaagttaaatccatcaacgatagccgatcggctggattgccgataacgtattgttcggagccaagccgatgttacttgcatcagatcagcaagggaatataaggcatagaaattattagatctacccaatcggctgtagacgtcagcagtacgcaatctatccaatgaaagcacatttggatcaagtgattgggatagatcgggcgatatgccgagacagtataaatcacttaatatctaaatgtgcttcaaagtagggattatgtatgctcacagcatagccgattgagcaaacctaacgtgtatcgactattactccgataccactttatactacaatattagcacagatgaaatatacgaaacgtagaccaatctaacaagcaaggtgtcatgtcccaaaacgactctaaaatatatcctttaaattatgcctagaataattaaaatccgtgtgaaagcctccaacaattaaaatgtgcaaagttaaaagtcaaataaggcttaggggatttttgtatttttcctaaaagcctaaaaggtgtaaataaattttagtggaattttcagagcacaaataataattactaagaaataaacaaagttgaaaaagttttataaaaagaaaaaccttaaaagtcccccttccctcccttgggccgggccggcccatctctcctccccccctctctctctctcctctccccgcggcccactcagcctctccccgcgcgcgcgccgctgacgggcgggcccgcccgccaccctcgctgacgggtggggcccacccgtcatccccatcctcccgccgctccgcctgcgccaagcgccgccgccgccgccaaatccgccgcatcccgccgtccccgcgtgcaataaagtgggggaaatcactccccgtgatcccctctccctttccccccatttttccctctctctctt

SEQ ID NO: 7580 - DNA, 1267 bp, Oryza sativa
ttacaaccaacttgctctaaacaatgtgcatatgtataattcatttttatccatagcaaaacacgtgtatttaagtatgtcgtgaactttatgataagccacctttcgagaatgacgtgacaaagggagcaacagtacaagactcccttctagaagaaagaaacgttgttggggccagaagcagggaacaggacaagaagccccacaatcatgcactagtagttgtatggggaagaacaaataatcgctcccagttgtttgcaacatacatatcgaatttgtcttgacgtatattcatccggcgattaaagtaccacctcacgtgaaattcatgtggttctagatcgatgcaaattaacttaatatcctctctctttgttttgttatggagaacggcattattgttaattgtagattaatgtgtgccattctatgagctatatgagctacagtgatcaggagtaggtacaattgtatattataagctagctataaacacatttcgagaagacaaaaaataaagagaaaagcagcggactatagacttatagacagctgcagtatggattccaagatacctgtgtgtatatgataggtggaatcaggtattaattttataatatatatttatagataactattgtataaattagctattaaattaactatagataatttagagtgctatattattaaactacttgctcttagtaaacttaactgttaggccgagtttagttccaaaatttttcttaaaactttcaacttttctatcacaccaaaacttttctacacatgaattttcaacttttttccgtcacattattctagttttaactaaactttcaattttaacgtaaactaaacaaacgctagtattttataatggtgcattcctttcacacgaagtacttggagtgttacagtgttgtcgcatcacgctgactcagcacagtactactatgcatgtggctttgggatccccacattgggcaatcgagcatatgccacgctagaacgtggtccaagtgaccatttctgggtgcggtagcaagtacgagtatacgactactcttttcgatcaacgacaaattaagttaattaatatattgtgatatagagttcctgtacatattactctatatccaacaaacaagcagtaatgaacaggcgaattaacgtgatgatcgctatatgctgcatgcacgtctgtatcatctagtactagtaacctaaacaccacataattatgtggtcaagtggacaa

SEQ ID NO: 7581 - DNA, 1179 bp, Oryza sativa
tacatatatataaggaaatctattgctacataagcaacaaataaattacatcctagcgtttgccttatgtaacatcgaaagtttcgatgatgacaaaaatcttgatcgattgatgacaagggagtgttcgatcttccatcaagtgaagataattatcgatttttgcggaaacttgacatacaagatccagcttccaatcaacatgatttcaaaccctccaatcataattctatatctcctttggttatcaatagtttaaaacctgattgacttcgccgagaaggataatctctatatgcgaatcgaaaaacacaagcaagaacaaagtcgattgtaactcaattgtagatgaatgattaagaacttgaagttagaattctacaaactgactagcgttgaaactgcatgacgatagaaaaaccactctaaactttgatggctattgaataagtatgattagggatgtcctagggtgtccagtccttggacttatcccatgacataattacaaggtctaaggcccaaatcaaactcaaattggatgatgcacgtggcttgttttgcagatttttgacatccaaggaagaattttaacatgggaccaaaactatttgaaagtagactccataaacattttaacaagtacttatggaccctaagagtccgtctagttcagcggcatgtccgtttaaaattgatgctgttaggaggcccgaatccaaataaaaaagtgtagaactttatctctggtattcaatagatgagaaatgacgtggtatcatggaagtagatttggggaaggatattggttagtccctgatcaactttatgatcatccaagcactgtgtatacccgccccctttacttcacccatgcaattatttctgcaaacgagaagatacatgactcatgttacaataatgtttattgaaatatataacaataaatcttacataacaatcatacatgcacttttggttaatgtttactcccaatttcttaatttctagtttggctccctccaccgttatggtaaaaaatcgttatgttttaactatttatctgctagagcatatgtaatatttatgtaaactctgttctttattaccaatcaaaatagacaccttacctactttcatcgaaagaaataaaaaaacaacactaataaataatgaaca

SEQ ID NO: 7582 - DNA, 1501 bp, Oryza sativa
gacacccctactcccgtgtggccgcgcgtcctcgtcgtcttgcttgccctgctttctttggctcacgagccaaacgagcccactcgagctagacaactagccgagcctagcttggttttctagctcgttagggtaatgagccgagactagctagaccgagccgagctggctcgacatccacccctacacgcgtgcctttgcccaaatcttatctcccgggaggctcacttccctccccgagtggctgcgacgacctccacagctcgagacgaggtgccacttcttcttctctctctccatcccccattcctcccctctcttcccgtgtcccgtcgtccacagctccccgaccaaatccctagccctactattcccgcgcccgcccctccctcgcgtggtcacgcccgacagcgccgtgccgccaccgcttcttgccctactgccgcagttcttcaagaggcttttgtcctgatttgctgcagcccggtaggtattatatatttttgtggttggtaaattcggcagcaaaaaagaaaaaaaaataataccgaatgttataaacccgagcatctcatggtgtccatgtatcagcatatatgatatgttaggatcggtaaggatgcatagcacacgattacaaccaccaactccacctcgaagataatatagcgtagtgtttgccagcttcgcacgttatggccgaattcttatgtataacaaatttaccatggtatgtaagctcaaaaatgcaaaactaattatcctcgaacctaaaaaagtgtatacatgcaagagatgatcaatcccacatataaatacatgcaaataatacacgccctgctcgacagccactgctgcagctgtacctaagctactagctgtggccgcggtgtgcatccacaaccgtagcaatggctgctcagcaggcccatgatctctgaaaaagttcctgcaagcagtacatatgtatgtacagttgtacacaccctcgcccctattcatcctcttaaaggagtaaggagtaatgacagtcgatatgtgttggttgattaaaatttagaagagaacgtttttgaatagaattgtgaacttactcgaatatcgttcttttgtgtattgcttttgttatgcttcacctgactctatctctgtgaaatggcagctagtatattgaaggttgaagctttgtgggtatccagcaagtatttcaatggcgttgctacagtttggaggtaccttggcccccaaacttggggaaaaacctcagctgttgcccaggtcacctgcacttacaagagttatttatgctgatccaagatttctggtgtcgaaaagtgggtatgtgaatgtgttctgatcagtgagatgtactaggaatactaaaataaaggacacattgatattataaaaaggcaagatttctgagtaaactgaagatgatatatctctttttgtgcagtagtggaggcaggcttaaacaccttgtatcacctactgctag

SEQ ID NO: 7583 - DNA, 1501 bp, Oryza sativa
gcctggataaaccttggcccggcacgcctgggcttcgggcatttgtcagcgaagtggccaagctcgtcacagttgaagcaggaccctggttttgctcccgtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctcacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcactgttggggtgcacaccatcagcgcgttcttcgccgttgctgccctcgcctgttgcgcggctaccagtcctggtgtagaccatctggagggaaaagcagacggggaaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaccggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagc

SEQ ID NO: 7584 - DNA, 1501 bp, Oryza sativa
tcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgtaacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacagg

SEQ ID NO: 7585 - DNA, 899 bp, Oryza sativa
cagtttgaaaagcgtgcgcgtggaatataatggagatgggttgggtaccctggattccgaacacagtccaagtctatccaaaaagtttagacaagaaaacacgtaacaagttagtttacaagaatacgaattacgtcaatcctgcactacaagtagagcaaaatggtgatttcttgtaaatctctcgaatggtgatttaagaattcagtgcaaacctaattcttgctataaaatcaaatgttcggtaccgtatcaacggaacaataaaaagcacttggcataccataattttgtcattcttgttgaaattttgtaacataaaatgcatgaggccacacgaccttaatgttcaacgtgtcatgcattagtgaaataatagcttacaaaacataacaaatatagctagataacggttgcaatccttaccaaactaacgtataaagcgagcgatgagtcatatcattatctttctagcctgctaaccatcacgtacaccttccgatcccaaaatatgacaacttctagggatgaacctggacaatgtttagggtttagggatgaatctggacaaatgattgtccaggttcatccctagaagtgggtttctccttactggacggagggagtatatgtgatggacacaaaagttactttcgtgatgaaatcaaaggggatttgttggggcacctaatagaacatgtgtccgaatgacatgactcacttggatcctaataggacatgaaagcaaaactaacactccaaagcaaccgatgaggaattgaaagaaaatcagtgccattgcatctataaatagacaagcgcaatgaaaaccctccccatcgttcacacagttcaagcattatacaacaaaaaaagaaagatctagtgtcccgtagcaa

SEQ ID NO: 7586 - DNA, 614 bp, Oryza sativa
  unsure (1)..(614): unsure at all n locations
tgtttgtatttggcccaaaaaaaaaaaaataccctgtttttaacccggtctctccgggggccgtgttggcaaattaaattttgggccgcgagagaagcaaacccctttccaccccctcccccccccaagaaaaaaagggaatgtgtcccatttgccctgtatgccaatttcttagtatcacaattcccttggtatgaaggccaaaatgcaaacttattttccttgaccttaaaaggtgtatactgcaagaattgtcaatcccccatattaatccatgcaaattatcccggcctggttgaaaagccattgttgcagctgtacttaagttactagctgtgggccccggtgtgcatccaccacggtagcaatggcttgctcagcaggccaatgtctcttgaaaaggttcttgcaagcagtacatatgtatgtcagttgtacacaccctcgcccctattcatcttcttaagnnagtaaggagtaaatgacagtcgatatgtgttggttatttaaatttagaagagaacgttttttgaatagaattgtgaacttactcgaatatcgttcttttgtgtattgcttttgttatgcttcacctgactctatctctgtgaaat

SEQ ID NO: 7587 - DNA, 1501 bp, Oryza sativa
atgtttcatagtacaatgaatttggacattggacatgaacatcttttatatatgttgtactatgaaacattccattcagtctaagattataatattataggacggagagagtagctcgcagagcaggtggtcacatggcacttcgatcgtgtacctgcattctgcatttgcagccgcccgcgactgcaaaagctggaccctctagtttctcgtgttcctctctcacacaggccacggcaatactacatactgcttttttctttatttaaatttaaataattttatagtatagtatagtaacaattttcatacaaagtaaacattgtatcaaaatatgttcggtgttaaatataataaaactaatttggtgctgtggatgtactattttttttataaatttagttaaatataaagtagtttgacttaaaaaaattcaaacgacttattatatgtgaaatagtcagtagtactagacacaggtagtagaagagtaagctttgctctctttctctctctgtactacggcccaaccaaatgggcctcgttgttggtggcaggagggcaggcccagcggggaccatttttaattctggccccgatggactcctcgatcaggagccgactatcattttcttatactctatcaccttatcagccaaataattcaaattccatgactaaattgaaccggacactatgatttgccggttgataagttgattgatcttgtgtgactccgtttttgtttcagttagccaatatcatttccatcctcccaactcgttgttaatttccatacctttttcgtcgagagatgcatttaacaatgtagtgataagttgtggtaattaacccccaaatcccaccgtgtacgattctcaataggttgtccacattttttttcatatcttttgtcgtctgtcataccacaattttcatagcccaaagttacctctccattttttttgccttctttattgtgtttgttgttcatgtaaaaaagactttttttagtctcttctcctaatatgaaatggcagagctcctgcccgctccctccaagaaacaatttgcaggggcaacgcgccaggaaggtgctaccatacaagctctctgaagcacaaatagcagatgtgtccaggttttccactattccggagtcgtttcttactctgacactacatcgtactctctccgttccaaaatataataacttttagcccttaggatttatcctaaaatataacaacttctccaccaacattctcttaccaaccaatcacaaccctccaccattcacttttcctatctacctccactactcatctaatcacaaccatacaccactcacttctacctacttttttaaaaccgtgtccaactttaaaactttttatgttttaggacgaagtgagtacgtgctgaggatcatcgtttcccagcctgctcttctttgatcctgagcacgcagctgcaagcctgcaatagccagccagcaagc

SEQ ID NO: 7588 - DNA, 893 bp, Oryza sativa
  unsure (1)..(893): unsure at all n locations
aaaccccctttaattttttaaagggggccgggaaacacgagaaggggttggacccttgttttttaaacacaccatttttttcaaatatttaacaaaaaaccgtgaaagtgttgtttaacagatatttaattggtcatccggccaaaatttaaacccaaaaggtatttccgggaatcctcggaaagggtgatttaagattcagggccaacctaatttcgtgttgaaaaacaaattgtgggtgncacaccacggaacaaataaaagcccttgggtgcccaatatttttgcccctcgtgtaaaatttgatattanaaagcaataggccacncgacttaaatgtccacgtgtcatgcattagtgaatataatagctcacaaacatacggaaatatagctagataccggttgcaatccnttcccaactacggtaatagagtgancgatgtgtcatatcataattttttaagccgtgctaccaacattgtacacctttcggatccaanaaatgacactttccaaggaatgaacntaacaaaggtttagggttttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaa

SEQ ID NO: 7589 - DNA, 1501 bp, Oryza sativa
tcgttcacgatcgttcacgttcgcgttctcgttaaggtcacgtttcattcacgtacgttcattcgttcacgttcattcacctgcctatattgcatttcacgttcacgttcattcacgttcacattcgttagttcacgttcatgttcgttgacgttcattcacactccttcgttcacgttcgttcgctcgttctcgttcacattcgttcgctcgttcacgttagttcacgttaattcgttcgatgccgtggcggcagctggacggcggtgtggcgcgcggcccggtggcgacgttgcgcggcggcggcggcgaacgcgcggcacggcgccggcgttgcgcagcggcggcgtggcggcttggcgcggcgcggcgccagtgccgtgccgcggcggcgtcgtggcgtctcgtcgtgtcgtgccgccgcgtcatgtcgtgacgacgttggcgtcggcgtcgaggcggccggcggcaaccgagagggagagagagagagatcgagatcggagagagagagagctgatgagagggaggcggcgtcggctctcaccccagagatgcggcggcggaggaggaggcggaggcggcagcgacgacgacgagcgcgagacgacggcgagatacggcggcggcgttggcgcggggatgccctaggcagtggcggcgaaggagaagccgagagagatcgatcgggcaaaaacttctaagtgttggtggagaagacgagggcgcgcatcgggaatatatatacccctagatctttattcccgattgatgagaacaaccgggagtaaatttactcccggtttttctcaccaatcgggaggaaagttatctttactcccggttgttctcatcaaccgggaataaagatcttttcccgctatttccaaaattttttaaaacccggttagggtcaagaaccggggctactgataagtgcactgagtattattttccattacatatgtgtttctaaaatagaaaataatgcattaaatttatttaaagtacaaaaattaatgacaattactacggaaaattagtactgtctgtaataaattaagtggataaaacgtaataagcaaatattacgttttaaaattaataaaaattctaataatcatatatacttagcatatgaatgatattaaattgttaaaaactctaattaacatatgtatatacatacgacatgatttaaaattaataaaaaatttaataatcatatataattaggatattaaattaattgttaagaactctaattaacatatgtgaatgccacatgcatgatttgaaaattttaaaaattcgaatagtcatatataattagcatatgaatgatattgaactaattgttaaaaactctaattaacatatgtaaatgccacatgcatgatttaaaaattttaaaaattgtaattatcgcatataactagcatatacatgatttaaacttgttaaaacctcaaataatcgtgcgtaattaacatatgccata

SEQ ID NO: 7590 - DNA, 859 bp, Oryza sativa
ctctttctattatgggtatatatacagagagggcttgagaggttggttgatgtatccacatatgagaaagcaataaagctgtgatgcctctccctatatctgtgttcattgtttatctattgtgtgcatgagatcgtcgtcttctactctggatcagcgaacaggccactagttatccaacacgttatcagcacgagttctcgctcgttccgctgatccgggtaagcgtttttaatagatcaatttgtttcgttactaatcagattgatatattgtgtttatgcatgtgtctgccgttggccgagaggatcgcctccgcacgtagccgcgcaccgaggcaaaccgtcgggtgacgcgcgtgcgtgtcgcactccacacacagagcagcagcaccgccggtcgtccgcactgaggccgaccacgccgcaaaacttcctgacacgatatacgtcgatctgcatcaacctgaccggtggcacatgcatataaatgtatgactgatcttgcatgtgtatggatctacaccaggcatgtactacctccgtcccaaaataagtgtagttttacactattcatgttcaacgtttaaccgtccgtcttatttgaaaattttttatgattagtatttttattgctattagatgataaaacatgaatagtactttatgtgtgactaaatgtttttaattttttcacaaatttttcaaataagacggacggtcaaacgttgaacgtgaatagtgcaaaactgtacttattttgggacggaggtagtacgtagtaagtactgatctccatcaaacaaaacctgcacacatgtatatgtgtgcgatccgatctgcatacacgcatatggaga

SEQ ID NO: 7591 - DNA, 1501 bp, Oryza sativa
gatacctagctcggagtgcttgtggaggaaggtgtaccaccactcggtgtcgaggccgcggagctcgggggggaggggaggggcgccgccgccatacttgacgatcttgagcttgccggagtccttggacttgcgcttccctttcttggacttcttcaccggcgccatcctccggcggccgcggccgcggctgctgctgctgctgctgatctcctccactttcttctcccttccctcccctcttcctcctctttttctccccctcttgctagggttcttctttttggttttcttctccatctctcctatatatggaggatttttaatacttgctagtgtaaatccatttttttaagtaatttttttggggcaaatggaatctttgatttcatctcagtaaaaaaggaattcagtctaataactttctgggcactgtcatgtatatagataagaatatatccagatacatacctgaaaattattactcctatatttgtggattgaagtaatagtgttgcatttcaacaaaacaaaaataaaattttctttccatctcgataaaaaatgaaagagatttcttaggttttcgcatttgctagatcggaatccaaaatctaaattttctcaaaaatttcataaaacaaattaaggataaagttcaaatgcatagctagaaattgctagaatgttttatgatggagtaagtaagtacatatcaacaaaaccaaatgaatgtttacttccatctggttaaaaagaatgaaagagttagttttttgtgtttgctatgttggaaccctaaatttctcctacatttcaatataacaaatgaaattttattttcatctcaatagaaaagagagatcctatatgtttttagtttttcatacccgccagacccgaatcctaaacttaaattatctattagatttcaacaaaacaagataaaagaaaagaagtgaaaagaagtccttttgttgattttagtttagtttttcaagcgctgaatcagaatcctaaatctatttttttctagttcatttcaacaaaacaaatatatattacttccatctcagtaagaaagaaagacaccttacatgttcttagttttatgtattcgctgaatcaaaaatcctaaatcttctaatacttttcaacaaaacaaataatatctaactttcatcttgataaaaaagaaaaagatcttacctgttcttagtttcttcacctttgcacacgactagctcttctatcgattttgtatggtgagatctatcatagaccttatcgtttaccttggttttgtttactcgtgtgtggcgccgtccatagcatgtatatataggatgacctatcataaaccctaattatccttgcccccactatcgacaccgttgattaactacctgttatgaaattaacgttcccgatctatctttaaagatatatgtttaaagtaggccggcccaaaacaataagcccggcctatctgtgtaccctg

SEQ ID NO: 7592 - DNA, 1501 bp, Oryza sativa
taaaatttggggtatacaagtcacacagtttgagttacatgtaaaagtttactaatttcattcaagaatgagtttattaattgttttggagtggtcttaattttatcattctgtaaagaaatggaatatgaaacttcatacaccacatgcaaaattaaatttatagtcagggtacacagataggccgggcttattgttttgggccggcctactttaaacatatatctttaaagatagatcgggaacgttaatttcataacaggtagttaatcaacggtgtcgatagtgggggcaaggataattagggtttatgataggtcatcctatatatacatgctatggacggcgccacacacgagtaaacaaaaccaaggtaaacgataaggtctatgatagatctcaccatacaaaatcgatagaagagctagtcgtgtgcaaaggtgaagaaactaagaacaggtaagatctttttcttttttatcaagatgaaagttagatattatttgttttgttgaaaagtattagaagatttaggatttttgattcagcgaatacataaaactaagaacatgtaaggtgtctttctttcttactgagatggaagtaatatatatttgttttgttgaaatgaactagaaaaaaatagatttaggattctgattcagcgcttgaaaaactaaactaaaatcaacaaaaggacttcttttcacttcttttcttttatcttgttttgttgaaatctaatagataatttaagtttaggattcgggtctggcgggtatgaaaaactaaaaacatataggatctctcttttctattgagatgaaaataaaatttcatttgttatattgaaatgtaggagaaatttagggttccaacatagcaaacacaaaaaactaactctttcattctttttaaccagatggaagtaaacattcatttggttttgttgatatgtacttacttactccatcataaaacattctagcaatttctagctatgcatttgaactttatccttaatttgttttatgaaatttttgagaaaatttagattttggattccgatctagcaaatgcgaaaacctaagaaatctctttcattttttatcgagatggaaagaaaattttatttttgttttgttgaaatgcaacactattacttcaatccacaaatataggagtaataattttcaggtatgtatctggatatattcttatctatatacatgacagtgcccagaaagttattagactgaattccttttttactgagatgaaatcaaagattccatttgccccaaaaaaattacttaaaaaaatggatttacactagcaagtattaaaaatcctccatatataggagagatggagaagaaaaccaaaaagaagaaccctagcaagagggggagaaaaagaggaggaagaggggagggaagggagaagaaagtggaggagatcagcagcagcagcagcagccgcggccgcggccgccggagga

SEQ ID NO: 7593 - DNA, 1501 bp, Oryza sativa
gacacgccaccgccgccgccacccacctggccacctcctcgccggcgtggtggggagctcgacggtggggaaaaaaggaggaggaggccgacggtgggaggctatgggggaagatgctgcatgggaagttggtcgccgcaggactgcggggaggctggtggaggcgctcgtccggtggcggggtaggcgagcatggcgacggtctcgtctgggatggggaggcagcggagctccgatggcctcctaaagccagcgagggcggcagctcttcggggtagcagagacggtggggagcccgaagggtggcacgctcgtcaaggggaaagaggcgactggcggtagtggggggagagtggcacaatgagccaatgaggaattgctccgggtggcgttttgcttgatgatgccgatagctttgagtataagtaaaggagagaagctcagagccgactccagtggtggcgcgacggcgtggacgtggttcacgcgtgcgacggcttcttcgaccacatctccgtcccggtcaccggcgccccttcctcagatgacatcgtcagagctgcccttgtgtatttcgccttgcaccgcctcggagtcggagtcccgactgtacgagaaagcagtatagacatgttgcagcccacctcctacggtcgctcgtcgttccccacttcagccgttgtcgactaccgctgtcccctcagcggctgctggccaaggtgaagagagagaccgggggagagagatatataagggggagagagagggagggaggaggaataagggaaggagagggtggttgacatgtggggcccacatgtcggtgggtcccacctttttgtttgaatgacatgttggtcttacaaatctttggatttggttattattgtaatgccacgtaagcgacatgtgggacgaagaccgggtaaacaccgccacgtaggcgccacgtcagcgccacgtcagccaaaaccgttttcaaaaccgttgagggagtcaaattgcactggttttaataattggaggagtcgtcctatccggttttgcggtttagggatacgaattagattcagccgacaatgaagggagtcaaagtggactttttccttgataaaacgcctaggaaacctgtagttgcgtaagctgctgcgttgggccacagtccattaacccaacaacaacatattaacaagcccaagtaaaagcccattcaatctacaccctagatctcaatccccatcactcacagccgtccgatccactccacccgcaactatataacagctccgcctcctccgcgaaccggaaaaccctaaccctcgcagccgcatcgcgccaccgcctcctcctccccctccccctccggcgagagagcccgcgccgttgccgccgccgccgccgccgccatggtaagctccgttcctctcccgcatctcccctttgcagtggtctctttgcgcaggtgctaaggggaggaatcgcgtgtgtgtttgatttttgc

SEQ ID NO: 7594 - DNA, 1501 bp, Oryza sativa
ttgacctttgcaaagcaagtatatatcttaggatgggcatataataaaatatatggaaagtcgctgcttgtacctaaaatttgtgatgaccataaacaaacatgaggcgaggcaattatgattacccaatatattgcttcagcggctgatttggatggaaaatgtcatgggggctgatcttagcggtagcccatagctgctgctacagcaatagcaagcaatctagtactggcaatgatctgcaaccgaaattcagaaaaaaaaatcaaattatagctgcaagcacgcgtcagtaatgtaaaattgttatacatacccgttatcctcatagaatgaatgatctccttatctttccagtggaggaaaaatagtttgagtaattattaaacctatctaagtttggctctttttcttatcttcctgaaattagtgcaaagctggtctgcattgcaactactatgtacagttactttcagtaccataattaagtccacactgaatcaacctcttggccctaaaacttgtttgggtcagcagcaaatgcaatggtcagcaaacaacagacagcaggctggaacacatcaaaatatggttctaacttatataaaccaataattctgcagtggttagtcagcagcacaactcacaacatgcaggcataatgatatgcatggagcaaaatgggcaaacatgtgcgtgcgtgtgtgcgtactgcgtgctactcccacagaggcatttccacaaacacgccacgcgcgttcagaggaaacacacgaaattgagcttgcagttacaggcacatgcaaggtcagaaaagcagtacaatcctgacctcagaggacggcgccggacctaggaaaccgccatcacagcacctgcactggctggctgctgctacagcaatagcaagcaatctagtagtggcaatgatctgcaaccgaaattcagaaaaaaaaaaatatcaaattataactgcaagcacgcgtcagtaatgtaaaattgttatgcataccagttatcctcataaaatgaatgatctccttatatactataaataaatttcaatcgggatggtaaaaacctaaagaagagccaaaacaaaaccattctctctgttttttttttaattaattcttcaataatctgagagataacagaaacatatcaatctagcttgactaaaagaagaagccaatagattggatatttggatgagatatatatgattcaagaagaggaagaagaatacctttgggaggtgaatatacacccatacggtttcaaggtgaaggagcagcataagatatactatttcagaggagggagaggttgagaaagccaatcgaactatgatttccgctgagggagaagccgtgggaagcgatttgaagtaagggaatggggctcgacagccatgaagcctgcggtggcagcggttttgaagtgccggggggaggagaagcgccggggggagggggttggaggagaagcggcgcgggga

SEQ ID NO: 7595 - DNA, 1282 bp, Oryza sativa
ttatgtagaacaatgtctgacttcgcttcagctagtgaatccctcaggttctgggcttgtgcaggcccctgaaaaagcaaaggtaactctgttatgcacaatacaagtgggttttcttgtcctgaacccgagtagcatgagaaatccatgtaaaaaaataaattgcaacccattcaccacattggtcacatcaatttgttcgttattcaagcaatttgttgtgcaattgatcaattagtgattggaaaatgtcacatgtgggacactgatcatctaaatgaaacgggaaaataagtttgaagacaagaaagaaaacgattatttttttaagacaatcattcatactccgtatttgcttgatggccttaaacgcctagggaagcagcgggaacaggttcctcccacccctcactataatatatactgtgacacaatcaattcagcgagataaacaaacccccaaagagagaacaaatccaaaagggagaagggatgcaagcagagcgaacctcctcctcgtggccggcgaggaagaccttctccttgttgaagatagatgtctcgaagtcgagcgacgtcatggcggcgccgcatggcagtgaccgcgcggcggcgagcggcgcgcaggcggcatatgagaccgggaaggagacgctgaccggcgcacgggggtggtccgatcctcatcccccgaccacatggaggccggagacggcggcgacagagggagaggggaaaggtgttttgcgaaaaaacccctcggccttcacattttcaagcgcagtcctagttcgcgttgtttcctctcttcttcccggggaatatccggctttagtaagggcttaaacttaaaataacatctcagaggtaggtactgttcgtgagggatctagatcgaatttcacataaactcaagtcctatttcgttttcaagagattaattaattttctcaactttgcaagggcagtcagttttaaaagccgtggagtactccagtagtatatcttccccttccccttgcgtaaggaaaacgaaaatcttaaaatctcctccccgtctctgactcatcttctagatcagctcttctcctccttaatttcagagccttaacctctctcttaatttcagtttgtttgttcgttcgttcccccaaaaaatttggatccgcctctgcagattggtgccttccttccgctggaggcaacccccccccccctcccttgtacgcttcgtcttcgtctccggcgacgagcggaagcaaaccttctccggcgagcagca

SEQ ID NO: 7596 - DNA, 527 bp, Oryza sativa
attcctgcagccccttcctagttctgaacttcttattgatgcagctttcatggttaatgttatataccatgtactattgactagcatgtgtttttccctgttcccatagttctgaatgatacacctacatgcttaatggtatatatagcatgtacagttatctggcatgtgtgtttcatagtttagaatgatgccaagtaaatctgtcatggcatcacgccaatttcctccttgtgggttcttgagcatatcatggtatatcctgtgatgtgttcactagtttgattgctataataaccgtaccaaatgctttcaggtttgttcagtggatcagctgggttttcagttctgaatgcttcccaattaggttccccttgtatcacaagttgaatatttcagtcatgaagtaccgcgtgaccaaaggagctttgctacagaattgtgctacatgagagcttaagaagctccaagttcacaagaaaagaatggcgctctgcaaatatacaaaggatggaaccagagagaca

SEQ ID NO: 7597 - DNA, 1501 bp, Oryza sativa
cgtagcggggatgcaggggcggagcctccgcgaaacggatcgtcatcccttttagggttccaccatatatatatctcttgtaagccgccgtgcggcgatgtaacctcaccccagatatagtgaagatattttgctggctggcgctcgtggttttttctctcccgttttaggagggttttccacattaaaatcttgtgtcttctatgattgatctattgttttttatcgtttgttcgcctgtcatttcctaacaccgtcgacgacgacgatcggccggcggtcactgttggatcgatcggtgcaaattaaattaaagcagaggctgagcatgtacgcagcctactcaccacaagccatgcaaagcaacctcactcgcgatcatgcttgcacacacctgtaatccaagctactactactgtcgacacaaatgcttggccaattcttcttctgtttctctttttccccatcgttttctgcttcgcttttttgcagcatctagttcatctttctttctttccttttctttcggagcatggatacagagaagcagaacacctaccataatgtattcgattgttatgccgtgatgggggaagagccatgagaattgtggaaaggagatagctaagtaggcaaccactccctttgtttctgtttttttttctaaagtagatgacgatgttgattactggacacatgacgttaaaccagtcgtcttgttgaaagtttttatatcaatacataagatataaattatgattaaagtatttttttaataataaaacgacttacaataaaataaataataattacataattttttaattacatgaatgatcaaatacgtatttaaaagttaacgacatcatgtattaaaaaataaaggtaatacataatactctcttttttttcaaaatataaaagattctaggccacataaaatatcttatattttgtaacggagaaaacaacaagctatagctcgccgccgatgaacgaaccatctgcaacggccggccggtaacggatcgccagcatatgcaagtatggcacacaacgaaattaccaaactgatcaaccgaaagaaaaaaagctaggaaaagcagatatgattatgaatatatgatatgatgatgccaatatcgatctaagctgcaaattgtttcgtttctgatatatgcatgcgtccctgcttacgttgtggcccatattcagagtatccaacgtcgacttcttgttgggtttcatgacgaaattaacccatcaaatatataaaatcttcttctcatcttccaatgtatgtatctctacctcactacctgcaattgttgtctgtacatgccgcccagatacatgccacaaacagcaaccatatctgactttttctaacgatctccggcttttttttttcctttttttgttgaaaatgacatgtccaaaatctctgtacagattgccgaacttattatatattagctgtgaaattcagaaaggaattaac

SEQ ID NO: 7598 - DNA, 1501 bp, Oryza sativa
aattggaaacgtcatattactttataatatgaagagaaacagatggagtagctagtactagtctttctcaagtctcagccttggagaagaagttgatcgtcaatcagagtcctttatccaaaccaaaaccgtgtgatcgagcacctgatctagtggagtggccaaccatgacttactgaagcgtcaactcatctctcaactacagtggcagcagtagctggagtatcaattattcaactcctacacagaacatggccatcatatacatcactatcaccaagcatataaatcgatctttatatctgcatctttggttcctctttgcttttctccttaatcatcttcctccaacatccattcttgaacccttgtccaagaaacaacaatattcagaatttcagctgaaacactaatgctaactatgacacaagtataaatagcagcatagacaggcatgttgttatcatcaaacaccattactcatctctagttcagacactaattattaacatacacacattaattagtgtgttcttcatcatcgccggcgatcgagcgaaggcgacgatgttttgcttgctgcatcggctgttcccgttcctggttggcacggccgtcggcgtgtacgcggcgcagaattacaaggtccccaacctccggggactcgccgaccgcggcgtcgacgccgccaagcaatacgaggaggcctaccgcaagaagccctcctccggcgccggcgccggcggcgggagcaagaagaggatgaacaaggccgtggagatcgacgacgatgaagagtaactaagttactgatagctagagatgcaagcaggtcgacctacgatgaaccgaacccacttataggtcaaataaataacccgtggattttcgggtcgtggctcggcttgtcacatctatagatgcaagtgaattagtggataatccgcatagttttgcttataaacaggttcgtgggttggtccacttgcattcctactgatgctggctcctaccccatccaagctgcaaggagtatatatgctctacaaaaacgagcaactagtgtataagttaaattgtttagcgtatgtatgtacaaactaactgctatattcgtctcaaaatataacaacgtgagactgtccaaattcgtggtactaaaatatatcccatctatttctaggttgctatattttgatgagacgggggattaagttttaatttaccgaataataataaagaacaaatgtattatattattaacaaaataaaggaagaaaaatgctcaaatggcaaagtggcgagcatctgaactagagggccttaacaattgcaatgcaccgatctcgtagttgaatcggcccgagtgactagttgggccgtgaagattttttacaatatttgtgaatttgtaaatgggcctaattggacagtttgcctttcttttactgggccaagccaatatcagaagctcaccaaacagtgctcttatagatggcca

SEQ ID NO: 7599 - DNA, 1501 bp, Oryza sativa
gaggctgcaggggaagagcgatacaaggagagcaagagggcgacgacgacgacgaatcccaaggccaagaagggcagcaccaaggagaaggcagctgctagtgttgctagggaggaggaggatgacgatgatgaataggattaatttgagttgattattaattaagttcagtttgagttcagctattattgtaattagctgcttgattccgttgctgtgccggttaattgtgtttgtttagctctgtactcgttatcctgttgtgtgtattgacaaaataagataatatatatacatctctgttgttaaaaaataagtacctttgtttgacggtttttttattttttacctagagctttgcgttgtgagctagagtcgtcagccatctcgatcttgagaaacttataactaagatatataataattgagattaaaactagctagcggaacaaatttagaccaattcagggtaaactcctgttttgtgatcggaatggaaaatttctagataaatctacaaacgaattacacttttacggtcaggatagactgcttataatgcaaaccgataaagatgaacaaacagtacaaaagatagagataatattgaaaaaaatgacacaattggctaattgtgtgttggattgttgggtgtatgaattggcagccaattgtgatcaaactcatcgaatggtagtagacaggttaaaaaaaccaaactaattaactgagcaataagcccacctcactatatttcaacacaattaattaactgagaaagtctcctagattaacagattaatcactctattgctagcaagaaaggcacaagaaaaatagaagggcacaatttaatcgaccggacaaggacaagccttgctcggtgggtggttggggatattgcaaaaagtatataaaaattcctgaagttcagctgttgtagtctgactcttggagaagaagttgatcatgaatcttttatccaccaaaaccgtgtgatagtggccaccccttgcaacgtcagatcatttcaactattatactactagtagctagtactatcaattattcaacttgattacatagaacatgaccatcaattatttattaatctgttgtatattctgcactatcattcctagatctttacatttccttagctttgctcccttcaattcctttcttgaacccttgtccaagaaacacatattcatccgattgatggacacactgatgctagcttcttcaatccagctaattaattacacacacctgacacatataaatagcagcacagatacacagattattctcatccattaacaccacttctcatctgaagttcagacacacacacactgacacaaacatatatacttacatataaatacagatatatataggtggttagctacctgtatagtttatacattagctagcgtatgtgttgttgttgatcatcgatcgccggcgacgacagggagagatcgatccacgatgg

SEQ ID NO: 7600 - DNA, 1501 bp, Oryza sativa
gggaatgcttcacaattcgtgcgagagctcgttctcctctagcttcagtgcctctaatgaactaaggcaaccgacagcgactcaacaatttaaggtttagggttcaaggtagggtcaagggtggacgctcacaatttcttcttaaaaaatgtttggactttggagggatgtcttatccctccaaagtctcctcttttttttaatagtagccaatcctttatttgaaatcactttgaaatatagatccgtatatataaattcaaattaaccaactggaaaaggtttaaccattaagcaaagtctggttagaaagcgctaatactctttttagttataaatatttgacgcatagagaaagattctgtcaaccttttaaactttgatgcattagatgcttaaattctttttatggacatgttgagatttggctcgggaagttatatcataaatttattggaatttcaaaatttattctaatataaaattagagatcaatctttcacaagtttaataaaactttatcctaacattaaatatctatgaccaaagagcatatatactctctttaaatgaactaaacatcatcatacataaattaaggtcccgtttggattatttagtccctgtatactttagtccttggactaaaaactgtagtccccatttgaatccagggactaaaaagactaaagtcatgtggactgagggagagagaagagaaaggctgccgctttagatcttataagtaaagagggattaatggattttagtcccaatatacacttttagtcccttttagtcacctatatttagattagattcttagagactaaaaaaactagaatatatggaaggactagtggattagtcccatgaaaaaaagccctaaatgtaaagagggagcagcatatttcatgaatgcgtacgagcatatccaaaacagtcgttgtatccggcccttaggattgaacatgtgtgctagcacacagggccctagcacacggtaatcgaattttaatttgtcgttctcatgacgtcagctggtagcaacaacactcgttctcgtccggctttggttgtgcaaaaatgtgttactccctcgtccgttttataaaaggtaacaccgttaacttttatcacacgtttaacgatttattttattaaaaagttatctaattataatttatcttttaaattattttatgtctaaaagtattttgagcatgatttataccttatatatttatataaaaaatttaaataagacgaatgatcgttcaaaagtaacaaccgtaactattagaaaacggagcgagtaattaattaagctttgccttggacaagggaccaagaaagagacgacgccattgacacgctagctagctcactgcattaatcacacacacaaaacaacaaatcaaatggtactaggaggagaccaaaccaataacatggctatatatacacacacacacccatcctgatccagctcgatctaacc

SEQ ID NO: 7601 - DNA, 1501 bp, Oryza sativa
caaactcaccccaccgtagtcggtttccccaccttccgtgcaccgagttcaccaacaccctactccccaactccccgtacaccgcgcccacgggtccacgcgccccgcgcaccggctcacgatagcgcacccggcgcacgatacgtctataaatacgcccctaccccccttccccttccggaaccggatcctctaacgtaattcattctacgtcagagggacgttcaaccacggatcgtcgttccttgcgcatccgacggcaaccaccgtttcagtccgtccccgcctcagaccccacaagcgcgatgtctctgcttgctctccggcccattcgttgatagcggcagcggcgccgcgccggccagccacccggaagctcaggcagccgtgcgctgccgccggcggggaggtcggactggaacgcagtgctaccgccgtccgccggcgaggtcgagggcgaggactccgcaccgcctcggtgtctgctgttggtcccatcgcccagcaactgctgtttctcggaaccatcgccggcgaggttggattggaatcgatctgtagtctatcgaacttgcatcatcaggttgccttttctcatggaagaggcagctggttgaaattcttgctaaggcattcgtgctgtcattagcttgtcccagaaactaccaagtaacctgaagaaataaaatcagagctgaaaccagaactttgccaacagattcatatagaatgcggcatagcaagtctgcaattgcaataaaaaattaccaaaaaagatggtttttctccttgaagaagagatcaatcgagtgcagatgttaaccaaggaaagaaatctcatggctcgaactgaagagaagatgagtaatttttctgttcttttgttccccgtgtagctcaccgaggacggttccgagaaacaccgacagcaaacaccgaggcgggcggagtcctcgccctcgacctcgccggcggacggcggtagcactgcgttccagtccgtcctccccgccggcggcagcacacggctgcctgagctttcgggtggccgaccggcgcggcgccgctgcccctatcagcgaatgggccggagagcaagcagagacatcgcgcttgtggggtctaaaggcggggacggcctgaaacggtggttgccgtcagatgcgcaaggaacgacgatccgtggttgaacgttcctctgacgtagaatgaattacgtcagaggatccggttcctccccttcccctttcctcagacgaacccttcttcctctccgcgatttcccctcacctcgcggaggcggcgaggcgatctgcgcgcgatcccattcgattcgccccgaattagccgccaaaaacactcgctgctgctctgctcactgggggggtggagcccacgcgggtgggcgaggcccggtggtgctcgcggcgggtggggggagggggcggcggcggcgccgcgatctgaaaccctaggtggtgggctgcggcggcgggagaga

SEQ ID NO: 7602 - DNA, 1501 bp, Oryza sativa
atttttcgtcctttatttttattaatatatccggtctttttaattttttaatttagaaacagtacaaataaggtttacgtataagttttacgtgtacacataagaacattccaataatttacatatcatacacactagctgctcgttttcatagaaaatgtaataactagtgagctagcactagcagtatcaactaatttactcctcgtcgtcgtcgatctcgacggtcttgttcatcttcttcctgctcccgccgccgccgccgccggcggagggcttcttgcggtaggcctcctcgtagtgcttggcggcgtcgacgccgcggtcggcgaggccccggaggttggggaccttgtaattctgcgccgcgtacacgcccaccgccgtgccgaccaggaacgggaacagccgccgcagcaggcaacccatcgtggatcgatctctccctgtcgtcgccggcgatcgatgatcaacaacaacacatacactagctaatgtataaactatacaggtagctaaccacctatatatatatatctgtatttatatgtaagtatatatgtttgtgtcagtgtgtgtgtgtgtgtctgaactgcagatgagaagtggtgttaatggatgagaacaattcgtgtatctgtgctgctatttatatgtgttatgtgtgtgtaattaattagctggattgaagaagctagcatcagtgtgtccatcaatcggatgaatatgtgtttcttggacaagggttcaagaaaggaattgaagggagcaaagctaaggaaatgtaaagatctaggaataatagtgcagagtatacaacagattaataacctattgatggccatgttctatgcaagagttgaatactacctccatcttaaaatacttatcgctttgagtctttactagcaaaatgcccatgcgttgcattgggggaagaaaaaatagtaattagtgtgtgggagcataaaaccaccaggttcattgaggtctttatagtcgaatcgaatctttgtagtgcaaataagacgctaacatgatataattatttgttgctctaaatccactgacatggatactaaactttgaaaccacaaaaaatatttacttttttgtcatgtattattatgagtcaattgcagtactttgttttttttttggtactcgatattgataagcacttttttttcatattgtaaagagtagccataatataagaaatattttttgctagctatcagatcaacctcactgcactccaattgcataaccactcacttaaataatcagaaggaaagaaaaaaatgtggtatatcgcagaataactttcactctaaataatagaagaaattatacaatgaatgaaaaaaaaagtgatgtgattaggtgtcctgtggcgaataagcaattgatgagcgaaaaaaatccaaatgtaaacatgattcaatttgttggtgattactctttctaaaaaaaaagaaagacacatgtgattattttt

SEQ ID NO: 7603 - DNA, 1501 bp, Oryza sativa
ttcaaaattacagggcacttacatgtcatatcaactgatttacaaatataattttaattttagttatataggactgtaattttatattttaaagaaaataacaatatatatttacttacacattatttttatcaaaattacagtgcacttacatgccatatcaactgaatttacaaatgtaattttagttatatatgactgtaattttatattttaaagaaaacaacaaatatatatttacttacacattatttttatcaaaattacaaggcatttacatgatatatcaactgaatttacaaatgtaattttagttatataggattgtaactttgtatttcacggtgacgacgacgacgagagtggccgtactgccggcggccagctcaatcagaggccaccttggcaccgtgcttctccatcatcacgcgcgcacgcggtagctaggtaacacaggccgacgtgcctgccggccggcgagctgcatggaacgtcgaccttgcaaattgccgctcgcatcgcaagctgcatggaggccaaaaaaaagtgtcaaatgccagcaaaaaaatcacacgggagatggatagcaaaatcaaaaaaacaatcttcttttcagataggaagacacgtctgtcatgggcatttaatgggccaggtaaagacctattgaacgggccctgatgtaaatcaccactgcgtggccaggcccaaccccaatttggaaacctgactagttatgggataagttcatctgaggtcccttaactttacaccgaatccgattttcgtccctcgatcagaaaaccagacacagcgggtccctcaattattaaaaccggtgcagattaggtccctcggctgttttgagagcggttttggctgacgtgacacctatgtggctaatttgactcggtctttgtccgacgtggcgcttacgtggcaattcgacccgtgggacccacatgtcagtctcacatagaaaataataaaaaatcgtgggacccacgtgggtcccacatgtcagtccaactcacccctcttcttcctcctctctccccatctccctctcttcatctccctatctctgctctctccaggcgccacggaagacaacggcgcgtggcggcgcgcggccggcggcaggagaggagggagcaacgcgcaaagaccggcgaggtgggcagggagggaggacgcaaggaggccggcgatggccaagcgccgtgggcgggggcttgatggcgacggacagagggagaggtgcgcagccgacggcggccagcgggagagggagcggcgaccgccctccgccgcaacctacctccaccaccaagctcgtcagcgactgcccaccggagtgagcaggacgacagccggcgacgggtgaagaggatgaaggcggcggtatggagcagaggtcggaggagggcccccagccgctaggatggcgctcgatccgtcgcgtttcaccaccaccgagctcgtcagctgcagcccaccg

SEQ ID NO: 7604 - DNA, 1501 bp, Oryza sativa
ggttaatctttttgtccgtcattaagagtgggcccacacgataattcgtcgctaatccacgatccgaaagcgtggccacgatctcttacgcctgcaaataaaggagaaaagaaaaataaaaagagaaaaccttgtttgtggagcagcccatccaaagcagcctggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaataaaatgaattatttaccgacaaaataaattcttttttaaaaataaaaataatcacatgtgtctttctttttttttagaaagagtaatcaccaacaaattgaatcatgtttacatttggatttttttcgctcatcaattgcttattcgccacaggacacctaatcacatcactttttttttcattcattgtataatttcttctattatttagagtgaaagttattctgcgatataccacatttttttctttccttctgattatttaagtgagtggttatgcaattggagtgcagtgaggttgatctgatagctagcaaaaaatatttcttatattatggctactctttacaatatgaaaaaaaagtgcttatcaatatcgagtaccaaaaaaaaaacaaagtactgcaattgactcataataatacatgacaaaaaagtaaatattttttgtggtttcaaagtttagtatccatgtcagtggatttagagcaacaaataattatatcatgttagcgtcttatttgcactacaaagattcgattcgactataaagacctcaatgaacctggtggttttatgctcccacacactaattactattttttcttcccccaatgcaacgcatgggcattttgctagtaaagactcaaagcgataagtattttaagatggaggtagtattcaactcttgcatagaacatggccatcaataggttattaatctgttgtatactctgcactattattcctagatctttacatttccttagctttgctcccttcaattcctttcttgaacccttgtccaagaaacacatattcatccgattgatggacacactgatgctagcttcttcaatccagctaattaattacacacacataacacatataaatagcagcacagatacacgaattgttctcatccattaacaccacttctcatctgcagttcagacacacacacacacactgacacaaacatatatacttacatataaatacagatatatatatataggtggttagctacctgtatagtttatacattagctagtgtatgtgttgttgttgatcatcgatcgccggcgacgacagggagagatcgatccacgatgg

SEQ ID NO: 7605 - DNA, 884 bp, Oryza sativa
aaactgctcatattttacggatggtagagttgtagcatctcctttgctcaagctcgattttttcttttgttaatacaaagtggtcactgctaaggtcacatgtaaaagagctgatctgctgcacttgctgcttgcctgccgctatttgagctgtaaataaaatccaggatttgcagtgaggagattgtaaagctcaccacaagctagtctctccgttccaaaaaaaaaagacaaaccttagatttccgtgtctaactttgactgtctgtcttatataaattttttttataattcataattttattgttgttagatgataaaacatgattaatactttatacgtgacttgtttttttaattttttatataatttttttaaataagacggatagtcaaacattaaacacggaaaccaggtttgtctctctctctctttttttacggagtgagtagttttcactggcaccgcgccgcgcactgccagcatctctctcctcctctttatctctcgccccgacgccgcgccctacttcctctgaagtctgacctgacctccgcagcgcggaacacaaaagcaccaccaccaccaccctctccctgcacgtcacgaagcccgaggcgaaccaaagcccctcctcctcctcctcctcctctctgtaaccccaccaagaaagcgaagcggagcccggagagtggggagagtgtgtgcgtgtgtgtgtgtgattctccaatgccgcagggcggcgcggcggcggcgtgagaagctgaggcgggtgtgagccgcgcgcgcgcgttgttggctctcggctctgcaagaagggtcaggagggttgggaggggacgcattgcaatggcggagtcggcggcggcggcggcgggggacg

SEQ ID NO: 7606 - DNA, 1501 bp, Oryza sativa
ctgctctatatataattgagttgtcttttttttctggcaacatccaattcatcaccggtgtatttttctttttctgtaaatatcattgaaaaaaagcatgacctgaaaattttgatgttaattcccaaagtaattgtgattgaaggttaacattgcaaacctgtggtgtttaggttattatacaaatccttctgaactttaaataggttaatcttgctctagatgcaatgcataagtaggcttccccccaactccacagccacctccttttttttctggagggaaatgacatctggtttaaaatttaagtgttctattgtaaaatataattgtgtttggaatggtaaagattgctgatccctctttgttgattctatttctgattacaattctttaattaccggttggttaatattcccttgagcagaatattttttatctctttattgatgccttaggaagcctgttgataatattattcccttttggttccgacctatatttgcatggtttatgtactcataattatctgttgatcacaggttcattaatgtccagttatatttctcaatggtctactctgaagtgactggcttgaagcatatgagactcttctggcttggtgtttatagattactgcaaacaaaaggtggtctcacaaaagtgataaagtctctctttacgtatggatatggaaatgacacctagaacaatgtaatgaagttgtcgatttctcatttccccacatgtatctaagctcaacgaagaccaacccaactatgatatatccgtgcatggatgccaattacaaatcatgatttatataagtggagtaccgaggaacgcatgtagttagcataaagattctagggtgcccactttggctcagtctctcgtatacgagatagtttatgctcgtgaaaacgaaaccacatataactaccaaagatgctcaaaaagactattgcacaactagtcaagacatgaatattctcaaacctgatttgattaaaaggctaagggaggagaagggttggtcgggtcacaaatcctaatgtgcacaactagtctacactaagacaaatctgatttgattaaaaggctggggagaagggttagtcgggtcacaaatcctaatgtgcaagatttttactccaattttctgcagaatggtacttaaccgcccggttctagtgtgttcttcaaccataattgtatttaggacttgtttgatttaataccctatcaaaatattggtaatattaaaactaagccaagttttttgcactactaccgtttcgattttgataggatgatattgtaaatgagtgtgtttgaatcgatgtcaaatggatgccaaattatatcctatatattagatgaaaaaagttataggattataccaaattaaacatattgccaactatttaattttaaaccaaacaatcccgtttactattcaaactactaaaaattggtataccttttgacatcgacccaa

SEQ ID NO: 7607 - DNA, 1501 bp, Oryza sativa
aacctaccgggtgtacggtttcccgctcttgcacctaaggaccgtttccttggaatttcatctgaacataagacaagtacgaccacatgggtggaatgggacacccctggctgagtaactagcttatcaggggagccatgatgccgagagacatgtggattcgccggggtggtgtcggagaggacccccctgggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgtggtgaaaaggggttcgatgtttgaaaaatcagcagctgacgggatcagctaggcccaggtggccgtttgaaaagttgttggcccgggtggccgtttgaaaagctgttggccgggtgccaaccttgttttaagatctaaagattgatacattgcacatactccgaccggacgagtagcactgtctcatccgtgtcgtttgagaagcactcacttagttgtttttagaaaagagctcaaataaaataaattgcaaaaacaacagcctttctttgaagcctgcattaaacacttatttcctatggcttgctgagtactcccgtactcacccttgctctatataaataacccccccgcagttgctgaagaagatgaagcggatcctgctgatgaggagttcttccaggagcaagccggttacgatgaattttagggtttcggcctagttcccaagtcgcgcctgtgttgtttggtccaagtcctggcttccgtttcccttttgtaatgcagttgtgagctcgggatctgtccgcagcccaacatgactctacctctactctataataaagagacttctgtagctgtgataatccgtcttcctgtgataccagcactgtttcctgggactggtatcgattaacaggttaatttggagcgtcacgggctagttccggtcggtactagttcggggcgtgacaagagatggtatcagagcacaggcttggccctagggcgaaacccgacgcttaggacgaccctaaggatactaagttcaaaactacttgcgaaaagctaaggtttcttctgctttctttattttcaatagtttgtttctaaaatggttactgatctttctccctctttcaaaattgtagatggcagtgaacgccagcttcagttcccacggttttagtgagggtcaccacgtcgctcagcttcgtgacctcgcctgtttccttggcttctcgtgtcccgagtacacggggtactccgtggaccgtgttccccctcactg

SEQ ID NO: 7608 - DNA, 1451 bp, Oryza sativa
cacatcgttccaatttcaatcaaacttctaattttggcgtgaactaaacacacctaaggtcctttatatagcccagcgatgcatatgcctagtctactgtcgtggggaacaggttctgggcgtgtgtactatgcgtggcacagtgtgtgtgccagaagcccaaaataccacttccgtaggcgttaagttaatgcagggttggtgtggatccgggtgcaaacccacgcccatgtgctgtgcagctctggtatagatggatgagcatgacgcgtggagactttaccaatccaatattccaatgccgcgctccacgtcggctcgcttgatcttttgcaactcccggctcactccgctcagcttaaccggctcgccctccccaacacatgttgttacatgacatttcacaaacgcccgttaaggtcaacttctacgttgatgtagcacccgttccgtcgtggcgcctagcgggaaaattatctcctaaaaaccctaattgcgaaacctgtttctttgcttgttgcctagtgtccgtgccatctcaagatctcaatccccgatctatcgtcgagttcaattccgaatccaaatccttccaaatcaaatccctccgcaaaagtctagtttgcctcccccggggtcgatgggccgattttctctcggcccatcttcccctctcccccagccctttcccctctctctcccctctctccctgatccccccctctctctctctctctcgctctctcccccggcgcgctcccgctctctctctccctctctccctccgctccgccccgcgccgcgcgcgcgagcgcgcgtcgccgcgccgagtgcccctccctcgcgtgccgcgcgcaagcgcgagagccgcgccctgcgcccctccgctctgcccgcgcgcgtgcgccgcccgcgccgagccgagcccttctccccgcttccccgctgccgcttcccgcgcgccgtgttcgcgtgcgcgtgagccgcccgcgcccgagccgcgccactccatccgccgcgcctcccgttgcaagccgcgcgcgcgtgccgagtggccgaccgcccggtcgccgccgccgtcagcctctgcacgcgtctgtcgcccgtgtcgtcgcgccgctccaaaccgcccgccgtcatcgcctcccgttgcaagccgcgcgcgcgtgccgagtggccgaccgcccggcccccgccactccgcgcgcaagccgccaagggacggaggcagcgcccccctccctctgccacgtcgcccccgctcccctcctccttttttccgaatcggcaaaagggcaagcccctttctccccctcctttcccctttttcctcctcgccggcgtcatcctccctgtcgccgctttggccgcgaccgccgagcgccagctcgcgcccttgaccacgcaagtcggttcccaaaccgacattgccgcccatctaaacccccagc

SEQ ID NO: 7609 - DNA, 704 bp, Oryza sativa
taatgatcctattccgtgatataagaaaatatgttgtcttctttctttctttgttttggatttttttttcataataattctgggtttactgtatattctagtgtagttttttataataattatgggtttactatataatctagagttatatgagtagcactgagtaggcgtatgatatttagttaaagaaaatgaatgcaaattcgttgttttggattttttttcttaataattttaggtttactatatattttagagttataggagtagtactgagtaggtgtggtatatttatagaaggcaaaggagtagaagttcgtgtggttggaaagggaagatagttttggaagcctctagaatctatatgtgatatttttctctatatttttccttacatatgattgttaggtgtttttttctttatgattttttcttcaaagtaagagacgccaagtgaaccaatcaaaagctagtaaaagagctagctttaccttctgcaatgtgtgagtctgtaagacctatctagtgttactgtattatttttttttcttttcttctttaccatctttacaagagggaggctagaggaggcaactgcaatgtgtgaatgtaagacctatctagtgttactgtgttattttttttcttttcttcttaccatctttacaagagggaggctattctttcttttcttttttttaagg

SEQ ID NO: 7610 - DNA, 1501 bp, Oryza sativa
tccgcttcccccctcacgcgagatatttcctctcccccggtgggccgagccgccacgccacaccgccccctgtatcgctcactcgcttactatatagccagaggggagggagcgggtagggttttacctcctcccccccgcagcgccgccgccgccacacactcccccacatctccccttcccttccactcctcctcctcctcggatcgggaggcggagcgagcaatcccccaaggtgatttcctgctgctcttctctcatctccccccatcctctccgttgcgtgaatctgttgtgtggttcgtcgtcgattatcttagctaggctagattcctcgcggtggtggtgatttgagtgcgtccatctggtcaaaggttcgaggtaggagtagtagtatgtgtgggtgctctcagttcgttgcatgtttgggttctgtatctggtttggattatcatgtttagtggttggcgcggtagttgtaaatctgtggggttttgtcacgctggttaattttttggtttcgtcccggttccgatcgacgtttctttgggtcgtcaggtgtagcgaatggatgggattggttcgatccgtctggtagggattcgttctgctcgtagatctgctgtggattgctttcgcggtcgcctgctggagctaatttggcaggattaggatggttacccatttctccagggcagatctatgctatgttcgttgattggcgtgtgctggctacagacttgttcatgttgttcactagattgttaaacatgtgacgtcagccggtgattgcttgtctgccacggttttgtttgttgtcctagtgaaatatgcacagatacttaagggccgtgtttttgttttcacaataatggcagtagatgagttgaattcagtttgtcatatcgtttttgtatcaaaacaagtttttttcttactggttaagtgcttctcgcggtcccgccagaatttttatgtactgggtatctctgttatgagtactcccatatcctgcatgtacagtactgcagtggtgaattggtgatgtgctgatggtaatgaatatggcggaagtgtatcagtttgctgcttttgttacatttgatgtgtgttttcaagtttcatcttttttttcttattaatgctgcatctatcaagctgtgagtttttttctttgatcgtcttaaacctaacagtgtaactgcatcagtgtggtatttggaggtagtattagtaaaactggacatgttaaaaattcgcatttagtaaaactggacatgttaaaaaatcgtatttagtattttgtatcatgtatgatgcttaatttttgtttgcgatatcaattatatttttatttgttgcattgctatgtttttacttgagtcatgccgtgatatatttgtagttagaattttgattttaggttttgtgttttgcatggttctaactgggtttctttttttggtacaggaatttgtatttgtagcgtgatttgcaaagc

SEQ ID NO: 7611 - DNA, 1501 bp, Oryza sativa
catgacagggagactaatctttgcaacttggcattagaataatcagaatcacagtttggtcggtttggatcttgttgtacacatttcgcaaccaacgtataggaaaattaatatgtcccagaagttgcatattataagtcagaatcttgtagtttattgttcatcatttatacttctgttgtgtaaatgattcctattttgaccagttgatatatgtttcattgtcttcttcatttcgaattatttatagatcctatagataggtataacatgaatgtaatagactatttctggaggacgatggtattacattttttttccttgaataataagcttagtattctctatcttggacagaaaaccttgaaccttaattagtgggtactctctgtgttgattttataggccgcccatgtactccaagattcattctttgcgagctctctactaacaattagtccaacagtaagtatatcttgaaacaggaaaaacagcacaattgaattcatctttgaaaacattttctctactatatatcacttattttttgttactgccagcaatataacctcccgtcaagtcaaatcatgcacgccccttgtaaaagtaaatggacaatagcactttatgtattttgtattcattttgcaggatttgggattttgcgcatttgaaataacagaagggcaaaaatgaatatcagcacatgatcttcccacatcaaaatgaagcattttaattatgcatagtacttattgtataaattgcaataccagccagattatatgatggtaaaaggattcccatctatctttgctatacataatacacttattgtttaatttagaagtaagtactgtacttctgcctgactctggacggtgcaagcctaacacaactcccacttgatcaattgctctgaacatcggtagttcggtactagtctgcaatactcccagcaaatctatcatggaagatatcgatatagacatatgatgagaggaaattttattaattaatacttgagcatatcactatcataattcccatatgtaaactcgatttaatattaataaggttagtatgatggatccagagctaactagctaagtcggccatgcatgttaatcatcccatcaagcatatgcatcatgcagtcaccaccagagcaaatcattggttgaccacttttgccgcccccacaaacgaatcaatttttttaaaaagggcaccaattacattttccctccattactcctgctgctaatcatgcttaagatcgcccattagtaccacctcgcttatttaatccatttccccactaacttttaagctttcccgcccttatatatactcctccatgcaacctccccatgcagcagcagtagcagcagcttcatcgccaacgaccacaactacttcttctcctcgatctctcgaagagtatggatttctacttcttctcctcgtcggcgccggcgccggagaagaagacgaggcg

SEQ ID NO: 7612 - DNA, 1501 bp, Oryza sativa
catgtgttgtatatgccttcaatatccttagatggactttctgtatagatgaaatgttctgaacaataacaaattttatatataatggagatgatttatatccctggcctttgccatatgtgttgggacaaatccctaaatacctgtagaaaaaaaataccaactgaatgcctgatgtttccctcaggccacaaaatgttttcctaacaaaagttcatcaaatgttaattctgcttaaaaaaagggggtgatgtaattaaatagtcaacctaaaagggtaaaaatttgtacactacaagaattactgggcgaacatatttatcttcaagtcctgtcatgagatttttccaactctgttgctcttaatctgcatctgtagtgtctgaattggttaaatcaaacatgtgaccttgcaattcttaaatacttgccaaacaaaatacttattcaaagttactactccctccgttttacattttaaccttttatgagtcaaacttctttaaggtttaccaagtttttaaaaaaaccatagcaatatttttaatacaaaataaacattattaatttggtgttgtacatgtttgcttttttatatatttggtaaaatttaaagaaggttgattaaaaaaatagtgttttataatatgaaatgaagagagtattacatcgacagagtaaaaaaggaatggctggaaataagagttagaagaaaaaggcaacgtgatcgatgatcgagtcagtatatattgttttctaacaaaattttgtgggctgggccattactttatactcaaccacgtgtactactgtacttccaggtctaaaccaaggaataagtccactgtgactcccttaactagtagccgaatttgattcgtactcttaaaccgtaatactggatatctcgaccccacctattaaaaccggtacaatttgacttcctcaacggttttgaaggatgtttttgttgacgtggcacacgacggtgttgacttgatctttgcccatgtggtattggcgtggcacttatgtggtataagaactaaaaacatataagtgggacttatttgtcataaaaaaaatataggacccctgtcatgtggggctcacatgttatcctctttgtccttcctccccatctctctgccctgcgccagcacgcccacaagctcggcggtgctacctcccccctccccacgcgacagccttggatagcgaggcggacgataataagctagctctcagcggattaggggtggtgctggcaatgaaggcggaggaggaggcggcgacgcttctgcaggccaagccgcctgcccaccctccctcctgccatcgccactccagacccccgaccccatagatggctaaaggcgaagagaaaggggagagaaagagaaagggggagagagagagagagaggagggagagaaagggaggatgacatgtgggctcattctattttttggtgaataacaaataggtcccatatatatat

SEQ ID NO: 7613 - DNA, 1501 bp, Oryza sativa
aagtcatttgacttttttcttagtcaaatttctttaggtttgaccaaatttatagaaaaaattagtaatatttacaataccaaagtagctccattaaatttaatattgaatatattttaataatatgtttgttttgtattaaaatgttaatgtatttttctataaacttggtcaaacctaacgactttgataagaaaaaaaatcaaataacttataatatgaaacagagggagtataacatatgacatatggcataataacttgttctttattttctcaagtaaagggttcacaaagtggtaaatattacgaagacatggatgttttttttgtccttcttgtctgaacccgtgtgtttataattattatttattaaagtgatccatgacgccaatttatttttttatacgattaacttatatactgtatatgttttgttataacttatttaaattaaatcaaccatattaatggtctaaacttttttaaatatgattaatggggtaaatataaagccctcataattaaacgcataattaaacgtcaaatataattatgcatattttttctagttccaatatagtgaacagactcctcaaatatgtatttaagtagaaaaaaaaacttttggtaggctacaaaattatttccagtgatctatcgtgtaggtgttgatagcaagatggatgaatgcacgtgattttagagtggcatcaagattatctgggcaagtgaacttttggtagctacaaaatactcttccgtggactgtgcatctttttttcccctttccttccgtggattgtgtttttttttccttttttttccacacccaatcggacatacctgcctaaatactattaggactctgacatgcatgctcgttagaagtactttaacctttcctatttatttattatataaatagagtttgtttcataccaatagaaatattgcccaataaatctacaccctttaatctatatgcactgtataatctaaaggtgtagcttttttctctttttctccgattaatgtgagaatttctagtctcaacagcgaacatggtgcctcctttcaaggctgttttaataatataatagattagtgcagatgtaatgttggcttgccattatgttattactctgtgttgcaggactaaagattgattatgtactaaaaaaaaaaggtgtacatactgtctcaaagtggagtaaagggagagatgcaactcttgcaggtgaactacaggctgtaagttgtattaacagtttactgtaaattaagttacacttccgtatcttaacacattgctcaagtctcacattttatactacaatttgcttgttaattcttagaaacccatctgacagtcagcaaagtgacttgatgaatacacacattttgcagccgttgttggtgtgattttggcatgtaggaaggaccatactaacctgtggtaattaaggaagtgctattaggcaagagcagatgcttgcac

SEQ ID NO: 7614 - DNA, 1501 bp, Oryza sativa
aaggacgggccctgcaggcagcggcacgcggcggtggcggcgatgacagcggcaacggtggctaagccgcagcagtggtcggcgtcgttccacggcgcggcgcggcggagcagcggtcgctgacgcagcctgacttgctcgccgagcatgtggccgctgcacgtgatggcgcgcttcgagtgtcgcgtggctgacctggtcgccgccgccgtggagctctacctccgggaggggcgccggctgctgctgctgtccgccgaccccgccgccttcggactctgcttcttcctctccccaaaggccgcaacgattgccgcaatcaccgccgccgccgctcctcccccaccagtttagggatgagagaggaagagaggaagagagaggaggagaagaaggggctgacatgtgggacccacgtgggtcccacgctgagtcagctgccacgttggacaaaaccggagtcaaaaccgccgagggacctagtctacattggttttgtaagttgggggacgcgttgtatccggttttgtgttttaaggatgattttgtaattcgatgacaagttgagggaccttcggtgtactttttccgaaggagaatgttccgccccattataagcccactgttgaatgtagtctatacatgtacaaattgtgagctaggatgacgttttactttttcctgggagcaaaaaggagggggaaatcataagaactaagaagcactaggtgaaaccccgcgcattactgcgggaatttagtatgataacaataaaaaaataacgtttaagatagctagataacatcagattaagtaaattaatgtggtttatgataatttaaatttaaatagtatgtagaatggtgattcaaacgtaaaaagtaaggtggtatgactttatggaagaagaaaagtaggaagatagtttggaccgtagattaatcatctaaaggctaaatacaattgatgtgatatgacttaattagaggaaaaaatgataatttggaccatagattaatcatttaagcactaattgaggatgaactatatataagtatataggatatcataaaacataaaacataataaagatatacattgaaacattatgtgaattatgttggatgataatttaacatgtttgtatttcaaaagctcttaaattataaaaactataaagatataacatgtttgcatgatgtttaaatgtgatgattgttagtggatgatgatgtgtcatcttgttaattagtggataatgatgtgtcatcttgttagtggatgatgatatgtcatctttgcatgttaagcttaaggagttaattagaggaaaaaaagagaaagataatttggaccatagattaatcatttaagcactaattaagtgaggatgaactatttaagtatgtatgatattataaaacatagtaaagatatacattgaaatattatgtgaattatgtgggatgataatttaacatacttgtattttaaaaactct

SEQ ID NO: 7615 - DNA, 1501 bp, Oryza sativa
atgaggaggggaggtataagtagagagagggcgcgcgggaagagggggcagcgtggcggggatggtcaaaagcgacgcgtgagctgcagtgcaagcggggagaggagagacgcgacgcgaccatggcgatggcgcgcgacgcgatggcgcgcgctcgggggtggcatgagtgcatggccattattgggcgtgtggggatcattggtcatggatggcgcgtctctggggcgaggaggagggatccatgccctgccatgccacacacacacacacccctctccatctagaataattacaaacgccattaatcagttccaacacttacttccttcctccgttcgatgggatagctctaactcctaaatttaactccaagagttaagtctgaagtagagttgtggagcttcacaactctagtttattttgtgagagagctccacccagctccacttccagttttggtggagctaaaactgtttggctgagctccagctccaggaggggtggagctggagctggagctggagctgtgccaaacaggctctatattaagttcatttttaactcatttcatctgtcccaaaaataaattcagttttaccgtaatagttgcaacagagtttgtgaaagtagagaataataatattgcgagtagatagagtgagaattgttacattgggatttgataaaataggaatattctagcctttttacttttgtgtttgtatatgtgagatgagtgaaaaatatccatctccattctttactaatatagtattatttttccatatttaataaaaaataagtgaaatgtctattttactatttcaccggaacggttaaccacctaaaccatttttcagtttattttataccgtaaactatttaaaacggttgcattaactctccaacggtattttctttctctatatataaaagccatattttgcactggaattatgttaggctgatagatgcattacaacttattacgtcttaacattttttataatttttgtcactgtttccatgagttcgaagcacctaagagtctaagactaattttaaatatcaagcaaatggtcatgaaaaataattttgattatggtgtaatccatatctaaaaatttgttgcttaaaatacaactcgtataaagaagggaaaaacagaaatatttcaagcaaatgatcatgaaaaataattttgattatggtgtaatccatatctaaaaattttctgcttaaaatacaacttgtataaagaaggaaaaaagagaaatatttcaagcaaatgatcatgaaaaataattttgatagtggtatgtaatccatagctccaaatatttgagtcttaaaagacaacttcaataaagagagggaaaagagaaatattattacggagtaaagtgaaccattttcgatcgattagagataaaataaaggtgggataattaaggagaggaaaaaaattagagcaacaaatagaaataaattgtccatc

SEQ ID NO: 7616 - DNA, 1316 bp, Oryza sativa
aaaaaataaaataaaatccaaaattagacaaattaaaaagagagttcaagtaggaatacaattttgaaacaactgacattgaaaataaaaaataacacaatgcaatattagttaaaattcaaaacaaaaaatataataaattctgaaattagaaaaagaaaaataagatttcaagtaggaacacaatttataaataactaaatttggtaataaaaaaataaatactactgaaagaaaaggccatttaaaacacatgacgaaattaattaagtaacagggctataatggagtagaatggtggtggttgatgggacatctaaatactattaataaaacacaaaatagaataataatgacaattaaaaggaatgacgacgggcagatagtcaagcaatcggttatggcggtcggcgggacttctagaaagcaaaaaaaaaaatccaatgataatcatatttgatttttaaaatctcaatgacaataaaaatgagaggcaatgggcgagtcatacatgagtacaatggcagagccgccgatggttggtgggacttttagaaagtaaaaaaataaattcaaacaatagttatattcgatttttacaatcttaatggcaataaagagtaagcggcggacgggtcgtagaggagtatagtgcagcgtttgacaggatttgtaaaagttataaaaaatgaaatccaacgagacaataaactctaaaaactataggtccaatttttagaggtaaaagtaaaaaaaaccaataatactcatgtttgattttaaaatctcaatgataataaagaagggaggcatcaagcgagtcgtagagaagtacagtgacaaagtcgctgacgttttgacggaacttctagaaagttaaaaaatgaacctaaatgataattatattcaatttttataatgccaatgacaatcaataggagaggcagtggacggccgtaaaggaatataatggcaacgtttgacagaacttctagaaattataaaaacgaaacccaatgggacattaaactataaaatctataagatccaatttttaaaagtcccaagaagaatgaatagaaatagtgctaggtcgaacaagcaaataaagaaagatatgacagaagtaaggggtacggtgtgacttttaaaaactataaaattagaaacacaaggattataaggtttggtatttcaaagtcttaaaacaacgagataactatttaataaactttaagtaaaatcatattaaaatatatataactttctatgggtgctagccgcgcaattgcgcgggtcacccagctagtttagtg

SEQ ID NO: 7617 - DNA, 1501 bp, Oryza sativa
ttatatatgtgtgagcgcatatgagtccaaacttattgtcaggttggttatatagtggttctattgagccaaaaccttatacactacttaaaaaccttaataggtgatggctcatatgtgtcggttcatttaaaactgacacctattaaccgtttcccaccttcacgagataaaaaataccgacacctccaaaaacttataggtgtcgactctaaataaaactcggtacctataagtacttgtgttttcaaaaaacaaaactgacacctatactaattttatatgtatcgattctttaaaaaaccgacacctataattaatttttttaaaaaaatctgcccattgagccggcttatgttatctactcgtgaaaccccatcggaaccgtatccgccctttcttgctccttcttatccattgctgccactcctacttcctcctcctaagcacccgccactgcccctccttcttcctcccttctcctctttctggatctgccgcccctcctccttcttagccgccgccgctacccctccttcctcctcttctccaaccggccgacattgctgcgaccacggggccagatccgctgccgtgacggtggcgttctccatgtgttgtgtttgcgattttgttgattttgtgattgtgtttggttatgggatgataatgatctcaatgatgattttgattgtgtttggtagatggggatgatattgatctcagtgatgatggagagtttctcgaatcgagccgatgcattgagttagcttttttttttcttttttccattactagaaccttaaaagtattggttcctaaactagcacctttggtccttaaaggtgtcacttgttgggtgttggtttggaaacccggtacctgtgatcaatttttaatcggtaccaatctcttttatgtagtagtgataatgaatgcatgtatttaatggaagaaaagatccattataaaaataatattgtgtgatcacctacagacttttcatgtagattgtgctcagtcaactttacttttgcacgttatatatgcccatttttcaaccataagaaaaagatgcttcgtttgacagaaaaacagcaccgtatgcacgtggccaagtcgtgtgctgcaacagacacacgtggcacgttccttaccacgccaacgcaaaccgatcacttgagccattccgatctgaacccattaaattccaaggaaacaagtcaacaactagttagatagaaccagtaaaaaaagaaaaaaaaaagaaaaatcacgagggttaatcaggccgacgtaagcaagtagcccaaggcccagcgagtactgggcctgggccagcatccttccgtgctccccttcccttcttgttttttttttctctctctcctcctgcaattctcgtccactccgtgacgccaccacgccgcctcgcctcgacccgatctcctctccacccacccgatccacccgccggagaggaaggccgccgccgccgcca

SEQ ID NO: 7618 - DNA, 1501 bp, Oryza sativa
tcctagcaacctcttgatcaaagacatatttccctacggtaaccctcccttctgcatctattcccatcttcaaattggattgtgttagaccttttctagcatgcctagacttgcaagttttaatatggtctaacaaatgtttagtcccatttctactttcagctccaagcttgttgtgacaccatttgcattcagctttccacgcaccatttattttcttcttaacaaaatcttgccatgctgcagatttcagtctcttattatcatgttctacttctgtaccttgtgaatcatttatttcgacgcttggagcattggttggagtgggagtggaagtggaagatggtgtcaatgcaacttgtgactcaacggtggcagcagggttcgacattctgtccacaaataacataattcaataatagatcacaatctgctgctatgtgctatgtactaccaaatctaccaaatatacactgaaatatacactgaaatagatcacaatcttctgtttcataatttcattcacaaatcacaaggcacatttggagtattggagatggagcaatacctctcactctttgtgatgtgctgcaacctcgccgccagccgcgccctgtgcgccgccggccgcgcccttgctgccggtgtcgcttccccgccgcgcctgtgcgccgccgccggcccgccgcggcgccgccctgtgtgccgccgccgctgactccggagggagaggacgagctcgagccgccggacgccggatgggagactggagaggaggggagaggagatggtggcctggcggctggcaggcgccggcgacgccgagagggcgagatccagaggcgacgccacagccgcaccgcacgggatgagtggatgacgggaggggaggggaatggatgtggggaggagagagactgagggatgtgctgcactgctgctgtgctgcagtgctgctagggttaaggatttttttagtgggctgggctttttgggctttctttgatctatattttgagatttatatgtactccccgggggcccgcgggtgaaatcagtcccccgtcccctccccgcccaaatgcggggccccgtccccgacgcacccgcgggtcgaaaattggccccgcccccgcccccgtaggggtgggtccccgcaggggacccggccccgcgggggaaattgccatccctaattgccacgaggaaccagtcctcccaagtccgaagtcccaactccccgggccagtcaaaaccaaagtcaaacttctctccttgaacgtggacgccgggccccactccccccccggcggaacagggacaaagccgtaaattccgccccgtttcgctgtgccgtgccgtcccttcccctcccgtgcgtctcggcctcgcctagtgtttgaggggtccaaagtctccgtgtcgtctccacgactccacttgctctcctctcgctctcgctctccctcttcctcccacctccagatcgatgcgtcggcgg

SEQ ID NO: 7619 - DNA, 671 bp, Oryza sativa
ctttggctcataattttacactacaaacaattaaaaatggttcttttcacttctttaaaaagaacttctttatcactatttacctaggttgggcgtaactaagtctagtatttaagcaaacaatcataaaaaaataaaaaatgttttcaaacttagataaatgtgacatctatagttgtaaaatgttacaacttaaagtatactatcttatatgaggagagaaaaagaaagataaatattattaggaagtcgagtggaccattttcaatagttgagggtaaaataagccaaaaatggtttaaggggttaagcatttttaatggtctggtgtaaaataagctaaaaatgatttaaggggttaagtaatgcaatgaaataattttggggaatgaaaatgaccaatctttaattcaagcagatattagaccgacgtagatgctaaatttacgatttgctacatcaaatttgaattaattttgttgaagaaaagaaaggctaaacagaaaaaggaggctaagcatatgcacatgttacctttataaatagcctcctgccttcctggaattaacaaccacgcccttggcacatttttccttcaccccctcgcatcatcaggaatagcaaatcagcccccgcctctcttcccgcctaagcttttgacgccgccacga

SEQ ID NO: 7620 - DNA, 1501 bp, Oryza sativa
tctatactggtttattaaaaaaataaaaatcatatattgttatgtttgttaggagctcgagcttgactggacaaagctcgcaagctttggtatacgctcgggctcgactcgtctggaactccagtcgaggttgaaactagcctaggacgaatcgagctcaagcagcctgtgagtctctagcttttctgatagccctagtccatgtaagttactttatgggtaggcggcacaatactatagtatacgataccaaagatgtctcgggcatgacccatggttataaattatctgaaagaaaggttccaatgaaagagaatttatgattgactcatatgctatgggtacccttcgtgtttgctacttaggctggttataaaaataatactattagatagctgtttgagagaagataattcattttggaccgactaaagtaaagggataagaacacaagtatgagcaataaaatgctatggccatgcataatgccttaaaaaagaaagagtaaaatgcatgaatgaccatttaacttgtttagatttatcatgcaggtcattctacttttagaatacacatttagatcactattttaagttaagctaactattcatatgtcatctatgattggaaaaatgcttttggacttggcaatatacaaaattagaagaactaaatcatatcacttgggcatgttttaatgagttctcttagttcttagtcctctctctcacttaccatcaatcccgccaacggtagcggccgataggctgaatataaacagcgatggaaacaaaatcttaggaggcaccgactaaagatgtccaggtgcaaatttttacaattcaaggtggcatgctatgcgtaccaggtgtgctcatatggatagttagatgattaaatgacacacttaactcatgttagtgattaagatgtacattttaaaagtagagcaatatatatgacacatccaaacaagttgaatggctctccatgtattttactaaaaggaaaattcaagaggtttagggccaacacaaatattacatcaatacaagtcacaatatgaatgaatttctctcgaataattgattttcttttacacttaataagtatggttaaataacatgaaagaatgttattccatgcaagtgaaaagagaatgttttcataaaggagggtttcatttgaaaagattaggctgatatagtaatataaatgctaaatcaactaggattttgccacatcggatttaaattacttttattgaagaaatgaggaaaaactaaactgaaaagaaagaaagaaaaataaaaaccccgtctgctggactccataggtagcaactgcctacgaatgctacatttataaataccctcctgcctttccagaattgacaaccacacccttgaaatatttctcctccgccccctcgcgtcagcggaattagcaattcagcccctgccactcatcccgcctaagtttttccccccgcccgccacga

SEQ ID NO: 7621 - DNA, 516 bp, Oryza sativa
ccccccaggcactggcgccacggtggctggcgctgccctcttcccacaatcgaagcccttttgtgcgcgggacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggggggcattagagcaagtgtaatagtagagctaattatatagatccacattagagttaatatgtacagtagatgagctatacatatttaatgcatttatcttgaaatatagtagcaaaatactcaacctttgctt

SEQ ID NO: 7622 - DNA, 686 bp, Oryza sativa
tatggacaacggggttgatccaagtaatcggttctgatcaagctaagttacccccactcagtcccggcctcccggggatcgattttctgtgaaaagtagcagtaattactcttgagagacagagtatccaaaggcacttagaacatcatgccgatataattcgcctgtaggaccaccagggagcatgagatcgtggcgagtaaatttgacggggtttgctggacaagtagactgagggatcttcttggttttgtcacaagtacatgtaggagccaggatagtaggataccttgatcgatcgactttcttcgctgtatatccagttactcttcccgtgtaggagtacgagagtagtagcctgtctcctggtcgaccaggagacccccatgaccaacccaggaggaggagcaacgttttgcgcgatagccaggtgaccaggtcacattcacatctctctttaccaaagctaagccaagtaaagaactttgtactactacttggtctaagtgctgtgccacgccttgccggtctcaataaaaggcgttggccgtacgcagctcgccatcgtcgccctttaaagtgcgccattgccgctccggtcgcggcccctccctttcccaaaagcaaacaagggataggtttgccgttcagcccccacccagagccagcggactgcacctcgcagt

SEQ ID NO: 7623 - DNA, 172 bp, Oryza sativa
cgacgcgtgtcggcaatcgcgtggggcggccggctggttccgacgtggcggtgcctcgggacgggtggacgcatcgggagaggtcggcgccatgtggagccagacggccgtgtcaccgagggagaggaggcgtgggcggcgcgtccgcctctccgctccctctgcttcgagg

SEQ ID NO: 7624 - DNA, 1501 bp, Oryza sativa
cgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcggcgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcggcggacgaggcggccggtcggtgaatacgtagacgcccaacaacggtggcataataggccagcgtgcaggcggaaacactagtcggcggcagacgaggctgccagtcggtgaagaggtagacgcccaacaacagcggcataataggccagccgtgtaggcggtgacaccagtcggcggcggcgaaagcaaaccggcggtgaaaatgtagacgcctgacaacggtgttgtgaccaaccaaccgtataggcgaagacaccagtcgacggcgacgacggcgagccggtggtgatgttctgactgatccattactggagcgtaagagataagcttaaagccatgaatcccttttatgcatatctggatttggatcctgcagaacaaacatataggatgagtagtatctgatgtaaatataatactcgagaaaaattcaagcagtttataaatacgtatttcttctcttgttaattttgatttccccgagcagatgactcattacgtttaaacactctgcccgactagccatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtggaaccaagccagtggtgtagatgatgaagcccattaacggcg

SEQ ID NO: 7625 - DNA, 1501 bp, Oryza sativa
tatacttggctctgtccctatatgcatactatctccgtttcatattatcgccgtgtttagttccaaaataattcttcaaacttccaacttttccatcacaacaaactttccaacacacacaaacttccaatttttccggatcaacaattgaatatatttttataatatatttgtcttggattgaaaattttacatcaaacttaaaatagtttaaatagtttactaaagtcaaaacgacttataattttatacgtaaataaggatggttggataacatagatacccattgattagtaactagtaccaaacatcacaaatcgaacgatggatcgaacagctagacataactgatactaactaatactagtagagctaattagagaaaaaagggccaggcgaatcatccatccatccagaataaggccagtgtccaatgttccagcagcagagctgggtgggctagctacttgtagcagcctgcttcttcgtcccagtcaccgacatggacgcggctgaagtcaatcttagcccattcttccttgatcagagcctggagcttggcccgcttggcgagcaggtaggcggcgctattcttgtcagcttcacggcagacctcggcgtgggacttgttgagctcgccgtcggagtactccttcgccgcgaggcgctcgtcggccggcgagagatgcttcacctcctccggggtggggcacgtctcctccatcttgagagccatgctggcgtcgatgagcggcaccttctgcccagcgaacgcgctgccgccctcagccgccatgagcttggcgatgcagtactgcagcttcgactaattcgcggcgcagcgattgggatttcgaggtcgtcgacggcgggtggggatcgtacgtgatgggaggtggcggcggcgtctcgatttgtaggcgagcaaaccctaaccaggtcggactcgggagcctggaggattgcgactctaatatgaaaaggagggagtccgaaactaaactcaacgttgactatgcatggccaataaaaagccattacgacatctactactcatctctttacccataataacgcattaacgcatttggcatttttgacctatcagttttttacaagtttcattattccaagacatgaagattgttatcgtcatgttgtgtggcatacacgatttgcttctacaacacaatgaaatttcacacaagcgaggaaaagatcagcattaaacgagaccagttctgtggatattatgggtaccccatacccatatggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctattttgtaatcctgccccccaccctatataaggtgggcaggaggccctctagggggca

SEQ ID NO: 7626 - DNA, 1064 bp, Oryza sativa
ctttatgaacattttcttcaccaccttgactaatactctctccgggttaataatatttagacagactaaaaatcattcgacagatttttcgtagaaaattagtcggattttcaagccacccccacgtgcggttcaaatgaaaacatatcaacgtacgtcagtcaccggacgttaatcacttcaatgatgctaaaagaaaaggaaaaacaagcaacttacacctatttacatcaacttacatatgtaattttaaaacttacagtgtaaatacattaaaattacatatgtaactttgggtacttgcaatgtaaaacttcttttatgaaaaatacaacggtatatatagtcccaaaaatatcaaatcacacctcaaacaattaagttaactacaatgcaacaaaacaacgatgagtaaatccgtacatgtaaaacaaaaactacacccgcatgtacttaaaaattacattgtatctgtagtgcacttacattttaatcgtggtataacaatggtgtgagtgggtgtagtgtaactgcattgaaagttttaaaaatgttaagtatagacataaagctgttgtccgctgcttgctcagttggtggagtgcatgttgtggcatcccgacgtcatgggtttgattcccttttctagcgacttttttttttcactcaatggcacatgcacgtatctcaaagtaaatcatgcggtcaacaaatcgactgatttttaatagaaaatctgtcgacagatacgtagcaattccataatatgggttattgttttgtaaaaggcacgatcttaaataaacaactttaaccattatttttcattataatatatataaaagtgttaacaaatatataaccttattaaagtactttttaagactactctatatacatatatttactatagttaccatatttaaaaaataaatattttaaaaataattcataattaaatactctaaagtttgatctcacgcttatccaaaacgacaagtattatctgaccgaaaaaaaaaccgtactatttgcttaaaatatttctcttttttaatggcaga

SEQ ID NO: 7627 - DNA, 1501 bp, Oryza sativa; identical to SEQ ID NO: 5626

SEQ ID NO: 7628 - DNA, 541 bp, Oryza sativa
acctcttgaatggaagtagagaatttgttctctggaaaattcggcgtgagcagaatatggtcagccattttttgctaataagcgtcggtgtgaggacctctctagtcgtgtttctatttcatatcttgtaagaaacaatattattcctgagtaatttattcccatttccccgaaaaaaaaaaggtcacctgtgacacgggccaaaaaggaacccgtcagatgtgaggtaaagtcacctgtgatgggccaaatatttgtgtgcccgtcaaagatgataaaaaaaatcgctctcataaccctcccctctcctcccagctccgaacccacgcccatcggtcttcttcttttttcttccgcctccacccgcgctctcccttcttccgcccctccctctttctcccttcttccgtgcgccgggatccaagccactgggcgccgatgcggctagatgccgccgggcgccggccagatgtggctagatgtggccgggcgtcagcgtctcatccccgagcgtcggcgtggcgagatccgacagacgagg

SEQ ID NO: 7629 - DNA, 1501 bp, Oryza sativa
ctaccttgcatatgggccacaaatgggttgagaaattgtggcatccaaaacaaccccaactgtattgttggacatgaatcgactcaactctagatttattttttcagaaatttttaacgaccatttgtagggatcaaggatgcaagaaggttagggagacaagtgtttaaaatcttaagatatttaactatttatcactctttgatgtaattcatcacctatacttatatgttataggcatatgagggttcacatgtcattgacatatggatacaaatagttaaagctaaatttaagagtggccaatagataaattccttatcttttttttcttgcttactagttactccctccatttcaaattaatctacatatatttttttgaggttatttctaaatgatctacatatttgtgtttattcattgagtctattcgttatttatgtattggagtaaatggacattgatgcatgcaagtatgcacacaagtatttataacctacatgcaatatcttgatttgctattggctaaaaaatagtggggatggtgcatgcatcgagtttgttgctagagtgcatatagtatgagagagttattagcttttcttgattttggtgtacttataaaatatgtagatcaattaggaatggagggaatatttttttattagcaagtgagtgataaaccatgaagcgggtttttatgctgacagtgaaattgcccccttatgttgctaactatcttacttttgtccagaagtaaaaattacttctattgtcccaaaatataacaatttatatcttaagtataacaacttctacaccaatattctctttctaaccaatcacaaacctccaccatttaattttttcacctagctctacttatcatccaatcataatacttttctatttaattttatctattttcttaataactatgtttaactctaaaaatgtttatattttgggacgaaaggagttaatgtactactccctccgtcctctaatataagggattttgatattttgcttgtattgttcgaccactcgtcttattaaaaaaattgtgcaaatataaaaaatgaaaagttgtgcttaaaatactttgggtaataaagtaagtcacaaataaaataaataataattctaatttttttgaataagataaataatcaaacagtataagtaaaatgttaaaatcacttatattaggggatggagggagtagtacattaacatcttcctaagatggcaaaatcctaaaaaaatggtaaaaaaaatgggaggaaaaagaaataggagaaagaaaaatggcaaagatgaagaactcggcctgccccttcattcccttccatccacttccaatccatccagcccaagtccatctcccacccttccaccactacccacatcgtctcgccgccgtcgccgccgccggcgtgacctccgccgcaaatccgcagcccccaccaccgccacccaaagctctcatcccgca

SEQ ID NO: 7630 - DNA, 231 bp, Oryza sativa
attcctgcagcccaactgtttgaaaagtcgaagattgaataatgatgatttttggactttcaagtttaggggcggggcagtagaggtaaatttatcaatttactactaggtctggtgatatggtcttaggtgatgttgatccatggtggcgcaatcgatcgattatttgaggcgacatgagtatagagctgggacttgggccgtgctttcttgggccggcccaaggcacga

SEQ ID NO: 7631 - DNA, 1501 bp, Oryza sativa
cccgtcccaatcgtgatagacatgatagggcagcaaccaactaatccaccgattctatctccttctaccttatccattctaccacatctctctcaaagcatgcatattgctgcacaagctccggtgtggcatggggtgtggatggtggaggacgcggtcaccggtgacgagttcccggcgtggcatggctatggacgacggaggatgcagcctccgggacaagctccggcgtggtgcagagcatggatagcgaaggacgtggtgtggggcgtggcggcggaggccgcgaccgccagcaacaagtctagtgtggggcgtggcagtgaaggacgaggctgccggtgacgacctccgacatagggcgtgaacgacggagaacgcggccgccggcgacgacctccgacgtgaggcgtggacgacagagaacatggccaccggcgacgaccttcgacatggggtgtagagggtggggccaccgacgacgacgcctcgatgctcagctcttgatacctagtaggaatcacctgatatctggtaggtatcatctaatacctcacaagtatcacccgatgcgtggtagaaatcatctgatacctgataggtaccacatgataccttatgagtatcaccagatacgtagtatgaatcgtctaatacttgataggtatcacttgataccggttatgtttcaggacatgatacctcagaggtatcgggacctgatacctaatcggtatcatcccgttcgaaaacgggattccgttgtatagcagccctcgagatataatgtttagacggtaagaataaataccacatactcttttttaaaaaataaaataccacatatggaacatcaaaggatcctcgctaggagcaagatcgagcattatggctcctctaatgaagtctctatctcttctctttttgtctctattttgcgatgtctctatctcttaatgtgtatcaaatggaatgactttgacttgaacagaaaactttgactgagctagctacgcacaaaagtttcatcaacttgctgacctcataagtggggcagaagctacaacttcttcattttttttcttttcaaggaagctacatgtggccgatcgcacggctctggttggttgagttacagctcacaagccatacaaaataaacaaaaaaaatcagaaatgatttatggatataatttttatgtatgcattatttgtgatttaaaacccaattctagaaaatataccaagatgagaaaaaaaatataatcaactttaaaattagagcaattttatattacttgagaagatactctaaggttccactttttctattatatatttggcacctcttggtacctaggtaccactaaatttttggtacctcatgatacctccttaagaaccgtaaaattactcttaaaattaagtttcaaaaatttaaattttggtagcggtaaaaaaattcagcaattagattattacattatgttaaccaaaaaatt

SEQ ID NO: 7632 - DNA, 1501 bp, Oryza sativa
ttcattatcattactttcgctattgcatatttatctacatcaatcgactctctctccatcaaaacaaattggatacatgttaattgacgtacggtagacatgggagcttctctgacagcgcgatgctcaacaacatcattgggctcctcctgcatagcacgaagccactggcacgcctatccgtccacgcgacatcctatgcctcgcaatgcgcattgacggctcgtgcttaccatcgtcgtgccttgctacctcagtgggaacctccgcatgtcctgcatcctcccggcgctcttcccctctctcgccgcacatggccgccacgcctgttcgcctccacacccgcgaggccgtgctagacgtgagttcgccgagtagtgagtactagtccacctatgcgatgaagttgccccgggttaggccaggcatccaccgctaccgtcgtgatttgctcgcctctgcaatttcgcccaccgaccgggagcccgggatgagacaaagagcaagagggaggtaggagaggaaggagtgggccctactatgttctttttattttttttactataatgccacacatgcaacacgtcagtaccaaagtaagtcagcctactaagtaggcaccacatagaatgaaaccattatctaaaccgttgaaggatgcgattcaatcaggtgtaaggtaagagggagattcacaaataggcttaaataaatgtgttctccttattttggcttttcctatttaaatgtttgatgtgttctattttatttgaactacactcttatctcgagtgttactttgtaataattggttgtagcttttcttgagcaaaggttgagatattatattccattattaaaaaagagagagagagaaaaatagacttattcctttttattcctttttagattcttaagccgaactatcatccgttgatgtttgcattggacttttctctatataagccgcgtaacatgaggcccagtaaccgaaagttggctgatgttgtttcgttgaacagctcagcccactccaacctaaacggccgctccctccactgctgttgaaagcgccacgacgcgccgcgccgcgccccgccccgctggcgactgcttctgtcgcgctcgcgcgcagagtcgcctccccggagcaagcgttgatcggctcaaacctccgccgaggcgagagggcagcaaagcgaaaccccgaacattttcaaacgcggcgccaaagcgaggaccgtttcggatcccgacccgatgcggtgcacgcgccgtggtcaccggtacaatcgtactgtagtacagccggtccaccgatcccgatgctctcagcctcaccagtcaccaccaccaacccttccacggctagaaattttgcagtctactactgccaccaccagctgtccagttcaccaccacgacccggtcgcctcctcccgcccgtttaaatacgcagcagctcaagctgcctcccccgcacgcttcatccacagatccc

SEQ ID NO: 7633 - DNA, 1501 bp, Oryza sativa
aaaaatattaataagcgaaaactctgttagcatccaataaccaaccacagtaattttcttttttcttggaacagtaattttctgttaatacggtgcttctgcagtttggtgaatactgacaactgaaattatgaataacccgaatatcttcctcaattaatgcaaccttttgttcaaaaacctaaatagagcagcttcgagcaagttatcttcagctttgcccattttctatctcatatttaaaaactcaaaaatatctaaaactttgaactatctttaaaaaactaagcaaatatagaataaaaccaacgtatgatatatatattcatagccatacccatatatattatcatcatgtagggtgaattaatggtggcatagcggcactggatgaaaatcctctacccttgaaatcacgtgactttttcaatgatatgtgggcttgataaaccatgaacccatgacagtgacaaaggtatgataactttgaaagtagatgatctcaatacaaggtaaggtgctaaccttgttgaactcgagcacgtcggacttgaaccggacgcggtcgcccttgtcgcacctcacgtcggccggcacgtcggcgatcaccccgactcccggcacggtgagcggcgtcgtctcgccgcgcctctcgaccaggcagccggcgccgccgcccttgcagtacttgagcctcaggtcgccggccatgtcgaagccgcggccgaggcacctcaccgccttctcggccgccgccacggcggccatggatgatagctctctctttggtggctggctagttgactacgaccagacatgctgccattgcagcttcatgtccaggaaactgaaggagcatgatggttttaggcagaggctatatataataaggatgtcaaggatctttttttttttttggtttcctggtgtgaaactaagatatgtagctatcaatcatgaaatcaagcaagaatgaatctgtatttttttagttgagataacaaggctgcttcttgatgtttgaatggcgacttcatcagatcagcgggtagttgattgtatgtataatatgcagggagaaatgggcatgggaacggacttagtggaatggtggtggcaaccaacgtttcagtggttgactcgtagtttttcttgtatttttttactctgggctcttccaggggaaaaaagttaccttattttggatccctcggaggtaatttgaatagtttcatccattgtttttggcaccccaaaattatctcgacttaatgtgaactcattagtatacatgtgtcatgtgcgaaaatgatagaccatcttgtcgtagtcaagattataggtgtgcgattttaataggaatttataaggtacaagatccttttatcttcggtgtgtacgttagggggctctcgtatcaaaatttattgagaaaggggcgaaactcgaacctagatcgactaattcataccttaacagtactaggcagaagacaagcctt

SEQ ID NO: 7634 - DNA, 1501 bp, Oryza sativa
agatcgattcggttgttgtcatgctcttttacactttttggtggttgggggagtggaattggcaagcgtggagaagggcaggtggtggagaaagatgaggaagtctggtaatgtacgttcatgatgtgtttttgtggaaattgtgctcgtctaatttgatcgatccttttagtttttttctccatgcttctgtcactgcattgcatgataatttggcttttgaaaggggggaaaaaggaatgctctaattttggggaatcaagaacatgtggtaaatatgtatagtccagagtatagaaatggatagatgatagggatacccagggcggagccaggattttgagccactgggtcatggcttttacttgtactaatgtcgtgtttaaaactctaattgttctcgaagctagatatctttagatcaaaattattttggagctagagcaatgaggaagttgggatcgtttcattttgttaaaaataaatgtttaaactctatattttataattattttataagaatgcaggaggttttttaaggtccaaaaatttaaaagttaagactataaaaccaggcataacaaccatgcgttttttcagacataaaagtttgttctgaaagttgtttattacttcctctatctcaaaatacaactacctactctcttttttaaaagattaatgttagggtgtgaaatagttatgattggttgaaaaaagaaagtaggtgaaaaaattgaattgggaaaattgtgattggttgagatggaacggtacatagaaaattagttgtattttaagataattttgaacattaaatgtaacatattttgagacggagttagtagcttaaaaaacacagctaacatctagtagttgattagcaaaactacaggcctaatgcattgatatacacaacacatagctaaaacaaagagttggttaatggatgaaataggtctaattgccgcattagtagtgggttgacagtagcataacctagctaacaaattgtgcttccaaagaagaagctgtactatttcagctttcatgagctccagtagtttagcgacctgatcggggtcatgaagcttttgctgctggggtcattagctgcaaaatcctgcacgattcacttgatcgattgaataccatcggggtcacctgaccctgacgatattactgcagctccgcccttggggatacctgatttacaaaaaggaatctggcatgtgcaatagttagtatcagggaatagtttacaaaggaagcatggagatggttcgcatgatcattgttttgcttgtattctttgatacattacagtaccttgtttacttcactactttaagattatgatagaaacaggataaaatttagcttttaagttctttctgtagacgatacttaccattctgccgtaaatctaaagagctgtgcgtaattcttaacaataattgtttatattgatgagttcctgcagttgtgatatgcgccatgg

SEQ ID NO: 7635 - DNA, 1369 bp, Oryza sativa
tttcaaattgtcgaaaagcataatgttgttttattgaactaaaatatggtttatttttttcctttgttaacaaattatcactaatccaagctcttcacatcatctcagggcctctctcccgtatttcaccacacacaccgatttggtacatcggcaaagggaggcgatcaaccagaggaaggctattaggaagggcctggaatcagacaaggactggaccggtgatggattcgtcaaggagacagaaagcatggtgtccaactgattcgactctgaactcacacccccttccaccatacttccaacttgtgattaaacagggaccatgttcagcccaaaacagcagaaacttttgcatcatctcgttcaaataaaaagcataccaaattacttccatcatgttgtcctgtgcttgtccattgcaatcctaatctgtgcatttttgagtcataaacttcgggtcctgaatctggaccaggtcagtagttcagaagtcgttttctacacttgatgatttgtagcaaacatgccgtgctcataaactgttccatgtgaacataaagtcagggtcactgagctttgggatatctggacttgaccttgtaaagcctcaagacttcaagtctctgctggaccgtgtgcctgagtaaagtgtgagcaaacgatggcatcagcatctggtcagattgagccgtacatgtctctaatccttcacacctgccgttttgtacctgagattcatgctacaattatctgtggcgcacactgtcagaaatttcagcatcgatcaatcagaaatccgctgatgaagaaggactttttcttattacttcttctatcctaaaatagaaatttcagcatcgatcaatcagaaatccgctgatggaggactttttcttattacttcttctgtcctaaaatataaagtttctaaataaatatatcaaaatataagcatttttaactactactatgaatctaaacataaacatgtttatataagtatgtctaggtaaataaaccagaagttatattttaaaacaaagtgagtattacaagaaaaacattttagtatgtctgacgggggaagttggaagtttagaccatggtattcatgggagaacatgaactcaatttttctccgtttacataaaactgcattgaagtggtaagtagtagcataattcggatacgttaaattgtaatcgcatggtttcaatttcacaaattttaatggtatttttcaaaacggacaaatttatagtgacatggatccaattaatatatatatatatatatatatatatatatatatatatatatatatatatatatatatatatatatatatatatatatatatatagga

SEQ ID NO: 7636 - DNA, 942 bp, Oryza sativa
ttcctgcagcccgaatcttttgacttaggatcggcatatcttcgtttgcttctctaatcgatcacacgaccacctaacctgtgtgccagtgtcaggcaggtagaggactactggttttatctccttggcttcgaaatgcaatcgggacgtatagagctgcttgatctgacatccacaattattgacgcctgttcactttgatatcattttcaaccttatcaaattttggtaaagttacaaaaaaaagtggctacatttagtttcttgccaaattttggtaactatataagaaatcctgccaaatgctaaaatttagtaaggtttttttggcatcaaagtaaacatgtccttggtttgttggttgcaacgaaaaaggatccgaaaaatcatatatcgttgaattgatcagcgttagacggtgagaagcctgactaaggcccagtttagttacaaagtttttttttctaaactttcaacttttcatcacatcgaacctttaatacacacaacttttctatcacatcgtatcaatttcaaccaaactttcaaacttcagtgtgaactcaacacaacctaagaaaaaaaccccagcattgcatgtagcatgcgtatgtactacaactactaccctactactatgtcatcccctctatccttagaatcatgacttcagcttagaggtgccgtcaattatggtcgaaatgggcggtgctggtcctaccactcagacttgtttcattgacaactttcgtcatattgcattttaatacattctataaaatttacaaaaatttgtgatcaaaggagtatttgggagatgctattgaagggagtagttgtcatggccagatcacacgcatgtgttcgtatcccagctcctgctatttctacctcatttgatccattccatacctggccacctggggcatgcttaactggtga

SEQ ID NO: 7637 - DNA, 1110 bp, Oryza sativa
aaaaggttgcgctgcccactgctgtcgttttattttcgttgctttcaacaggagaaagattgaaaaaaagccatgctgtgcatgggatcttctttttctgcctgggcaaaaaaaggtgcatctggcaggctagcttcagttgtaagtgatggtaagaacaatacagtatgaaaagaactaaacgtaaagatataattattgggtgcttatttaagcgtagaagaatcggccagcgcaaacttgtgtgcccagccataaggctgcctattcatcccactggagcattatcaaatgcaaacatcgaaagtaattaccgtatcattggattccggctgcctttctctatgcttcaaggcttgtagacgtgttaaggttcctgcctgtacaaatgcatcgagtggttggtagaatatgttcctatggacaacggggttgatccaagtaatcggttctgatcaagctaagttacccccactcagtcccggcctcccggggatcgattttctgtgaaaagtagcagtaattactcttgagagacagagtatccaaaggcacttagaacatcatgccgatataattcgcctgtaggaccaccagggagcatgagatcgtggcgagtaaatttgacggggtttgctggacaagtagactgagggatcttcttggttttgtcacaagtacatgtaggagccaggatagtaggataccttgatcgatcgactttcttcgctgtatatccagttactcttcccgtgtaggagtacgagagtagtagactgtctcctggtcgaccaggagacccccatgaccaacccaggaggaggagcaacgttttgcgcgatagccaggtgaccaggtcacattcacatctctctttaccaaagctaagccaagtaaagaactttgtactactacttggtctaagtgctgtgccacgccttgccggtctcaataaaaggcgttggccgtacgcagctcgccatcgtcgccctttaaagtgcgccattgccgctccggtcgcggcccctccctttcccaaaagcaaacaagggataggtttgccgttcagcccccacccagagccagcggactgcacctcgcagtccggca

SEQ ID NO: 7638 - DNA, 1171 bp, Oryza sativa
acccgtactacagactagagtgtggccccaatgcgtttcgcaggacaggacgggcgaaagaaatcaaaaggccgacatgccaccgacatttccccccacgaaagctatcatcagctatcatcaaagcgaaggaaagaaagaaaaataaaaggaaaagaactggctggaaattagagaagccccggacgactcgatctgggggtggcaaattaatcagtgtgatcaacagggataacttatcccgtccgaccaaatccaccaaccaaaccaagacccgatttgttaggctgtgaaagacggatcagtgggaccctgatctacggaccccatatgtcaccgtccaggtctctggatctctcccgtcgtcctaatcagacaccgcgcgcgcggtgccgtcgctctcgagccgtgtcccgctcccaactcgtcacaaaagcgatcacagactcttccttcctctgctgggagagaagaaaaattggccgcgatgatgccgataaagaggaaaaagggatgagaatccgatggaaaaaaactgatgttaatctatcgctactgctgcgcactaagacgaatcgtatccgaacaagaaacgcttacgttactgttcctaaatggatcgctccgctcatcacttaaccaaaaatcgattaggaaattgacggacagcgacgcccgaagccaagtgtctcgtcgcgtaggcgtcgaggcctcgaagcagagggagcggagaggcggacgcgccgcccacgcctcctctccctcggtgacacggccgtctggctccacatggcgccgacctctcccgatgcgtccacccgtcccgaggcaccgccacgtcggaaccagccggccgccccacgcgattgccgacacgcgtcgcggcgccactggctcacccgctgcctgcctctgcctgccccccatctcgtcgccatttcccgcccacgcttcttgtcctcgcgtcgcctacgcgtacgtacgatacaaacgccgcacctttcgatcccctccgctatataaggagggcatctgcctcgccaccttcttcatccgaaagcaaaagcgactcgtcacagctcaaacaagtcaagagcgaatagttcttgctgatctgttgtttgattactttagttctcgagaggctttagctgaatccatcgatcgatca

SEQ ID NO: 7639 - DNA, 288 bp, Oryza sativa
tggtgtagtatatacttataagtaactattgtatgaatgagctattagattggctataaataaattgaagctagtagttggctatactattaaacttgctctaatagttagtattattatggggaatgtgtaagccacgagcacggagtagcgcttgcatttttgttgtatatctcgaggatcacaatattcttcaacctctgtcagctcttaacatgggattcaggcgcagccccccaccgttcctcgccgtggctaacaaaaccagcaacccattgttcagggggc

SEQ ID NO: 7640 - DNA, 552 bp, Oryza sativa
cccctattgaatcctacaatatttctaagaaatgcctctatctgtatatattttggaggaattttaaatatgagattgaaccccaaggaaagtttcctttgatctcctctaattcatatatgttttcttgctgtctaatcaagcaattattcctaaatttttcctatattttatttatagttctatattttacacttacaattttattttctatttctctgtttttttatcatgcgtttcatgtttcaaaggagataataaaagttccctgaaaacgcattaaacggctcattatgttttagtatatttttcgcaacatcatattcgcaaatgacccttaactaagcaattaattcggtagtactacatcactacatcctaaatatatgccacagttgaatatcgctcgcgcggtggaaggcgtgattctcgttcgcgtgaagcaattgatgtatgctcaacgagttcccaatggttttcttcttggtctttaaaaagaaaatcaagagattttctcgctaaacacgccgtgttactcccgaactttccagc

SEQ ID NO: 7641 - DNA, 1501 bp, Oryza sativa
actataccacacttctcaaattctctcagtaccaagttggtatcgccaggtaaaaaactggaaggacaaagacaggggcaacattatcaaagtgaattatgtaaaacagtgtaatcaaatatgcaccaagtcaggggaactattcgagatagagtaagacgaggacaaacctaagtacaacaatgagaatcatattctattgaaagctaaattaagggaacaatatgtacagagcgaatgcatggtcatatgaatacattcatgacgattcccccaaaagaaagaatagcatcaggatgctgtttctgactgtctagtgcacgtgaaattatatattaattcatcccaagaaaaaggtttgctaaactatttaactagatttttgggatctccttttccaacttcctacactcaaaaccttaaaattttccaattactgaaatgaatcacgatctctattctctacttcagcatatcgattcaactacaacagaaacatcaagacaacatagcatccaatcacatactcactgatcaacttagacaatcatcgttttgcagtactatgtagatttaattgaaatatggcataacacatactcaactatatgaacccaatgccacaaatttcatcaaacttatactagtttataacttaatcatcctactatcataacagtaagaggagaggccacatacccaaaaacggtgacccactcctcctcgtcgacacggccagcggaaggtgtcgaatccttcggcatctccggccgcgcaacttccctgggtggcggcagcgtgatgagcgtcaccttctgctgctgcgactgctgcccagacgccgtcgtcggagacggctgctgctgcggctgcacgacaccatcgaccggcgagccctccctggccatctcctccctcgaggaggaccaccacgcggccggggagggggacccattggagcgcagcggggtggaggagaagaggccgccgcggtggggagggggaggcgaggggctcatggccgccgcctgaggtggggtggcgggcctcggcgagggggagtggtgggagaggtcgtcgaggaacagcagcggcggcggcggcggcggcggggtggtggaaccttgcgtctcgcggcggagggaggccgggggcagccgcacggccgaggagatcggcgacgagaggtcccggagaaacggcgggtggtgccgccggtgatccggcctggatgcgctcatctctgatccggcggcgacggcgacggcgagcggcggcggcggcggcgagaaaccctagtggagaagcgagtgcccgttcgtgtcagtgactcgtgtgcgtggcctttgggtttatcaaggatagatgggcccacctgtcagtgggacaacagaagtctgaccagaaagcgtaaattcgtcaatacgtaagctcgcttcggaggcgtagttatcaataggacaatgaaatcctgctagaaggcgtagagttagaatacgtt

SEQ ID NO: 7642 - DNA, 1007 bp, Oryza sativa
ccactgcctaatcttcttctctagtgccgaccgaacgtcaccgctgccactttgatttgggaactttcacctcggggagttctagtccaattccttcccatgggagaatcaaaatttcccatgctcttcttctctagttgaggagatattagccactgcctaatcttcttctctagtgccgaccgaacgtcaccgctgccactttgatttgggaactttcacctcggggagttctagtccaattccttccatgggagaatcaaaatttcacatgctttggtttcaatctgcaacgtttggagttccgccatcagacaaattccacccgccgccaccttgccggtagcctcaaccagtgagctcctttttctggatgtgcttatcacttgttccagtgtggcaactagcacttcccacgtccttgccatgaccagcgatgttgtggttcgtctagccgcccaagcgctggtgtattttaagaaccgctggtgtattttactccagaataaacaaaccattccagagatttctcaactcccaaaacaattattccatgtttccataaattgcaatgcaataattacccaaaaatgaatttcttttggaacaaacgaaagagaccagaaataaatttatttcgggacagaaggggtattaattaaactgctgtagacggccggtcacactatctttatgctgagtcatgtgaacaggatgacccacagaaatcctcttgaataaagtgtttaataatttattatgtgtatgtgtatggctaggatacagccgtgcacgctgccaaagcatcacactagagttgctgctataactgattgtacctaacaaccatcagtaccaacaatagtgtcggtggcagtttcaataaaccatagagtcactgatataattatatgaacagatagtgtcggtggtggtttcaatcaacaatcgtcacctatataatctatatatccccaacgtttgcatcacaaaaacttttagagctc

SEQ ID NO: 7643 - DNA, 1501 bp, Oryza sativa
catgtatagatagaatatctttaaagggacttgggttaaattccaaacttgtatgtcaaggaaatacccgggatcctagtcggttaggattgaatcttatctgtaactacctattccgttagggatatggactgtattttgtaatacgaatcccttcccctatataaggaggtgtccgggtgccttttggggcacgtttttctcccagatcatacgatcaataatacactcggcggatcaatccccgggcaggagtagggtattacttcttgattaagaaggcctgaacctgtataaaattctttgtctttcaacccatccacttttccagcttgatagtcacccccttttagtattgctgaaatcttgtttcgacaagaggtgggttgtggtattttttttctaaagataaggaccaccgacttattagaatgtgacaattaaaaagtgtccatagaaataccacgtgatgggttagtagtgtttatagaaagtttagtggacttttagtatataagagatattatctttatctttacctatatattataaaagtttaagatgtttttgtcaagtattttcgtacgttgcgcaatctgattcgctcaccgtgcgtgttttttgcgatgtttccgctatttttccgtccgattccctccctattataaaattttaatcgggcatatctacaagaactaagagaaccctgaaaaaattatccaatcagactgaactacatgttctagaaggggagaacaaggaaagaatccaatcgagcggttccaattgaacacagataaacgatggagaaccctagcgaaagaagaaataggaggaagaaaaatcacacaaattgtaggcgtggaaaatatcgttgaacggcggttcttctcataggccatgcgttcacctcttgaaacaggtgccatgggacagtacagaggcgaaggcgaccacctcctgccgcaccctaccctccccaaataccgcatgtcgatcggctttgaccggcacaacaacatggaggaggaggggctgatgtcgatggctagggggagggacgattgacggcggcgtggcgcgtggatgatgaagaaggagaagaatgttggcgcggcagcggcatgatgcaaggaggatgccatcgtcctggcgagcgcggtgtgaaagagaagcggcgcagcactggtgcggggtgtgccggtgcggctgaggaatgagatggagaaggctgaaaaggggagttggattagggttttgctaatgttgggcctggtgggctgctcgggcctccctcccacacatcatccattatatgttgggttaattgcatatatgccattaaaattttaccaattttgaaatatgccaccagcattcgtgtatttgaaaccatgccattataattttacatatgtttgagccagatatgccactgcttaccccttagatgcatttccaataaattttggaccaaattgcccttctctcttcttcttct

SEQ ID NO: 7644 - DNA, 610 bp, Oryza sativa
gaattcctgcagccctttttttattttcaatccatggcaagcgaataagcaatataccccaaatcatgtacccatacccagtagacatgacaactaacaaaaagagctgaaagtattttatgaatgagatttttagcttatagtgatgacatgatattggtgtcagagtataggtgaggcatgcaggtgcagggggactttgggaggcatagaagcaagtcaacttgtaccaagcaaacaagcatgcatacgcagccctatatagaaacggagtggagtaggtacatcttacagctgcattagtacataatggactgactcatccctggtgcaatgtgcatacgtgtcagccatatgaggtgggtacatatgaaccttggttcacttggttcatattatgcagctcctatatacacctaggtgtatgtactccctctcccatctaccgtccatcacaactagcctctcgatgaagtttgttaccggatccaccaggcagaccccttttaatttttcacgagaaaaaattttgcgtagtaattggaaaacaggaacactcggagctcgcgtataaatacctctcgtcagcctagatcgataaaccaggtca

SEQ ID NO: 7645 - DNA, 211 bp, Oryza sativa
agctccgatttctggactaattatgattggatgatcgaaaatgatgtacctctgagttgaatgatcaattgagctctctgaaaataaggatactgttgtttttgctttggaaaactctatgaatcatactgctcaatctatgtatggaactggagtatgtcttttcatggggttgtggattagaatgctggacattttttgaaagcatttt

SEQ ID NO: 7646 - DNA, 1363 bp, Oryza sativa
gctcaaattataataagctacatcgtgtgctaaaataatttatctttgttattaaggattcgtgtgagaaagctattttgttttctgtagcaagtttaggaatgtaatgtaatgtaatgaagcggcaggacgactgccatttgattaagaaaagactcgcgcttgtttgtagcccaaaacatgtgtgtaaattacggcatatcactgctgaacttaaattcgtgcttggatatgcccgtaccacactaaatttacaccgaaatatgtttcaacgaagtacctttctttgcatggttaaacataatgtactctgccgcctattaatgagcttgattcatggtcgaaaacacatgttacctatgtatttttatcactcaatggctcaaatgattgagaaaacttttttgggtatatgttatagttccttctttcatatgtttgtcagagtttctcatgttgtatatgcgtgtgatctgctgctgttatctttgacaagggaaaggttttagcatttacccaaatgggaatttcacttgtatatatattatcgtatgaaccaaaaaaaaaagataaatggtattcccgttgagccaaaaattagaaggataatttgtttgcaagggtcagggcggagctaagaacccggtttcaaaaaaaattttacctatagtttatctattttcaccatatatatataccttgtcagtttaaacttaagcacccgtatcaagctaaattttattcaaaccagagtaaagcaagcgagtggaacccccttcattttgttctagctccgctcctggcaagggtataaaggaaatatcatactcggatactcgcaggcagaccctcgaggaaaaagcatagattatatcaatttgatgcccttccttttctcggacaaatccttttcaaggttagatggaatcttcttttatttatcgggtttgcttcaacctatatttgtgagaggtccctgttgagtttgcggttcaatggtatcttctatagtcaacctcgccctcaccgtcatcaccgtcagcttcatcgtcttggtcatcggattggaagaataagtgaagcactatcgcctagggatggcaatttcccccgcgggggaccctgccgctacggaggtgggggtgggtggattttctgacccaaggagtcggggccggggcctgcaattgggcgggggaggtaattcacccgcggggcttcgaggggtgcatattagacttttaaatgtagtgccaaccctgaacaccagcacaaaatgtcatatggcccattaggcccaggaaaaccctaaccctacccaccgcatcgctcctctcctcactcccagccgccggcgccaatg

SEQ ID NO: 7647 - DNA, 1501 bp, Oryza sativa
acagagatatagaccaagaaatacctctcagagtttctctcgacgtgcgtctcagagacgctctcagcttgtgtgctgtgccggtgcgccgccgccacgcctctgcgacgctgcgccgccgccgcgccgccgcgggcgctgtcccgccgcgcctctgcaccgccggaagagaggggaaaggaggggacaggacggtggagagggcgaccggagaggagggacgtgctgccgcagtgccgctgccgcctgctggggaggggcgcacgcgtacaacgctgttgccgtgttgagctagcggctagccgctaggggcattggcgccggcggctgggagtgaggagaggagcgatgcggtgggtagggttagggttttcctgggcctaatgggccatatgacattttgtgctggtgttcagggttggcactacatttaaaagtctaatatgcacccctcgaagccccgcgggtgaattacctcccccgcccaattgcaggccccggccccgactccttgggtcagaaaatccacccacccccacctccgtagcggcagggtcccccgcgggggaaattgccatccctaggcgatagtgcttcacttattcttccaatccgatgaccaagacgatgaagctgacggtgatgacggtgagggcgaggttgactatagaagataccattgaaccgcaaactcaacagggacctctcacaaatataggttgaagcaaacccgataaataaaagaagattccatctaaccttgaaaaggatttgtccgagaaaaggaagggcatcaaattgatataatctatgctttttcctcgagggtctgcctgcgagtatccgagtatgatatttcctttatacccttgccaggagcggagctagaacaaaatgaagggggttccactcgcttgctttactctggtttgaataaaatttagcttgatacgggtgcttaagtttaaactgacaaggtatatatatatggtgaaaatagataaactataggtaaaattttttttgaaaccgggttcttagctccgccctgacccttgcaaacaaattatccttctaatttttggctcaacgggaataccatttatcttttttttttggttcatacgataatatatatacaagtgaaattcccatttgggtaaatgctaaaacctttcccttgtcaaagataacagcagcagatcacacgcatatacaacatgagaaactctgacaaacatatgaaagaaggaactataacatatacccaaaaaagttttctcaatcatttgagccattgagtgataaaaatacataggtaacatgtgttttcgaccatgaatcaagctcattaataggcggcagagtacattatgtttaaccatgcaaagaaaggtacttcgttgaaacatatttcggtgtaaatttagtgtggtacgggcatatccaagcacgaatttaagttcagcagtgatatgccgtaatttacacacatgttttg

SEQ ID NO: 7648 - DNA, 688 bp, Oryza sativa
attcctgcagcccttgaacatttgaacacctgcatgaagtattaaatatagactaaaaaataactaattatacatattacgactaatttgcgagacgaatcttttaagcataattgctccatgatttgacaatatggtgctacagtaaatatgtgctaatgacggattaattaggcttaataaattcgtctcacgtttactgacggattctgtaattggtttttttattaaatgcccaaacaccccatacaacactctatataatacccaatgcgacgtgccaaaactttagacacctggatctaaacaccactctgttccttctcctctataaatggcaccggggtggtttgtcggcaccaaaggcagaaaagaaagccaatggcgtcttcaggcctcgcagttgcagcaacagcctcgtcagcctggctctgctgccccaatcatcacatccataccagcagcagcagatctcgcaagcatcttcttctccatggcctgtacgggtctgcacctgcacgtactaggtatagtagctgcaactttattcacaatgtgatgtcacgttattatatatgtttcgtcgtcaatggcggcgaaccttgcaggggacgacggccgccggtgtggactgcggcggcggccaccgcagcagcgccggcggacacggcggcgtcggcgcggcggg

SEQ ID NO: 7649 - DNA, 295 bp, Oryza sativa
ccaaagttcgatcgatggtagctcgtccatggtcgaacccatccattccagaaggtcggacctgtcagagcaccgtggcaccccgtgcgacgacgcgactgtggtctgtgggcccccaccctctcaaaaccctcacgccactgacatctgggccccaccccctacttttctctcccccctcgctctcccatccacgcgcgcggagtgggacccaccacccaggcgttcgcccttatcgttgcgcgagcccttcttcttcctcctctctctctctctctctctctctctctcgcca

SEQ ID NO: 7650 - DNA, 1039 bp, Oryza sativa
cacccattaactcttcagcatatgtttgactgtttgttttattcaaaaaattttgtgaaatatgtaaaactatatgtatacatataagtatatttaacaatgaatcaaatgataaaaaaattaataattaattaaactttttgaataagacgaacggtcaaacatatttaaaaataagtcaaccgcgtcaaatatttagaaacggagggggtagtatactagaatccattagttcattctctcttatttactttatttactttttgaacacttggcaaaaatatacatcaagttctatataagtacagtataacactagctagattttgcaacgtaacggtgccacatgcatggtgcgcggttagtgcattgctgatgaacacttgtggccagttccataaatacctaccatgcagcatgcaaaaaaaggagagtttgtgttcgactttagctataagccgtatagtactagcagctttcctcggcatagctaagctaatgcatatgcagccctatttaattatgcacaaagattccttctccgtacatgctcccaatctaagcttatcttaactccattaaatatatcctagttatgcacaacatatgctataaatagcaaaggattagtgggtgtgattacctcatagcaatccccacactagctagctagtataacactcctcattaagctcatcactagctagcttagcttaacttgcactgtgatttgcttcagagctaatactagctaaccttgccaaaaaaatgtcctcctctaagctgaatctcatcttcgtccttgggatcatcttcttcctttcctccgacatgatcatcgtgtgctcacagggaagacctctcattgcggaggcggcggcggcggcggcggcgcagcagcagagacacctgctatcgtcgtcgtcgtcggcaccgcgttccggcggcgacgtcgaagaagctgccgccggcggcggcaaggggacgacgacggcgatgacccagggcacgctctcgcccgacgccgccgagagcggcg

SEQ ID NO: 7651 - DNA, 597 bp, Oryza sativa
  unsure (1)..(597): unsure at all n locations
tcaggtcgggggcggggggggggngggggggctgagtttgggtggatgggtgaacttgctagcttaagattgctgttgggcgagtttggcatcacaagttccaattgaacgtttaccaggagctcgaaatgtttcaaattgggaccattgtttggtttgagtcgctacttcgatgtttcagggggaatgaatttatcatttgtagcgtatgaacaaccatgtgtaacttcaaattttgtgcactacaattacaaggaaacggtgttctgtttttgttgtaacttgtaatataaggtgtgtagtgaagcaattaggattgaacctgctagcagtgtacttataatgcaagcaatcggtggaacatgtactgttgtcataagttgtgaggcatcgaatcgaatttgtactttgcagagtcattgttgtgcggttccgtgtacctgttgagttgggaagctctgatctttacaatgaagtttaaatttttcagtacgcccgaggtttagttattgtgttgataataacatggactagatggatttgatagtattgagtcatcaggtttaatggttctgcttcagcaatgtgttatgtgct

SEQ ID NO: 7652 - DNA, 524 bp, Oryza sativa
taaaagaagtcgttttggatagcgacacgatctccaagacacaactttaacttcttgtttctataaaaatatttattgaaaagtgatatatgtgtacttttatgaaagtatttttcaagacaaatctatttatataaaatttatattttcaaactcaacaacttgagagttatcatgatttatattcccaaggtttgacttaaacattgtcctaaacaacttcctttacaagtacggagggagcatgtataatatatcacggtgaaagtctttataataggagcacatctcaaccgttggatcgggcgcaagcaaacggtcaggatcagatgaagggagcaaacgagcgagaaacccagcccccaaggcccggcccatcactgaaaggcaaggagaggcccaaagcaacaaaacctaaccaaagcaaacccctccctccttgcggcgtccctctctctttctcacccaaccccaactctacacgcacgcggcgacagcgagagagatgagcaccggcggcggcg

SEQ ID NO: 7653 - DNA, 1240 bp, Oryza sativa
tgcgctcgtagctcgataccctgaactctagatctgcaatcttcgactcggtatctctcttgctcctcatccgactcctgtacatgtgcatgtcctccttgaacccaatcttccaaggaatcacccctttccctcgtgttcgtcctggatgctctggagtctgcagggcgagtgacagctcgtccctctctctgtctggtcggaacgtgccctgagaagaggcttccactgcgtctgttagtcgacgcgcagcatctcgtatctgatcgccgaagtccagtgagccatcagctgggttgagcgttccaccgtgagcatagtaccagaacttcgatcgttccggccaattagcggtggccggttcgataccactctcaagcaagctagcatccatctcctcccacttcggcatcacgacgctatagccgcctgaccccaagtggtgatggtacttcttcttggcagcattttctttgtttctttccatcatcgcctgcccttgttcacctgtcttatatgcaacgaactcgtcccattgatcccttagttttgggaatgtgtcgaagttcggtgtctgccccttcaggatatatatctggtacagatctcccttgaagttctgaaactgttctgccattttcttcagagtccaccttttcactttgtcctctgtacccgcgggaagggtgaatgtctcgagcattgtggtccacagcatctctttctccaaatctgggacaaagctctcatgatctccgcgtgcccttgttcttcgctagtacaccgtactgacaggcacgttatcccacacaacccaaccgctgtgacgtacatagttcttggcggcttctgccggggcactaggtcgtccatcttcttccacttccgttatgatgtgccgaccctcaagcttcttcgcggcacctcgttgcccgcgtgccctcttctgtccaacggagggttgacttccactagcctcctcctcctggttcccctccacatccctttccacgtgcccctcctggttcccctccgcatccctctccacgttcccttcctcgttcaaatactggtttggatcctcgttcccctcttcttcgttccagtactggctgcttccctccgcgattgtatcgtacaatatctgttcctcatcgcgatcagccatctgttcatacaggaaacatctgctaagtcatgagacatttatgttttaacaatcttatattaaaactcaaat

SEQ ID NO: 7654 - DNA, 717 bp, Oryza sativa
tgcgctcgtagctcgataccctgaactctagatctgcaatcttcgactcggtatctctcttgctcctcatccgactcctgtacatgtgcatgtcctccttgaacccaatcttccaaggaatcacccctttccctcgtgttcgtcctggatgctctggagtctgcagggcgagtgacagctcgtccctctctctgtctggtcggaacgtgccctgagaagaggcttccactgcgtctgttagtcgacgcgcagcatctcgtatctgatcgccgaagtccagtgagccatcagctgggttgagcgttccaccgtgagcatagtaccagaacttcgatcgttccggccaattagcggtggccggttcgataccactctcaagcaagctagcatccatctcctcccacttcggcatcacgacgctatagccgcctgaccccaagtggtgatggtacttcttcttggcagcattttctttgtttctttccatcatcgcctgcccttgttcacctgtcttatatgcaacgaactcgtcccattgatcccttagttttgggaatgtgtcgaagttcggtgtctgccccttcaggatatatatctggtacagatctcccttgaagttctgaaactgttctgccattttcttcagagtccaccttttcactttgtcctctgtacccgcgggaagggtgaatgtctcgagcattgtggtccacagca

SEQ ID NO: 7655 - DNA, 1501 bp, Oryza sativa
tttggttaattcttcttcacggcactgacgagtgacgacgcctgtcaatttcccccaccatccacacggggttcatagcggtaacagtgacaactacgaactcatctgcaaattaagcagagtttatttgcggaattcagagaagagcttttgtgtgcacatgttacacctcgggttgaaatggaagcacgcagttgacactggcagattatacattcagatttgagatatggtagttagttcaacaaacacgggagattatacagtctacggcagagtagatttctgttactctgcatctctgttggatcaccgccatccgacaattttcaaagcaaccagcttccatgatctagaagaaggctaccataaaaagcagagtccaatttgttatgcctcaaaatccattagccctctgaaaccttcagtctatctcaggcagcaatgtcaattgcatatgcatgcaggcaccggccagaaaaggctgctacatctacttgactggccatcactactgaattttggttcttcacgtccactcctttaaccacatagttttgtacctggtcaattatctgcagtaagtagtatgcaatcttgtcagcataacttctgtcattaacctctctggttagatattgatctcaagatgcagtgtaatctgtagctactaccagtacattttattcagtttgcccagattgtcaatgtacatgcagtgatgcaggtaagtgatctgcttatctgtcagatgctgtggctgacgagggaaatgcaccacctcgttgtgagatgctttcatgtgcggatgtgccaattaaatttggaatatgattttccgttcgccgaaatgcttcttgagctcttgtcgttgggccgaaatgtttgttctgcgttggactgaaagggataagtccactttacctccctcaactctcgtccctagttaaatcacgtccctggtatatcggctccttcagctttgaaaaccagaccaaatcccctccctcggtggtttggcaaatcccctcggtggtttggctggtggtttcgtccgacgtggcgtcgttgactcggttggcgacgtgactcagcacggtgggacccacatgtaagtgtctatgcagtatgaactcaccggtgctgagtaagcgcggagcagagcagagggacggagcagcaggccacgggcggagcggagcagaggggctgagcggggcgggcggagcgacggtggccagagcagaggggcggagctgggcagtggcgggttgccgccgggagagggcagcgggcggtcgttgtcgaacccgtcgccgtcgtcgtcttcggcggcggcgagagaggaagtagaagggcagagcagggcgggcagataagaaggatgtcgccgcacccgttgacctcaccgggacgggagaggagcggcggagacgggtgggagaggagacacgagcggcggccggtggaacaggaaccgcgggaagcatcagaagggaca

SEQ ID NO: 7656 - DNA, 1501 bp, Oryza sativa
agagtagagagggagtagtacatgtagtcacaccgatcggtagtgttatcccgtaattgggaaacagtggctcgtaggggttcggcaaagaattctccgaaccccaatcagacaaatacaaccgctggatggagacgattgtgcggctaagatttaaattgacgtggctctacgggccgcggccatggaccctggcccgtaccgccgtacgctacgtgaagaaccttgaagcctagccacaggcttccatctaacggttttctttacccggtgggagttggagaattatttttcgaacccatcagcgtttagctagttttttttttttgcggggaaagggagatatattactcagaatcagaacaaacaagttgcaaaataagattacaactatcatcagcctagaacttagtgagatattcagtacgggctttatttgctaaaacatgactgacagaattctgagaacgatgaattttcttcagtatgatctcccttcttcctctcaacagagtatcgatgtctctgacaagatgagccaacgctgacgccaggggcggagccagtgtacaaccattggtgtcacatgacaccaatggcttgtgtcttgtcttcattattccttttactttgcaatgagtgacaccaaattaacttgctttgtgacaccatcctatgtgagcatggacagccagacagtagctagcagcttaattaactattgatagcccaaaactcacaatatttgactcgtggtcaaagttgtttgatagcctaaaactcacagttagtggtcagagttgttttatgagacaatgttcttatccaaaacggcaaaattattaacctagaaagaatattattattcacttgcacatgtatatctagcaattttaatttagtcttttataatttaatttcaccaattagatagttggcatgaatacaagtcgaattatttttgaaaagaaaattctattttactttatcaattagcactaattttattttacttaagttgttatcattgatagtgacaccatcgatctaatatcctggctctgcccctggttgacgcctcctttgcatcctccatcgatctaaaatcctggctccgcccctggcgcctcctcctttgcatcctgatcatagagacagccaccaagcaatccgccacaacaataatggggagtaaggtccattggagcgccatattaataccctccttacaagcaagcagttccgcttcaagggcactagaacaacgatcaataaaaccgcaagcagagaagataaccgcaccactggagtttagctagttatcgccggcaacgtgtacactctaattattcgacctgtgcagctgtgcacacgcattgcgtggctgcggcgatcgacatgagcacacatgcatgatcaatatacaaacaagctgattttatttttatttattgcttcgtgcaaacgcgctcacaacagagtacaaaagaatacacagttc

SEQ ID NO: 7657 - DNA, 1501 bp, Oryza sativa
tggttctcgtagtttctcgttctcaatcaatcattccatactcgctatcccctccatcacagaataaatgcaacaatgagtttccgtgtacaaatttaatcgttcgtcttatttaaaatattttttaaaaaactaaaaaacaaaagtcacgcataaagtactattcatgttttataatctaataacagtataaatactaatcataaaaaaaaattcaaataagatggacgattaaagttgaacactgaaattcatggctgcttttgttttgagactgagggagtacacgataagatttgatcgcaatcaaagtaacctacatcaaagaagcaagatatgtgggggaaaaatgaatactctagagcaaattaaggtgagccccgctttgtagaggctgatggagtactggagcgacggaagcgaagcagatcgagtgtgctgtaaagcgaaacgagcaagaaccagagaagtccagagatttcaggacagattagttgtgaacctataaatatcctgcctcattccccaacctccatccatcgagccaagactgaagcatttgatcgagctccaaacaaacactcgttccaaacttcctccaatccacttcatacaaagaaacctaagcagctagcgatccacgacaaaccaacaatgtcgctcgtgaggcgcagcaacgtgttcgaccccttcgctgacttctgggaccccttcgacggcgtcttccgctccctcgtcccggcgacctccgaccgcgacaccgccgctttcgccaacgcccgcgtcgactggaaggagacgccggagtcgcacgtcttcaaggccgacctccccggcgtcaagaaggaggaggtgaaggtggaggtggaggagggcaacgtgctggtgatcagcgggcagcgcagcaaggagaaggaggacaagaacgacaagtggcaccgcgtggagcgcagcagcgggcagttcatgcggcggttcaggctgccggagaacgccaaggtggaccaggtgaaggccagcatggagaacggcgtgctcaccgtcaccgtgcccaaggctgaggtcaagaagcccgaggtgaaggccattgagatctctggctgagaaggagagaagctatatacgtcgtgctgtgctcgagtccggtcgtgtcaggtccatgtgtggcgagtctcgtgtctgtgtggcagttgtgtcgtggcctccgccaatgtaatgtattctggttagaccggagcacaacattggttcggtccttggaattgtcccatggcgtctgaatgaatgagtaaataaagtgtccggccgatttgcacaagtgtcattcacttccgttcccttcgctgagacgtgcatgttttatttaaggcctgttcactttgataccaaaaaaccttagttttgataacttatcaaaattttggtaggatttttatatagttactaaaatttggcagcaaactaaatatagctatattttttggcaactttaccaaaattt

SEQ ID NO: 7658 - DNA, 1501 bp, Oryza sativa
tcatagagtagggtgttcgcgtgtatgttcatacgggtcagtgtgtacgtgttgtagacgtctgcattgtattgtgtttcaaaaaaaaaatagaagttaggaaaaggaagaaaaatgcatcaattacattggccctaccaatataattcatggcaccaaaccaaaaacaaccctaataagaaaggtagtacatataaaatttagagtgaattacactttggaccacctgttactgttgtagttttatattggatcatcactagttcagtcttatcactttggactagctaaatttacgtccgttgtactttgaaccacccaaaacctcttctttaacatgtaaacgacctggaggatgtcaactctgacacgctggcgaaatcatccacctatgtctttgccgcggtataggatgaacatgggtagagaaaaaaatcggggtgatccaaagtgcaatagacgtgacccaaaaagtgtaattcactaaaaaaaacttaccaacgaagcaatgctttggcagtgatttttacctttcagtcatgggcatgacctgcattgtaaaataacgtggttgtgaattcaaactcaaatgtgtttttctttcacaagttgccgttaaaaatatgtttcgcaagagactcactgctcccagtgaaagcagtgaattgaagcattcccgaaacccactggaatgatctagtactcactctacgatgtacagtgaagtaatacttcaaaactggtgtaatttggtatgccaaaaggactccatagtttcacgacatatttccaaacggttcaggatcagtactgcccatctgcctggggcccacactagcgggcaattggttctcgtagtttctcgttctcaatcaatcattccatactcgctatcccctccatcacagaataaatgcaacaatgagtttccgtgtacaaatttaatcgttcgtcttatttaaaatattttttaaaaaactaaaaaacaaaagtcacgcataaagtactattcatgttttataatctaataacagtataaatactaatcataaaaaaaaattcaaataagatggacgattaaagttgaacactgaaattcatggctgcttttgttttgagactgagggagtacacgataagatttgatcgcaatcaaagtaacctacatcaaagaagcaagatatgtgggggaaaaatgaatactctagagcaaattaaggtgagccccgctttgtagaggctgatggagtactggagcgacggaagcgaagcagatcgagtgtgctgtaaagcgaaacgagcaagaaccagagaagtccagagatttcaggacagattagttgtgaacctataaatatcctgcctcattccccaacctccatccatcgagccaagactgaagcatttgatcgagctccaaacaaacactcgttccaaacttcctccaatccacttcatacaaagaaacctaagcagctagcgatccacgacaaaccaacaa

SEQ ID NO: 7659 - DNA, 1501 bp, Oryza sativa
gccgcggccggctacccattcccccgagcgcgtcgttgctggtgagctcctaaccatgcccgcgcgaggcctccatcggcgacctcttccccgcacctatgccgaggccagcgacccctcacccatgcgcggtcgcggccagcgacctcctccccgcgcacgtgccgcagccggctatccctttccccgagcgcgccgctgccgataagctcctaaccatgctggcgatgatctcgtccccacggcggcgcccatcaagcggaggatgccggcggagcgatggcgacgacaggctgcgggcggagcagaggggcgggcggagcggcggcggtggaggtggccagaggaggaggaggtcgccggcgagcacggtagctgtggcaggtgcgacagcggttgacgacgacggtctactccactccgtcggcatgctccgtccaccgccgcttggcctgccccgctcttccctgccgcggtggggttccagactgtggcgaggagcgcggaagcgtggtcggggaggcccatggaggagagggaaaagctgccgccgcccgcggttcctctcctcccaccagctgccggcgaccgcgcgccgcttctgtcccttctgatgcttcccgcggttcctgttccaccggccgccgctcgtgtctcctctcccacccgtctccgccgctcctctcccgtcccggtgaggtcaacgggtgcggcgacatccttcttatctgcccgccctgctctgcccttctacttcctctctcgccgccgccgaagacgacgacggcgacgggttcgacaacgaccgcccgctgccctctcccggcggcaacccgccactgcccagctccgcccctctgctctggccaccgtcgctccgcccgccccgctcagcccctctgctccgctccgcccgtggcctgctgctccgtccctctgctctgctccgcgcttactcagcaccggtgagttcatactgcatagacacttacatgtgggtcccaccgtgctgagtcacgtcgccaaccgagtcaacgacgccacgtcggacgaaaccaccagccaaaccaccgaggggatttgccaaaccaccgagggaggggatttggtctggttttcaaagctgaaggagccgatataccagggacgtgatttaactagggacgagagttgagggaggtaaagtggacttatccctttcagtccaacgcagaacaaacatttcggcccaacgacaagagctcaagaagcatttcggcgaacggaaaatcatattccaaatttaattggcacatccgcacatgaaagcatctcacaacgaggtggtgcatttccctcgtcagccacagcatctgacagataagcagatcacttacctgcatcactgcatgtacattgacaatctgggcaaactgaataaaatgtactggtagtagctacagattacactgcatcttgagatcaatatctaaccagagaggttaatgacagaagttatgct

SEQ ID NO: 7660 - DNA, 1501 bp, Oryza sativa
aggccacggccggccgggcgcaggggaggaggtcgccgccgggtggacgcgggggaggaggtcgccgggaggtcacggccggcggagcccgggggaggagctcgccgggaggccgcggccggccggatgcgggggaggaggtcgccgggaggccgcggccggccgggagcaggggaggaggtcgccgggtggtcgcggccggccggacgcgggggaggagctcggcgggtgaccgcgactggtcgggagtgcgggacgaggtcgccgagtggccacggccggccgggagcgggggaggaggtcgccgggtggtcgcggccggccggacgcgggggaggagctcgccgggtggccgcggctggtcgggagtgggggaggagctcgccgggaggccatggccggctgagcgccggggaggagctcgccgggtggtcgcggcgggccgagcgcgtgggaggagctcgtcggaggtcgcggcccgccgggcgcgggggaggagctcgccgggtggtcttggccagccggtcgcgaggggaggacctcgacgggtggttgcggccggttgggagcgagggaggacctctccgggagtaggagtagatgagtcgtgtcttcaagccctccgaggcccgcccccgaccgacgttcgtcgccaccggccggccgaatcagcctcttgcatgtgcggttgcgagaaagagattgaaaggaggaagaagataagaaaaggggctgacaagtaggccccaccatttttttattttagcatttgtcacttccatgtgggacccacttctattttggtgatatggccgccacatcagcatatttggaccaagtcaacctgccacatcagcataaaccgcttacaaaaccacccgaggagtcgatttacaccggttttcggagatgagggagtcgttataccttttgtgtggttgagggatgttattagacgaagggcaaaagatgagtgaggtaaaatggacttattccttctctttttatacgaagaagaaattctaaggtactccttcacaaatagtgccagcccagcaaaagtccaatccagctccgtgaattgaatccattatccatctcgtatagattatcagcccattgtgcaatcctaacaggcccatttaattttgaagcctggtccagtccacgccaccaacggacgcgccgtcgatcagctctagagatctcgcgccacacccagcacccgctgcttgccatatgccggtgacctccagaacaagcaggaaacctcatcactcacccactcctcgacccttcacgacgcatccaacccatcctcacttctcaactgattctcgtataaatccacccccctcgaacaccggatcatcggtcgccaaaaatcacacaaacctgcgtgcaaagccatcttgatccagcgagcaaaacaaaacaaacgttggaattaaaccgcgaaaccgagagcaacaaactaaccaagcagtaaccaacagcacaa

SEQ ID NO: 7661 - DNA, 1501 bp, Oryza sativa
tctctttaaaatatgtttatagctgacttaagcttgctattatacctgctcttaagggcaaaaccatcttttcaccccataataacgttaggggtgggcaactgggcatacatttggttcggtcttgggtcatgatcaaaatttgaggatactaaaagaaacgcaatcaacaataaatcttgttttaggacatatttcaaaagtgaacaatcacaacaacaaattatatataacaccaagtaaccaatatagtggttttaattttttttttcaagcatgatacttccttcgtctcatacatatataccatcccgtactatttttttttgggacgaaaaaatatttatctgagttttagctaatgttaattcggttaagagactcatgattaaattgaccgtattaaattcagttagtaagaagggttagaaaacgataggcaaataaacgataaatagcaatagatcaatcacataagacataagatttaatgtggaaaatcctctcaaagcaagagagaaaaagccacgggtgccaggcagcaaatatcttcactataacgggttgaggttacaacgccgaacggcggcttacaagaagtatatatgaaggtgaaacactaaagtgataaggatccgtccgaagctagcctttatacatgtggaaatgaatccttgagacgaattccttttttagcataaatgaatccttcaacctaaacacaataaagaaaaatactttcggtgccaaataacctcttgggctaaatcactataccaactaagtttgagcaaaaagcaatagaaaactagctttgtcatcatttccgcttcgttccggctgaagcctccgacgacgggcctccgcttcgctccgttggaagctagactttatacgtgtgcaaatgaatttagatcacaactcaacaagaaagagaccggaaatttcggtctcatttctgttagttcggttggttttaatttattttgtccacccctaactaacgttaaatcgacgaaaacctactaaaacaacaaataaatgataaaaacagttcgaatgagaggcattacagccttacaggagagtgaattttacaagggtaaatgtctagctcggttaactttagaggataaataaataattttcttaaaaaggaaaaaagagcacatactaattaatgaaaatcataaaacaaggagctccaggctccagtaagcgggagactagtctagaaaagagtgggtcctgctggacagagacaagggaaataagctgatctggaaagaaaagagaacatcagagagtggagatcactcgagatgcttcaagaccaagttctgaagaacctataaatacgcccaccttgcatcgcatctccgcattcaaggcagagctagtagtggtcacatcgccaattcacagtcgaatcaagcaaaccatccaaatcacacccaactcttcttcttcccatcctccagagatccaagcagcttagcca

SEQ ID NO: 7662 - DNA, 1501 bp, Oryza sativa
gaggaggcccgcgttggcgcggctgacggcgagcagcgagagcgcgaggctgctggacatgttgaaccgggtggcgcggcaggcggagctctcgaccaggttggcatggaaggccacgacggagctgttgccgtagtggatggcgaggacgcggaggtaggagccgttcaggctgggcggcggcgacgcggtcgcgccggtggggtcgtcgtcgtcgtcgcaggtgacggcgaaggtagggtggccgcagtaggcaggctgccggccgcgcagccagaacgggtacttgatggtcaggttgccgcatgccgccggcgcgcagctctcgccgaccagctgcgcgtgcgtcgcggtggcgaatacagccaggagcaccagtactagcgaggtgttttgaaacattttcttttacggtgtatgtgtatcgatacccaaaaagaattctaaatcccccgcgtcgctctcgcgcgagcggcttggggggcgaaaccctagccgcccatgccgccactccccctcctctttcttcaccccgccgccgaaggcggcggcgaggccttccactgtagcaaccctttccttggcgcgaggaggacagagttgggctgacgatgtctaccaccacggccggaggcgacgacggcggggcagctcggggtggcggcggatccggcacttctttggccaaatctggccgccccacgtccggatcgggagcgcgcgacggccagggctcgccggcggcgcgcggtcggccgcggggcgtcgcgggcaagcgcggggtggcggcgcggcgcggcctggtgacggcggcggatccggtggtggtcggatctggccgccctacccccggcgcgacggccggggctcagaggcggcgcgcgtgtcgcggctcggcgcgggcggccgtgggacaccatggtccagcacggggcggcggccgggggtcggcgcggcggcagcagccctcacggagggcggggccaactgcatccagcggcggcctgggcggatggacggcggcggcgaccctcccggagggtgcggccagatcgtggcccgtggtcggcgcggcgcggcatgggcggtcggacggcggcggtctggccttctggtgcagcggtggtggcgttggggtgggcatggcggctcgtaggcactgaggcagggcgtgaagggagtgatggcagtgctaagggagctggcggcagtgggtcgtcttcctcgctgccggcctgcaccctcgcccttcctgaagctcatccccttctctgtggggagtttctatgttggattgaggcggcagccggttagcgaggggagctcagaccgccaacgcgacgccgtccaattccgggttctccttcggccaaagctggcaaggaggctggcgggtggcgggacggaggaggtctgggccagttcccagggtagcggcagctctatgcagcaagtgtggtggtcggccggtggaggggcgccggcgcggtgtggtggaggc

SEQ ID NO: 7663 - DNA, 1135 bp, Oryza sativa
agtcgacctgcaggcatgcaagcttaataaattcgtctcacagtttacaggcggaatctgtaatttgttttattattagtctacgtttaatattttaaatgtaatttgttttattattagtctacgtttaatattttaaatgtgtccgtatacttcaaagcctttacatctaaagcactaaacatacccatagtaattttttgactttttttttacactgcactcgttcaagtcttctgcacaaggatttttattattttattaatatttttatttttatttttaaaacggacccctcccaagacttatttttaagagataatttattatatgccactgactttgtcgcacgtctacgatttgccactgactttgtcacgttctacaatatgccatcgacttttgcttaacttctacgatttaccatcaccgtccggttagccaccgttagtactgtacaaatttgtcgaaatgaccaaaatacccctatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcatttcgacaaatttgtacaatactaacggagactaaccggacggcgatggtaaattgtagaagttaagcaaaagtcgatggcatattgtagaacatgataaagtcagtggcaaatcgtagacgtatgataaagtcagtggtatataatggattctctctatttttaaaatatgttaacggcatcatgtggcgtgacagttttttctgacgccgccaattagactggcgtggtgcttcaaatttagaatcaacttttttttttggggggggggggctgtggcaattgattatttgtcactcgctgtctatgatatgtgggctctcatgtgtatatgacatgtgggtctagtggcaaatagttaattattctttttagagagtttttttaaaattaaaaatgtctaaaactagaaaaaaaatctctgcatagcgtcttctcttccatctcagtttggtgtttgggcccgtcattacaggttatccacggccca

SEQ ID NO: 7664 - DNA, 1501 bp, Oryza sativa
taagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcccggatcatagtcacccccttataaacaaggtatggactccccagcgacccccgtgggcttatctccgccacttctcaacctggtgctctgcagtgaaccatgctatacaaaaggtaaagccgttgcccacgctggtttgtggttggcacggttaatgtttcacaatagtagctcgcgaaccggtccttaattgtcatgagcacgactctcaaaaccatgtgctcacaacccaccattatccagttttagttggcaaataattaattaaccaatcacaagtaattaattaaccaatcacaattgaccatcgtgagctaccattaaatataaccataagtgatagtgaaacattagttatcccaattgtgtgctaatgtttctaagcatggcaaagcaattacctctaatatctagctgaaccaatatataaagctcaactagtcaaattataatctcccaaggtaacaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaatgaagaaaaagactaataaaaaccaaataaacagtacataaaaagtaaacaaacatgtagatcataattttagatgatttatgagacttgaacggcctcattctgacttcaaatgaatttattatgaattttacaagattaaatctatttaaagcccatttaaaaagaattaaataaatttaattcaatttatggacaattttaaaatgtagatctttattttacacaacttttgcaacttgaaccacattaaactgagttcaaatgaattagttatgaatttttaaagattaaatcggattaaaacacttatattgattttaattgaattatgacgccataatgaattatttttgaaaaggaaaagaaggattattgcgtcagcggctagggtttgcggtggaccgggtgcacggcagcggctcacggaaacgaacggccgagatcaaccctatccaaaacggacggccgagatcaaacggtccacgaccggcttacggcggacgatcccgatgacgtcagcga

SEQ ID NO: 7665 - DNA, 1501 bp, Oryza sativa; identical to SEQ ID NO: 7603

SEQ ID NO: 7666 - DNA, 429 bp, Oryza sativa
ggcgcgaggtaggcgatgacaggtgggtccccacccgtcagcgagggtggcggggcgggcccacctgtcagcggcgcgcgcgcgggggaaggccgatgggccgcgggggagaggagagagagggagggagagttgggccgagccggcccaagagaggaagggggggaaagaggacttcttttagggattttctttttataaaacctttttaactttgtttatttcttctcaattattatttgtgctctgaaaattccactaaaatttatttacgcattttaggcttttaggaaatatacaaaaatcctccaagccttatttgacttttacatttgcacattttaattgttggaggctttcacatggattttacttattctttgcataatttcgaggatgtattttagagtcgttttgggacgtgacagt

SEQ ID NO: 7667 - DNA, 1501 bp, Oryza sativa; identical to SEQ ID NO: 7604

SEQ ID NO: 7668 - DNA, 1501 bp, Oryza sativa
  unsure (1)..(1501): unsure at all n locations
ttggaccgataggtcgaacggttcaattgttgaaccggaaagtatatctatcatacataattttacttaaacaaggtgaccaacttagcttggtggtgtggttgatgctcttatagcccatcagccaaggatcaatccccattgtcgaagagtaatcctctctagcgggcggtcgtgagaccccccccctttgtgagttcggccgggggaaatggcgcgatgatcaagggtcaacttccgcttggccatctaatcactagatcacttgcgtggctgtgtgggagatcaaggattatacaggttcgggccgctctcgagcgtaataccctacttctgtgtgtgggattatggtgaattcttacaagaggttttgagctccagagggaaacctagctgtccttcctcccgagctcaagttgtctgagagtcgtcccttttttcggtagacaaggtcctccttttatagttcaaaaggataccacatgcaccgtttgcacctacccctccaagggaggggggcccacatggccctattcataccgctatcctttgcttcaaccggaagcaacatggtcgcctggcttcaagtggggcccggcgccgccccccgcctgacacgggagacatccctatcattccctattaattgtatgaagactttggcggctcaccacgcgcatgcggcgtccctggcagcgtgccgatgggacagggcatacccgcccccactccgcctgacacagggcagatcgtgggggcactgcccccgtcccgtcgcctgtgaccggtcacaggccggtcatgctcgattgacatgggtcaatcgagcggcgccgcacgtccctccacgccgcggttggggcgccgcgtattgaaggcgtggagcagcgcctttcgcctcgcccgctctccccgccacgtggtggtcaggcgagggcctcggggtagcacaccccgaaagcccgaggggtgcgacgtggcaccccaaggccccctggccacctcagcgctaaccgaggggcggggggaggcgaggtcgcatgggggccccccaaaactgnccactaagaatgcggaagaacacttccccttctactgtgcgtaccctcgggcccatttcaccgacacccatgtgacgcaccattttcccattttatggaataaaagggatcggtccccatgtgacgcaccatttttcctattttaaggaataaaaggtaattgggccacaataatccaagtgggcattagcgaaccggcagttcaatatagccttgttcatccggttcacaccggatcgattgcatgagcggtccttaaagcaaaccgaaccggtgggagtgctggttccggtttctttcggttggaccgccggtccggtccggttttttataccacgactcttagccatagaataactggaacgaacagtatatattcatctgccgtagaaacggataaacagagcagccacaagaaacacagagcggcaagaacagaa

SEQ ID NO: 7669 - DNA, 1501 bp, Oryza sativa
ataaaattaacctttaagggattccaattgtgtgttaccccacagataatctatgctacaaactaaattgttcttgtaggtaaattggttcccttcctatatattcactcttttctagaaagatacattcacaagacttatatataccctttttcgagaaagatacattcacaagactcttgcacttttgagttttgagggaactaagccaaccagagggggggtgaatggttggtatacccaaaaaccgaaaacttttagcggaaataaaagttaccctcgaaatcgacggaacgcggtctgaccgaagttgtgtggacccccgtttttataacaggaatcattggtgtaaaccgtaccatttccctggatcaagtagtctggacacacgagttcatagctgaaataccaaatgcacatacacgagagtctagtgctaattattacatcataagccctcaggcactgtcttaaatcattagaccaagcggtccggaatacaaccaaaagcagaattagataaggcagcggaatttaggcagcggcatgccattgccacaggcaacgaccgtactaagacctactgagcgccatcgtcttcatcttcctcctggtagtaggcatagggatcctccggagctttatctcccgcttctgattaagtttatatttgcaagggtgagtaccaaccgtactcagcaagccaccacagcaacaatgcatatgaaagggggtatttcaaaggatggctatggttcttttgcgcaaagcaagttttgtaattcttttcacaaacctaagacctagcattgactgatcaaattttagtaccagtgtttatatttaaacaacgacggttctgtccaccatccattgtgatcccaaggatagcttcccaccattgaatcgttatggttttctgaggacgctcactttcccccttctcaggaagtggctccatcagcataaaaattcatcatgcaacaacccatcccacacaagttaagaatttagagactagctgtggagattatggatatcccatatctacacggcgatactatttgggctggatataggataccgaatatgtatagaatatcttatttgtatctcgggtttgtttcttaacttgtacaacaaggaaacaccttgagatttagtcggtcacgactgtatttgtattccgttagggatatagattatcttttgtaacccggactccttcccatatataaggggggtccgggcgcctctaggggcggaggttaattttctctaaaatcatacaatcaataatacactcggcggattcatccccggacaggagtagggtattacttcttttataagaaggcctgaacctgtataaatcttttgtctccaaacccatacacttttctagcttgatagccacccccttttattattgccgaaatctagtttcgacagttggcgcgccaggtaggggtagcgtcaagcttttcgccgatcagcgcaa

SEQ ID NO: 7670 - DNA, 1501 bp, Oryza sativa
atcgcggcaaccgcattctgttgaggggtacggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgttgaagtcgttgtagcgagaactaaattcgtcgtactccacgatgtcagtaggacgtgagtcggcggtgggagagctgttgtagtcatccagctgatccgtcgaaaccgtgccgagtggttggaggatgacgccaacttccctgaagctaggcgaaatcggtgttgaagccgacttctgcctaggcctacgggatgaagacgctgtcgtggtggagacggccgctaagtcgtcggggagcttcatcaggactggtgggtaagtcccatcatcttggtctggtgtcgttggagaagatgcgatctcggccgagtggtttgaagccgactcggttgagatggtcttgaagtagctttcagccgcgttcgggaatccaaacccgaccgaaatccggttctctcccgactggtctgattccgagtcgaggagagaaatcttgccaaagttgttggtgatgaagtcgaggctgccgaaccgaaacgtctgcccgggagggaagacgaggtcgtcgatgccggagacggaacccattgcgctgatcggcgaaaagcttgacgctacccctacctggcgcgccaactgtcgaaactagatttcggcaataataaaagggggtggctatcaagctagaaaagtgtatgggtttggagacaaaagatttatacaggttcaggccttcttataaaagaagtaataccctactcctgtccggggatgaatccgccgagtgtattattgattgtatgattttagagaaaattaacctccgcccctagaggcgcccggaccccccttatatatgggaaggagtccgggttacaaaagataatctatatccctaacggaatacaaatacagtcgtgaccgactaaatctcaaggtgtttccttgttgtacaagttaagaaacaaacccgagatacaaataagatattctatacatattcggtatcctatatccagcccaaatagtatcgccgtgtagatatgggatatccataatctccacagctagtctctaaattcttaacttgtgtgggatgggttgttgcatgatgaatttttatgctgatggagccacttcctgagaagggggaaagtgagcgtcctcagaaaaccataacgattcaatggtgggaagctatccttgggatcacaatggatggtggacagaaccgt

SEQ ID NO: 7671 - DNA, 1501 bp, Oryza sativa
tattccctagggggtggccatatcccagtaccgcccaccatccaaacacctccaaaatttgggtggccataccctatcccagccaatccctccatccaaacacatcctaatctagtgcaatttggcccaaccttatctatacctaggattggcaacagggcgggtcgagggggggttgggctggaacgcccccgcccccgactcccaacttctccccccgcccccgaggttagttgcggggctaaaacagcccgcagccctagcccgaccggggccccgattgagtgtccgcaccattcaattagcaaaaaaaaaaatagcagaacaatcagtggttcatcaaaaataatttataactttgacattctatccaaagaaatggtgttctgcgttcaaaccaaagatcatcaaactgagaaagcaccagaatcatgttctaagtcatcgggatatataattaccaaacaatgaaagaacacattacagaaatttagatcgacacctcctgagtttttgtttgcccgtcggccgtcacctgctttgctgctcgcctatgtgcctgcttgccctcgcctatgtcacgcccggaatttctatccaaaattccaaacgcttacatgtgtgtgaaccctcgtccaggaatcagccgaggcacacaataacaaattgataatagagtacaattattactctaattaataagcgaataaaacgtcattacagaggtagatagttcctctcaatcaataaagatctaagcagcgaaaaaataagataaacgacgcagacggctccactccataggcagtttgaccagggctacacctaatcctccacaccatcagcatcactgtagaactcttcctctgatgaatgattgcaaggtgagtatatgacatactcagcaagccacgcagcaaatatgcaagtgcacaaggataccaaagaatggcataatatagggctcatttgcaaaagcagcatttagcaaacatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtaccccttgcacaacacaatccaccacagcgcacatttcctggatcataatcacccccttataaataaggcatggactccctagcgacccccgtgggcttatctccgccacttctcagtctggtgctccgcaa

SEQ ID NO: 7672 - DNA, 506 bp, Oryza sativa
ttagatcaaccagcagtaaagatgaaggcacccagcaatagcgacagagttttgtagccatggtgacaaaataatcagtcggagacagacgagacagctggtgaagaagatgaaaacgcccattagcggcgacataataagccagccgtgaaggcgagaatatcagtcggtggcgatgaaaacaagccaacgatgacgacgtagaagcgcatcaacgacgatggcaaaatcctccaatcatgaaaatgcaagaaatagtcgacgatgacaaatgcaaccgatggtaatgacgattggcagcaatagagatgatcaaatatgatgacgaagttgcccatcaatagaagtagagtgggctatgttgaagaggcttgacaggatgttgatgaagatgacgatgtcagtgatccagtcaatagtggtgtagcagccgatgataacaatgaaatcctctatcggtagttgcgtagtaggccaaccgtgaaaacgaaataacaagtcggcga

SEQ ID NO: 7673 - DNA, 1501 bp, Oryza sativa
aaacaatgactgaagtgtataatcctggactgatctaggcatgcacggtcaatcaagcagacttttgagtttagtaaagaaaattacatgaataatttacaccgaaattggaccaattataagccttccgagtaggtccttcacaaaatctctccatgatatttattacgatattctttcccggcttcatatttagagcatccatattattttcggtcgtgtcatttattaagcatactagttcaactctactaaagtttacacctccaagtattaacggtgatggcttaatgtccacttgtaacctatagttggacaaaattaagagcatataaaataagaaaaccaataacatataattaattaagtttcaattattacaaactcaaaagatacctttatttgatattttagagaaacttctatatagaaaacttttgtacgaaacatatcgtttaataatttaaaacatgctaacaaaaaccaaaatacaatctacatcttaagacttaaaatacaatcagaacgaactaagacttaagttgattaaaagctgttcttttttttaaaagagaaaaagaaaaatcatgaatgtcatcattcactgtgcttagagcaagtataatagagggctataagaagcctgaatgctgaggtggatgagagaggagagaagagagatgagaagcgggctgtaagtttacagccggtttagatataggaaccaagaaaatctgtgagacagacatgtgtaccatatatttatagggaaaagttaattattatatgagtgagctgataaatagggtaaatagtagtagtacatgacctctctcggaaggactgcaacaaatcagagaaaagcaggccctatccagaagtagtactgctgaaatgcgaaattcccacatctataaggtagtactagtattgttttctcgctgtctctatccaaatctttgaaaaataatattctcatcgcaaagccaaaaattttgactaaattgaatagctatccccgcaaacacaccaactaaaagcatcatcctaatccagactactaattacttcatccgtaaaaacactcaatctagaagaagatgctaatcctaggacaacgaattaaaggatagctccatttttcacctctcatgttaatctcgaaataactttatttctactccccatcctaaaatacaagcattttggtaggaatataaatatctggggagtgtttaaagtagaaaataattacaactacaatttaataacgtgaaagtattctagttcttttgtcgcttattgcaacgggtgggatatgtgtgaaaaataaacttggccgatccaacggcgggggaaatccgccggaaattaaagccggcgccgcgagcgtgcgggcgtggcgcggcgtgcgagtcacgtgacccacgtgccaaactgcctcttatatcgcctcctcctcctcctcccctgcctccggcgaagcggccggcggctgagg

SEQ ID NO: 7674 - DNA, 1501 bp, Oryza sativa
gccgcacatatactcgtgctcgcgctcacgccgccgcccccgaaactccccgctccgccattgccgggggaggcgatctcccatctccatctcccatctcgcctcagcgaactccccttcacatcgcgtctcttccgtcgcagagagtggcggccggtgaccatttccggtgggagggcggaggttttgtcccggctccggcgacactccacactccgacagcccaccgctccgtcaccctgcatttttggtcaggtaaaaaatggaccggtggcgttgcttattcttttcttggggggtcatatttagtggtttgatcggtgaattgttgggaatagtcctaagagattttagtggatctgtttcttgcacgatatgttgtgtaatctactaatctgtgctcgtttcaatctacttcactgaaattaccaatctcagttgagattggaactgtgagtgcatctcattatttttttatagagtaaaatgcatggaggatcatctaacttgtttaggtgtatcatataggtcacttttctttcaaaatgcacatgtaggtcactaatgtgagttaagtgagttattgacacaattaactataaatatgagcatagccacatatgattgaaaatttgcttctgcacataaataaccccatacttaattaatttaatcgaatcatttcacttatggctgttttgacgaatagtctccataatgcagaaaaaccctctatattgtgattttgtttaagtcctaccgtacatcattagccaatcccggaattagcgcacaacgtgttagcaacaagcaatcttcatggctacgatacctgtataaatagtacatatagcttccacgaattgatcgatgtgagttgatatatattgtgaattccgcgtattggcaaggggtagtgttaggagaagggaaataaaacagggtttttttttttgcacatatctagaagcaaattttcaatcctagatggcatgtcatgtgtaaaaaagtgtgatcatttggatagttaaatgagctaatgactcacttaactgatacttcctccgtttcacaatgtaaatcattctagcattttccacatttatattgatgttgatgaatctagatagatatatatgtttagattcattaacatcaatatgaatgtgagaaatgctagaatgacttacattgtgaaacggaggaagtattagtgacttaatgtgcattttgaaagtagagtgacctacacgacacatctgaacaagttatatgaccctccatgcattttactcttttttataagtaggcgtcactccatttcttgattttagaaattaagtgttgtatccgtttttttttataccttggcgatttttgtaaaagttttatatgggtataaatttgttaatctctgctagccgtggccactgacctaacattttcatgtacacatatttctgttttatttttgatagttcaactcgtgtttgtgacagga

SEQ ID NO: 7675 - DNA, 289 bp, Oryza sativa
ccaatatggcacccaaaaatttttatttcctcaactaagacacaccctaagtgaacacatttatatctggcaaggtggacgcggtggtgtgtaacctgaatttttttttagaaaaaaagacgcatcactctatatatacgtgtgtaccctgcaggacaagccagtgtcacacgacgcctccgaattcattttcgattcctctcctctcctctccttccaccgcctaacgaaccactcgccatcaaagcccccagagagcgcgccatggcggcgcagcggcggtggccga

SEQ ID NO: 7676 - DNA, 1501 bp, Oryza sativa
cttggtctttgggttgagagtagttgtgccttatatttaggaatggatggagtacatttttgaaatattaaatctcttatttgaatagtctctcacttattataaatgtagttcctgttagaacttcttgcaactgtttgtttttctatttcccttaatgaacgaatgctacgcgtcaaaaaaaaactaaatagatatataaagaaactaaataaatgctactactgttctcatggataaatggtttgtatgtttcaatgcatcgtaaatgaagggcaattatgttatttgaattgttttcataactacccgtagtataagttgataattgaaatccatttaatactatatataaattttatgtggtaaaatagtgcatgatcccgaatcttaccttatgtaaattattgttgggaacaaaaataccatagcttagcatgcattataaaatagagttatatactgcagttttctttcatgcctctatctcagtctcaccgagctacatgaagagccactcttttatgtccccttcgccatgtctcggtgcactaccggtaacctcatcagctgtcctcgaagcttcaccatcatcatctttatgccacgttacctagttgtcatcatcctagttatgcgtcatctctaccttatcgttgtagcacgaaaggaggaggaggctgagctgctacggtgatagaagcgggaggtggcagcaatatgggcggctctggagctcgcatagagcaacaaaattgacagtctcatcccatttgaatcccttattgaggttgccctcgaggtaatcccagaaaggcaaggaacaagagaagaggtggagctcaaaggtccatttttaaggtcaggcttagagtgcaaagaagaatggcaaactaaggtaggcacggactcaggcatgaccaaggttcgttattatccctcttttcacatttgtttgttctcactatattgttcgcctgatgtgttgatgtgctgctgttcagactttgaacctacattttatcatctgtgagtgggttttgtttggctgtattttgtgaatttgtgatgcagtagttgcaacttgtatgcttgccgaacggattttgttgctatctgtttttttttcatttttcagaaatttcgcccgcaattttcaaatttgtattcaaattttttcaaaaaaattcgtccaaaatttccacaatatttctaaaatttctgaaattttagaatttcggtgaccccatacaaatcagtaaacccacaggtcgaaccctgcactccgggagggtatatataatcgcaaaattcctagtgaccaccgacgcgtaccgcacatttccggggcccacctaccagcagggccctccaacctgcccctccacgccctcaccacaaacccacgtgggccccacctgccggtgacccagcccctccccctccccctcctatataacctcctcccttgcgcgatttcaacgacctctctctccccatc

SEQ ID NO: 7677 - DNA, 1501 bp, Oryza sativa
atgccaatcatgcctatggtagcataggggttagagtagattgcaatctaaaatataccttggtcacaagagaacattcatcactactaactactaacatgttaaatagagcattatccacaattgatctagattgcacacaaacacaacattgaacacaaaaaaaagcacaaagaaagaactcacaaacaaatagaacattgtcacacctcctttcttatcgccaccgtgtcaacttccctccgatcaccaggcgcggtcatatcgacctccctccctggccgacaccacgtcctcttttgaaatccgtcgccaccactttatgccttcttcctatacaattgctaatgttcttgaagaggttatatttaaaagagagcctcacatttatttaaaagcgctagttgatacgtcacacattgctgaagggcattgtggttattaaaaaaattgcaaaactttgtggttacaaacagatttggagaaattaaaacaccaaaaatagatgtgcaaaaataatcattgtgcttttcaagcccatcaaacgattagtggcctaatcatacgattagaaagttctcatgccaaatgtaatatgggtgtatagctcatcaaaagatcgagatggctcaaatcagataaaggatatcgatctaacgtgacccatatttatggattatgtggtctcatgtatcatcaactttcgataagtggttgcctcttattggttgtaattatatagataaatagatttgctatgctacttgctatagaaaatcagtcgaggagaaacttctcttttttgatagttgggtttacttgaagattcgtgtgtgggagtttcatttttacacacatttctttgtttgatagtagagaggagaattatatggagtatggatgggaattgaattctaagtgatgatgtacgactcagatttatctcctcatacttagaaggggattccctcccaattacctgcgcctacccagatattgaaaatgtgggagttcgctcttaaactctgcttcccaatctcttataaaactccaacgatttatcaacgaaacaatagacttaacagtccccacccctcaaactcacattccaatgtaactatttcccccaaccaaatgcgtcgtaagcgttgtgcgggaggctggactcgaatccgtgacacgtaatgtgcctttcacgtgccccaccattgagttataatctaatcacgtataatacttttgagttgtattgtaattacactattttcattatataacagtagttatatctaaaaacttttagagaagttctccaaaaaaaataatgtgtttttaacacaagagtctttgcagtttgtatgtgaggtttcaatagaagaatgaaaagaaaatgtctttcacacatatatgtgccagacggacggggtcatcttcctgagctagtcaaacccgtccacccgccgcccgccgcacgccggcgaaaaccagtcgcgcgcccgca

SEQ ID NO: 7678 - DNA, 759 bp, Oryza sativa
caatggattagagagctataaatacccatatagacatactattgaggtggtttactattaatctagctagtctattgctaagatgtacatgttttatagagagcaccttactttaccattgtgggtgcccttactgcatatgctaatttcatgcagctatagcctcttcatcagtaaattaattggacagttagttaaggacgatgcatgcatgcgtgaagctaattacagcgtgcatgcgataatataataacctgaaagtggcatcacactatcagcggataattaatgatcaagatatatgtgtgacttaattaagctcacgtacatatggcgagaaagagatgtgctacctgaatagtgaatgtttgatactgtgatcagaaattgaaatggacgagcgaacgtttacccaagaagaaaactgattaacacgaccaaaacgttaattaacacacacacactaatgattcatttttccttgtaattaattaaggacgaaggtttcgcttcggtgccattgggggccaaaacgttgtcatggtcatgacagggcttagcatggtacgtactactatacacacatgactgcaattatgctactacctatcaaaagtagctcaactaaaactgttgtagatgtaatctagatgaatataaacaatgctagaatgatttacgttagaaagtattaattattaatcgatcggtttccctaatcgaataattaattaatctgcaaattatgcatcatgcagc

SEQ ID NO: 7679 - DNA, 424 bp, Oryza sativa
atgaagcattagatgtagataaatgaaaaactaattacacaggtagggaggaaatcgcgagacgaatcttttaagtctaattagttcatgattaactataagtgctacagtaactcacatgtgctaatgacgggttaattaggctcaaaatattcgtctcgcggtttctagacgagttatgaaattagtttttttattcgtgtctgaaaaccccttccgacatccgtcaaacgtccaatatggcacccaaaaatttttatttcctcaactaaacacaccctaagtgaacacatttatatctggcaaggtggacgcggtggtgtgtaacctgaatttttttttagaaaaaaagacgcatcactctatatatacgtgtgtaccctgcaggacaagccagtgtcacacgacgcctccgaattcattt

SEQ ID NO: 7680 - DNA, 1501 bp, Oryza sativa
atgattatattttttttaaagaaaaggaaattgaaggtatagacaattatactacatataatcattgatatatatagttcgtggtatgttctggaaaatttgtgcacataaaaaaaatccgtttgttgacaataattaaaataacaattggggagatagacaacctatggtttgacgcagaaactattggagtaactaactaaactaatccataatcatgtatatagatatgcatcctctgcttttcatttcaataggtaggtaccttccgtccctctcttaaaggagaagaagcatgtgctgtccttggactatgctgctgaaaaaaaaaatcaatggcctggagcagaggtcatgagggaaatgtaccctacagatcagaattggcgtaataatgctgcaatggggcctacggtggctgaagcaaattaaatttcaataatttttactgatatgctaactgtatttttcagagaaattcagacatgaataatttgtggacaatagaatgtaaattcttgatgaaatgttaccgtggtttgattatattgtcttaggagactcaaaccattagaaatttagaactgtgcttggccatcagaattcacgtgctatgagtgctgagattcctgcatgttacctttgtgtcctacatgcatgatgaattgctcagataagatgatctttctaaaagaaaaaaaaatagttgatgattgccaaacatttccaatcattacaatgaacaaaatatttggaaggactatgatgcaggcaatgtggttaactcaattaatagagattttggttatcatgatcgaattcctttgagttagacatacatttggtttgtagccacaaccgcgatgaaaatattactttttttactatctaggtcccacgtgtcattaatgtgtaatggtgctgcgagattttcatctcgctggcaccgtgtcatgctgattatgataacctaaccaactcgagtttagacataataaatgtagcaaatttgggcaacttatatataaaccaaagacagtgacaatgttcacgagttttgtatgctaaacggtttggtcaatacgttgggctaccgatcatgccattcttttagggctcgttggtagagctcgaactcctaaattaacttcataagttaggtttagagttaaattgtggagcatcttaaacccagctccacatctctaatttattttgtgaaagcgcttcagctatatccattcttatttagatgaagttgaaactgtttgtctgagtttcaactctagaagagataaagttggagctggagccgtggcaaacatacccttagtttcaatttcgcagtaactatctaatcaattgatcatagtatttctgccaaaatcaaatgtggaaaacgagggcatcgactagcactctaccagtagcctgcaggacacacatttatgcataaaacctcccaacgggatttaatttgcaacacaaaacgtcattaatt

SEQ ID NO: 7681 - DNA, 1501 bp, Oryza sativa
tcagaagtgaaggcctataaatccaccatgtgaaaatttgacgtgagctaaaataaaatgtgccgatggatccatacgtgaggattgaaagcccactatgtaaggcatatttttatcatgtaaattcaagcacgaagcaaagtgcaataggttgtccccgagccttaggctaatgccatgttagtccttgggctgacccacgagcctcactaaattaatgccagatgtttttttataatggattaaaactcggccttctatatcatgtgcggatatacacggctaacctacacagaatatatcattgatttaaatttcaacagaataaatacttttgtagtgaagagtccaacaacacggcatcatccccatcccaatgagggagaatatgcagtgaaaaacatatacatatacatacatacatacatacatacatatatattggaaatatgaaaaataccgtaggatgaaaaatggacatatgagatttatccacgtaagcacgagtaaaacttttactctcataaccatgagtaaaagtgtaacggggagtaaatattttcctaacaataacggagacaaatatgtaccagacgtctatttttacgtgctaaaatagttttcatatattttttttacactacatattttcttcgcgcaattaccatcaccatgtgcaggaagcatcagcggcacaggaacctcagaagatccgacaaaacgacgtgcaacccagggatctgatctccattgccatgccatgtcatgccaaatgcccgagtgcgccggttgcgacacgggcactcgcaaccatccatcgctccgcttctttctactgtgtgtctgtactcttgtgtgttccagtggtaaggcatcccacctaaaatttttcatcctgtcacatcaaacgtttgaacacctatataaaatattaaatataggctaaaaatatataattacatagattgcgaataatttacgagacgaatcttttaagcctaatatctccatgatttgataattaatataatgctacagtaaacatttgctaatgagggattaattaggtttaataaattcatctcgtagtttactgatggattgtgtaattagttttttattagtgcctgaaccctatacaacatataatataatagccgatgtaacacgttaaaactttaggccactggatttaaagcccgtgcagcgtcccaaagctaaagacaaagcttaagctcagtgtcagtgtcacagtgtcagacacgacgagacgacacgacgacgccccacgtgcaaaccgcagtgcttggcaccatcattaacacgccatacttaacgctgattgcacttattaattctgtagccacgagatgatgatggcaagttcaaacggagctggaggcagagctagagtgagactgtgagagtgaacaagagataagctaagctagtacagcaaccagcaagaacaaagaagagtggccggagtgggcgggggaga

SEQ ID NO: 7682 - DNA, 1501 bp, Oryza sativa
tacttggagtctttatatagaattccctatttgtcccaaaggacacagcttgtagagatgtggagtattgtaattatgcaatatcatgtgaattctcttgttttcctatcttaatttgtctgtacgatgtcgttagcatttcccttttagatctgtaacattttttctactatggtacaatatgtactgtttcacgaccaaaacatatatatagcgttttatcttcttccacaatagctactattctagtgcaaaatgtgtgcatggtctatgccggcccattttcacttccaaactttcgaccgtgagattcctcctcatgcttggaaatggtgaaaaattcagatcatttacaaaatgtttgataattttgtttgcgttgtggatttacctttgatattgtagaccatttaatgtatttttttttgtgatctcccttttctttttccttattctccgtatgattttatttactggatccttgttttaatccttctattctctttgttggatctgaataatgtgtgataatttctttatattttggattcgctgttttacctaaattcaccatacatattaatcagattatatgaatgaaagacgtatagtctggaacaccccccgcccctaacacaccctctccccctctagtaggcgttggcgtgtggtacatctaacgacagtcatgctatttatctccatgaacgggctgagttcatcatcgtaattaattatgttctttttttagcttgcgctttcattttctcccctttttttttcttccttatgtttgattcaatctacctattccattgttttaattcttaaatttctctttgctagattgatatttttggttttctccattttgccctgatctagctctctctctctctcacacacacgcgtagcaaatatttccgtttctctccgatctaccttcccattgtagtttaggccagtaagtgcaaaattgccctcgcaagtataataccctcttgttaatcttcttttgtcttgcacctcctctgcttgaaagtatgaaaattgtactgtctaattaattggattattttctgtctgcacctcttttttggaatgcttctactatacattaaccaaaatatgttttaaaaaattggtgtggccgggtggattggagcgcacaatggtagataaaaatcaaggacatttgagtgttaaacttcacctccaaactacaacttttccattttcctttagcacgcttcccgaactataaacaacacgtttcgtgcaaatattttcaatatataatttttttctaaaatcaaataatttttcaaacttataataattagtacttaattaatcagtggtaatatgcatgctacttcaatatatagagtttcaaacgggcccttattagcagcaagagcaccgatctatctttgtcataacatagtcatgttgctcaaaagtgggaaaaagagggaaacatgagtgagtttggtgtgga

SEQ ID NO: 7683 - DNA, 1501 bp, Oryza sativa
cttttcgtttggcatattgaagaaaaaaaaagcgaaacagtatataaaaaataatttataaataaagcttatatatatatatgtttttaaatgatataaaaataaaggctaaaaaataaactacgttgaaaaacaaaatcctaaaatcaactctaaatttaaggttgaaaatttcaattttagctaataagtatatgcaattaggcataaacaaaaaatatgaggctgtgcggcaattaccattgccaagttgtgtccgagcacgaatatatactaagtagcatgtctataattcttgaaaaaaaatattctaaaaaaaagtagcatgtgtctatatgttgtagtaaattataatgggctagacggatgattaaagttgtgttcgacactaccatttttcaacttctacacacttgttttttaaggacacactttctaaactactagacgataattttttttaaaaaataattctatagaaaagttgctttataaatttatatcaatacattttaaagtttttatagctaattctcaattaataatgtgctaatgaaccatttcgttttacatgtaggcttgaatatattttttttcgaacgcgcaaaaagattgcacgtcaatatattagaagtaaaagagtttttttatacaacataatctgccagacaagcctataccaggaggaagaaagaaaaaaaaccaaaaagtaaaagaagggaaaactattgcgaaaaaatggttactccaaacaacgagagggaggaggcgccgaggcggagctacactacgctccgagcaaaccccaaaagtggcaatgcctgtggaagaccacatgcttgaatatatcccaacattaataaaattaggttccagcaaattcccaaaagcggtaatgcctgtggaagaccacgtgcttaaatatatctcaaccttgaataaaattaggtttagtactgcttgatcaaaacgacaggccacgcctaagggaacgagtgtgatgttgtggtcgactaccaggtgcactgaagcacaattgttatacagtggaaataacttttaggttatgcaccaattatagatggacatgattatttaattatgagcatcatgattttaacctttataagtgaagtcacggtaaacttgacgcaatcactggtgtcgctaaagaggatgctaataataggcatcatatgctcattgctcaatgagacaatgactatcccgctgtgtaaacaaggatatgtccaacttggaagatttccggccctattgtttcacttattcatgaaataagccaaataatatatttgcaaacgaaaagtaatttttgaataaaatttttatatacgtatttttagcgatttaaaaacaatggctgaaaagtaaacttcaatgagaaaacccaaaatcagctcaaaaataaggttgaaaattcaaattttggctgataagcataaatataagcgaaaagatgaagccgcttatcttatggaac

SEQ ID NO: 7684 - DNA, 1501 bp, Oryza sativa
caaccagagttctacatgaaaacgacaaggactactcggattgtatccatattggttccctagttctacttggacaaggggacacctatgggtataaatacaagtccccctaggaggagagggacagaatccacacacccaacacaatggacatggaagccacaacatagaagcctacatacgccaagacacgccgccggatatcgacttcagggataagcacggctagtaccctacggtgtctccggatactgtcaggagagacgaaagcgctatctctgatctcgccgggcacggattcgaggaggaaggctatcctgttgtcgactacgagtcagatcgtcagaccgtcatgtcgacaacagttagataggctaccccaaatattgtactggtgtgattatcatgaataagagcaataccggcttcggccaacaggatgtagggttattacctgacaattcaggggcccgaacctgtataaaaatcctcgtctccatctcttttacctcagtctcgcgtataccctagtaccaacgatccctatgccatgcaaataccgtaatcgagacatcaaacgtcgacaacacatgttccataagataagcggcttcatcttttcgcttatatttatgcttatcagccaaaatttgaattttcaaccttatttttgagctgattttgggttttctcattgaagtttacttttcagccattgtttttaaatcgctaaaaatacgtatataaaaattttattcaaaaattacttttcgtttgcaaatatattatttggcttatttcatgaataagtgaaacaatagggccggaaatcttccaagttggacatatccttgtttacacagcgggatagtcattgtctcattgagcaatgagcatatgatgcctattattagcatcctctttagcgacaccagtgattgcgtcaagtttaccgtgacttcacttataaaggttaaaatcatgatgctcataattaaataatcatgtccatctataattggtgcataacctaaaagttatttccactgtataacaattgtgcttcagtgcacctggtagtcgaccacaacatcacactcgttcccttaggcgtggcctgtcgttttgatcaagcagtactaaacctaattttattcaaggttgagatatatttaagcacgtggtcttccacaggcattaccgcttttgggaatttgctggaacctaattttattaatgttgggatatattcaagcatgtggtcttccacaggcattgccacttttggggtttgctcggagcgtagtgtagctccgcctcggcgcctcctccctctcgttgtttggagtaaccattttttcgcaatagttttcccttcttttactttttggttttttttctttcttcctcctggtataggcttgtctggcagattatgttgtataaaaaaactcttttacttctaatatattgacgtgcaatctttttgcgcgttcgaaaa

SEQ ID NO: 7685 - DNA, 1501 bp, Oryza sativa
gttactttttacaaacgagaacacacgtacattgagaggaggaaataaaaggagaagggccccatttttaaagtagtaactagcattgagagtaggaaataaaatgaggacagttgtgtttgctaggggaggatgggaacctgcacactacgcacggaaaacgatgtagtctattagcgcgtgattaattaagtattagttatttttttaaaaaaaaaatggatcaatatgattttttaaaaaactttcgtatagaaactttttgcaaaaaacgtaccgtttagcagtttgaaaaacgtgcgcgcgaaaaacgaggagagtgttggtttggtctaaaagagcgtatttttttaattaatcattttttatcttgagattttttttatacagtgcagtgggcgaggggaagatggacaataaacaggagagaaacgtaacaatattatgaaatctgtgaatcaaaaagagtaaagcacttactgatggagatagcttccaggcaagttgggtggcctccctccgtttctgccttcttcattgtcaacaaccatcgatgcctataaaatattactgaaaaacgctattaatcgttcgagctcgatggcgatgctagctctgccactgcaagcacttgtttttttcatttcttaaccagcacttgatggtgtggttggttcgatatttaagaccttttaatccaaagtgagcaactcatcaaatcccttttacaaacaaaaagtattacacccgtcccaacaagttttagagttagacacaattattaagaagatactatctctatttttaaaatatagttatttctagcacattgacttgttccaaatgaagctatttctccacctaccatctactctcaaccaatcacaactattctctttacctactttatcttttcgaccaatcacaatcctccttcaattatctctatctattttttaaatatccgtgcctacctaaaaaagtatttatgatttgtaggtagataagattatgatttgtcgagaagtgaaaataagtagaaaaattaaatggtgaagggttatgattgggaagagaatgccgacgaagaagttgctatattttgagataaatttcgaacactaaggtggtgtttgagaggggagggacatattttaatccatctcacaaaaacataaatcactcccctagagacttatacttatataagaggtactaaacacccaaacaccacctaaaaaatgttttatcttccgatgaggaattagttagctctcgaacagtagtacgagatttgtgcaagttgtggtcctgtcgtcatcctgtggagttgtggtgagtgtttgacgaattttttttttttttggcggctcgattgcaacccgcggcccgcaacaaatccgacgccaaatcggacacggccggcgactccggcgacccaccaccacacaccaatcctcctcctcctcatcgccgcctgcgacggcgaggcggcgagcga

SEQ ID NO: 7686 - DNA, 1501 bp, Oryza sativa
gcggcggctgcggcggtggcgatgagtggctcggcggcgacgctggggatgcggtgcgggagctacggctccctcgcgtcggccggcggcgggaggaagggcgggggcagggggtgggggtggcgaggcggcggggagaaggagcggctgcagctgctccaccgcgcgctgcggctggtgggccgccggagggccggggtgctgctgctgctcgccgctgcctccgccgccgtcttctgctccatcttcgccgtcgtcaaaggtttgtacgcgctctgcccttttctttctcgccgctgccaattggctgcctgcgctgaattcgcgccgcacgcttccctccctagctgctgttcgtagcgaaatgggcatttgtactagcagtttgttccggtcacgcagttcacgcttgcagaaatccagattagtttatgtctttgtgatgctctaaacattgggaatcaatagcgcgcggcattcattctggttacatactggcctatgctgatcgtgtgatcgcctcccatttacatgtctcagttttgtggtgttgcggatcagctagactaattggatgttgttgtctgtgatctggtctgatggcagtgtcatgtatatcttggtccaggtagagtacttctctataaaccaggttttgatgcatacaagtggtcttgatggttagagaccttcataaggtcaagggaactacacactcttagatttgaaatggtagattgaatcttgcagagctgtgtggcctccgtcttgatcaccgaataccctcccacttagtactaaaatttgttatattacttgggagcctcagatatgataaattgtctgccaatcctaactatcaagggacgttagctgctcatgccatatgcttttactatggaattctcaaacatgtactttattcaaggaattcaaaagaaaatgatgtttcttgaatgaaaaataatatatgtttttgttagaaagcatagtcattgacttgttggtttggtgacttgtttcagatgataatgcttcaatgatcattgcaaataactatgaagtcgcaaataccatacagaactctgtgtatcccagcatgacaaggcctctaatgacgtccagcgaccaattctctgctagtagcgtcaacaaaactgaacttccaaatcgacttcgtctttcatttgcaaactttacacatcatccttgtgaaggtttctcagttgcccctcccctggttgatccgaaacgcactggaccacgacgtaagcttagttctttacatctttttggttagcgttgcaagtttgtttgtgtttgacttgtcattaatcgtaagatatgttctcattttccctgtagcatgtgatgtttgctacgtgcctgtagaccaggcgttcgctcttatgcctccacaaccttcaccatctcctgtccttaagaacttaagttatgtatttgaagacaacatcactgcaaatttctcaaatcagggctc

SEQ ID NO: 7687 - DNA, 1501 bp, Oryza sativa
tgcggcggccggaggaggaggaggaggaggagatggcggcggcgccgtgcacgctgccgtcgtcgttggggacgcggccgtgcaagcgggcgcgcgacctgcgccacctgcgcaactcggtgctgcggatgaccgggttcatcgaaggatgatgatgcatgcgctgctgccattgagggttaaggacaggttatgaagttgaagctgtatatgcatccatggaagtactggatttgtatcatgaatgaggaattaaaatgtaagaagatgatttgggagctcgatttgaattggtctcgttgctttaattttacttgaacaaataagttccgggaaattttgtcatgcttcagtatatcaaaagggatcaaacactgaggatgccgtggattgtaaatacctatcttgccgtgtgaaaattgtcatttatcaagttgggtttaccaggaaactggactaccccagtttaataccacctcgtgtgttacgttgttaatcaacacgtgggcacacagtaagcgacctagttagagagagcgtaggattaaacttggcagaaatcataacaccactctaaaattgccgttttgccgttttgctgtggtgcacaaaagaacttgttcatcctcgctaatatatactccctccgtcccataaaaaaacgaatctagaaccgaatatgagacatcctatgtccagattcgtagtactaagttgattttttatgagatggagggagtacaacccaattaaacccatgctataatatttcagataatttattttaaaaagaaaatcaaatccttatattagcacaaatcaaaacagtctgaacaaaactgtagttcattttcagactctctccacattctcagggatttagcgtctgcttagtttgtgaaaagaaaatttttaggtgtcacataggacgtttgatcagatgtcggaaggggttttctgacacaaatgaaaaaaaataatttcataactcgtctgaaaaccacgagacgaatttattaagcctaattacatatgggttactgtaacacttatggctaatcatggactaattaggctcaaaatattcgtgtcgcgattttcatgcaaattgtacaattagtttatatatatatatttaatgctacatgcatgtgtgaaagattcgatatgatgtgtttgggaaaaaaatttgggaactacacaagggcttatagcgagagtgtgccacacagtaaaaactaaaatgacccacatgttcaaaaacaaaaatgaccaacgcaactgtattagcgtgtgctatccacgtggcagccgacgataaggtgcaccgcactccacatcaaccctgttcggttccttccagcgtacagacacactccgctccgctcctctcattgccgtctccccaaggaattgtgcttgctcaccaagacacgccagcttcttcctcttctcctcctccttgcagcgcacaccaccgtatataaatacgccctcgccg

SEQ ID NO: 7688 - DNA, 1501 bp, Oryza sativa
acgctgcgagtacgtattgaacgagcgagtacgtatgtaacgctgtgacttgttatatctaatagcttattcatataatagttacctgtaagcatatagagaagagaagcaaattttgttacgctgcgagtacgtatggaacgagcgagtacgtatgcaacgctacgacttgttagagcaagtttaatagtgtagctagctactaacttcaatttatttatagccaatctaatagcttattcatataatagttatctgtaagcacatagagaagagaagagaagagaagataagataaaagatagaaggaaagcgggctacagatatataatcagctgtaacacggattctaatacatcgtgtgtatgaaaggtgaaactatatattaatgatgtagtatatgttcatagataactattatatgaataagctattagattggctataagagcaaggctaataatacagccgacctgttggctataaggttttctatagccttctctcagtctacccatataatagtgtagctctttataattaatacatggtctacttgtctctctcacagagttttttggttcttgtgtccaaaccggcggtaagtttacagcccgcttctcctctctctcctctcttctctcctccaccttaccatttagccagcttataacccactattatacttgctctaaataaattggagctagtagctggctacactattaaacttgctctaacaagtcgcagcgttgcatacgtacacgatacctgcacatccaccgccacctgcctgcacatttgacccgggacagtgtgacacagtgtgagtaacgctcatgcagtgcacaagcttcggacgctcggctgcattcctgaggatttttaaaaatttgaaaaccattttaatagaaaattctaaaaatagaacccaaaatttgctttggaacttaaatattttggactcctagtttaaatagtgtggcaaaacaatacatacgtccagtggcgtagctagctaggtggcaccgtggtcaatggaccacctaaaaatttaaaattatagtatatgtgctagttaatataataaaaattgtatagcggatcacccttttaattgacatactacatatagatgaaccacctttactttaaatcctagctacgccactacatatgtcatgccacgggggtgttgccatggtagacaggatgataagatctagattttgtataaatacataaacactctcttcatcccaatgtatgatgtaatttacttttcatataaaatttaaccattcttatttaaaaaatataaatataaacatttaaccattcgtattgagagagttcgtttttttttaaaaaaatacccctaaagttctaaaaataattaaaaaaattgccacgtgaaccacagggccaaattggtaggcccatttagggactgaattttgggtcgctccctaaatgggccgggctaacataatggaccagg

SEQ ID NO: 7689 - DNA, 1501 bp, Oryza sativa
gccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaagaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaa

SEQ ID NO: 7690 - DNA, 640 bp, Oryza sativa
acttctaaaatttgttaaaatgaaaccaacgagacaaaaaaaactctaaaaattataaggtttaatttttaaaggtttcgagaagaattaataaaaacagtggtagatcaagtatgtaaataaagaagggatgataaaagtaaggcgtagcaactggtgtgatttttttaaaaaaataaaattagaaatactgttatgataatatttggtctttcaaaaagacatattaaaatgggcttgatcggttcagctttgctgcggctacactgcaacagctccaattcaaaaatatgctattgatactgtagatgcagcacagctacagacgcagcaagctataccgatcaagcccaatatatatataaataattttatatgggggctaggtgcgtaattgcgcgggctaccaaatagttggaatttatagtagcattggattccgttaagccttaaacgtttgagaagaaagagagacgggagacacgcgtacgcgagcacgtgccgtctcgaccatccgatccaatcggacggtgggaggcaagggagacgggagatacgcgtacgctagcacgtgccgtctcgaccatccgatccaatcggacggtgggaggcgggagcctcttctttcttcaacgcaaga

SEQ ID NO: 7691 - DNA, 1501 bp, Oryza sativa
tcgcccgccgtgtgctcgctgccatcgccgctcgagctccgtagcacccgctcgttgccagcctcgctcggcgtagctccgcccaatccgacgctagcatcggattcccgtggccgcgtagatgctctcaccgccgggaatcggcccctcgtgacctcgtcgccgtttccctcttccctccccaccggttgccgccgccgcgattcgccgccgtcaagcttcctccggcgaatccgagccgttggctcgtctcccctcgtctcgtgcaaccacccggtgtgctcgctttcgccggtatcgccgtggttcgctccgccgctcgccgctgttgtccgccatccgttccgaccggcgtcgtcgtctacctcccgccggcccgcgtggcagccacgtcggcgccacgtcggcgccagctcagccgaggtcgggacgggccgaccccggtcagcccctcccgtgcacgcgttccaccgcgagccgtgaggctgcgcgtgggcccgccgcatccgttcctccgcagaccgcgcgcgtgcaccgcgtccctcccccgcccgcgcgcgtgcgccgcgtgctccctccgcacggtgagccgagccgctgacaagcgggtcccacccgggaccgcgcacggtgagcccggtccaccggccctctctctcctcccctcccccgcgcgcacttgggccgccttgggccggccggcccatttagctcggccagtccgctccttttcccttgggccgcgccctagccgctcgaggagaagtctataatccctccctctttcccttttcttttctttttcttttccaaaaaggatttaattaaatccttttcctttagaccaaaaatccaataatcttagaaattcaatatcttcccaaccgtagatccgtttgactccgttcaacttccaaaattcctcaaatctcgagatctatctaatggcacgcttagaggtcattattagggcttcattttcgccgtttgttgagttgtcccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgttgtcccgtctgcaaggcagattggcggatctacctagtttgttgcatttgatccttcctttgttaattgttataccatgtgcccttgtaaccacccagttgcgcctcggaaatcatgcaatctgtgcgagtaccgaagggcgccttcaaatttaaaatctgagcaacttcttgggtaaaacttgagttttacaaaagacttggaaaacccgacacctaggtcggtgcttgtgaactaaatgaatttccaaaaccgcggaccggggaacgtaccgggtgtacggttttcccgctctcgcacttaagaaccgattccttggaatttcatcta

SEQ ID NO: 7692 - DNA, 1501 bp, Oryza sativa
tgaatacctgatgatgagagcttctgatcggtccagacaaaattgggcatctgttttagtccagaaatttctgtgattaggcataaaaaagtttacatggattacctggcacgtcatgctgttacgtatagtacatgattttctctctatgtgaacgcaaaatagacagctctctcctatacgtttctgagggggaaaaacgcaaaagacactattttcaactaacgaaaaagtttatatttcttctctcaacttttcatgaggttttaattttcgtccatcaactttattactagatagaactcttgcttcgactattaaaactatgcaaacaatgctagttgaaacttaaaaaataacatctacagatacgctcatagcgtagtgacaggggttgctgtcatgcaccccattcgtccgggttcaattctcctcgaacatgctcactaggaatatttgcttatcttcttaaaaccattgataccaagtcttttcttggtgtccaacttttaaaaataacatctacatatatcctcatgccatatatgtacattatatctacaatgttccatatgttatttaaaacgacctgctctaatatcgtttaaaattgaacgagcaaagttcatacaccatttgtcaaaaccaacgagtattcatggacgacgaagtacttccaatccatacattgttgtttcctaagagcgagtttaataatatagctaattattagctcttaaaattaacacatcatgtatactagctaacttaatagcctactaatataatatttaattataaatacatactgcatcattaatgttttcctcacatttctctcacataggttattggatttcgtgttgtagccggctacgaacttgtagtccgcttttttctctctcctcttctatcttatccacataagcataaatatgatgtggcaatatatataaaccgcttacatcatatattatattattttactcgctctaatcctactattttcttttaccaaataaataaatctccacccttcatctgaattttctgaacccacccacccttcttccttctccagctctcgcctctcgcctcgtccttgttcgtcatcgcgctcgctcgatttctcctcctcctctctctcgatcccctctactgcgagagattcccttgcttgaattctcctcctcctcctcctctccctccggtgagcggtggcggcggcggcgaatccgagctcctggtggtgtcgtggggggcggggtgattccgtgatggtcgcccgccgcgctctgcggcggacacggacatgcagcgcaacctctcctccatctcctcctccgccgcgtcgccttcgccgctctcaccggccgacggcttcctctgcggtaacgatcccgggcgggccggcctgcttgtttctttcttgctgttcttgctcctgattctttggaggaattccgtcgaacacctcgcctgcagttgcgtagcgatctga

SEQ ID NO: 7693 - DNA, 1160 bp, Oryza sativa
tgctagctagcatgcatggacccccatggaattttacttggcaactaattttccacacctaaccttaaggaagtaataattttaatagatattgttcggttcctgtcacaactctactttgtcctcaaccttagttaaaatgtatgacaacattagtcctcaagcccaaattctccaataaaaatagccattgaaaaatgcagggaccttaaatacttatataaagttatacagtgcaagttatgggttttttttcctgcaaaataacaattaattagtactatcctgctagcatgggttggaacgtacaagcgtgttatagagagcgtcttgtaagatcattttcacttgagtggtcggtttaaagttagtacggactaagcaagttgtcacatcgcaaaaagtgtttcgttgcacttattagtatccaccttaagtttaattttactcaagaaagaattaatatgttttaattgcgggaaaatataacatgcagataaacataagaaggtgtccatattaaagaaacaagagtactttatcaactttgtttctttaaaaagcatatataaatgctaaataagacaccattaacttgaattaaacatctacagctataggattgtgctatcacacaagcaaagctcggcagctctcagtggtagcattcatcagtaggccaatataattataatttgtagtgggccatgggccatattttaaatcgccttcaatcctattaccaatattggatgggccaatcctagccgttttcaaaaggaataagttcacctaccatcccttaactttacatcgagtttatatgacatcctcaatccccaatactagatatgtctaccccttaaatgttcaaaaccgtgcaaaataggttctgtggcagtatatatgggtggtttagctgatgtggcttcctaattagcaaagagggaataaaaattatggggcccagatatcatcctcactctaattctcttctctctatcctctctcagccaggagcagggcaagcggggtggcatcgggcggagcggccacgcacgaagcaggtaggaggaacgacgatagccggagctggaggcaagggggcggggtagcggcggtggggtgcagaggagacccgggcaacacgccttctacca

SEQ ID NO: 7694 - DNA, 1346 bp, Oryza sativa
tgagcactaaggagcactcctcatagaacaactagcagtgagcatgttatgcaccattggaacatgtgtttggctcctaaagaacatgatgccaaggtagtaaacatatcacatattacatgaacgatattaaataaataaacctcaattttctatgcagttttcagtattgatttgtcagatgtacacctcacagtggctaagggttccagttaagaattggattgaaataaagcaataaactgcttgttttctgattttttttgtttgacttcttttctatttttattattcacctttgtcttgaaaattcgtgatctaccaagtgcatctgtgcacgacagtaattctagtaattaggtataaacaaaggttgaaaaggcatggtttggcacatcaaagaatagaccatgtacgcgtttgatgtctattattgccataattaacagtttgatattagctccatccgcacatagtgtagcttaaacaggtccgtgaacaacaagtatgagcaacgatgtggatgacttgcttgctgatactagacatggtggacacacaccagacagtaacatatacttggcaaagtagtattgatatcggaacatatgcttaggtgctaatgcaagattgcatacaggtacgttttcctttttttggatgcctcgtacatgctctatagttgttcagtgaatattctacaaatcccctaaaatacactatggtcaccagatctcttgtgtttgacatgaacaaagatccaaaataactaaccatataacaggaaggaagtactccttactaaactaaaaaaaaaactatgccagtttcccgccacggtctggaggtgttacagtagacttttccctattccattttcttgtgagcacagatatagtagagaagaggcacttatccaaaaggagcatacaagatgagcaagctatggagacccaggtcataaaaaaggacactaaagtgcatataccatatacccaactctccaacccagtacctgcaagttaactgtcgttaaatgcaggacattaacatgtgtcgatatattattgttttgcataattagattatcagatttatgctgctgaaaatcaagcccagttatgacaagggatatcaaaacattcatagggaataaacatttaacacctgcgaccctggccgcgggaagtatttgtatttatatgaacttgtacatcagtttggcgctatcgctagtgttagcaaaatcatacttgggccatcatagtgtaggtatatgaaactccgagtatggtaattagccaaatcagaggcaacaatgtatgtagcatgttgtccttactaca

SEQ ID NO: 7695 - DNA, 1501 bp, Oryza sativa
ggtggtaacgcagcgttaggtgggggcgtgctagggagtcaagaacagaaggaagggaggcccaactgctccatcctccctttccccaaatccactccttcctttcgatttgcctccttccttccttggttcattcattgatttttgcaccgcatttgaggaagaatgtgcccgctgagggtgatcctaatcttcctctccgccaccatcgccggattcttcctcatccggggcctcaacgccgatcccgacctccacgacgatgccgacgcctccgaatccccaagggaaaggccccccgtgcccctccattccaaggtaatcaaaccaaaaaaaggggaaaaaaaaccattctttcttggtcgctccatactattcttgggttaggttacctcacacacacgtttcatgacatcccttgctagaggactaacgcttcaattctactgcttaattcctgctacgagccccatgtaccccgtctcatatggcaaatcacaacattgtcttgtctttgacttctagtttgctgttgctggatatggaagctagcgattctaggaatgctttcttcttacggctgaaaaaaaagaaatcttctagctaactttcctatgaaaggggacgaaaatcatgtgctttggaaatgtttctggcatatgcctaattttcagataaatcacaaccatatgtttctttttagtgcacacaacatgttctctcttgtttttgttttttcacagcagtacttcactacacataatcgactcatgcacagcaacaacaaaaaaaatccaatggctttcatgctaatttttagattcacggcttcattttcggtcatttttttcagccttataacaattagaacaaatgtttcagtacagtattgttggttcctgctgattgtctagagcttggaggttgaaaaggaactaacacccgccattccaaacttatatgcaaccactgttataatacgataagcaaagatattgcctgttcttattccaaagaaaaaaaactgcatgcaaattatcaggaatcatactaaaaaatgagctattttgaagtatttctatagttgcagtatgcttgataacaaatcttacttaaacagcgacatgtagttggctagttggcagtgcttcttacattgtgttaaaccatggtatcatggttttacattgtgaacctgtccttatggattatgtaagcataatagtttatacactggagatgctggattgttgaaagaagtactagggaaaagattgggttgttgtcctgttgacgatgcctgaaatttatatttccaggcccacaaacttataaccctctcttttttttcttaaaaaaaaatttatagcggaagaagattttttcttcagggtggagcgcatcagaacgccgtacgtaccacctacgaataataggtagccccaccccagacagagtttgtgagccgtgtaattggcgaccatttcgcgcggttcgggtc

SEQ ID NO: 7696 - DNA, 1501 bp, Oryza sativa
catgaaacgagatttggagggggaaaagtcccttcaaatatttttttaaaagaaagtgtgagcttattaagaattaaatatgagatttcagggttgaaaccatccaccgcttaccacttcattcttatgcgtaacacaaagtttaaggatggtttttccggtgtgcaactgtgattcgtcttgcagacgctagcttttacaagttgcatcagtactttgaatagaaaatgaagaaagtaagaacgaccctatatttctgtagtacagtctcattttaacaataaaacgccactgtccaaccaacaagcatcatttcgacaaaactagaggttacagtcgaaccatttactagtaaaaaaaaaaatctctgtcgcaaggatgaaattgaaatgaaatttgcaaggtgtcatgcggacttgtaaaaagaaaaaggaattactggcctacttgaaccggcccgttggacccattaaggaggaaaaatattactcatgttaatcgggccaacgggcccaaagacgcgagctgccgcagatttaccttcatctactccatccatgccggcacctccgccgccgcccgccgtctccaactccactgcatgcatcgaatacctccggccattgctataaactccaaggattacttactgcttttcgacgtatatatagagggttcttcgatcttctttaatttctctctccacaccatattgatcttcttcttcgttgcgagctgttgcatggtgtctaatctacattagaatcaggtcgtctcggcgtttggaatttggagcagatacgtaccatgggacgacgacgatttgtgaacctggtggtgcagggcgccggtggactctattctctgcgccgcatacccgcgaatcgtctcttctacccatcaacaagagcagctgaagaagcaacggcaaagtcacaagaatcattcatggaggagcacggtggcaggaagcatccaggcctccacaccatggagatgttggagaagcttccccgttcgacgttcgccttcgagccggcccccgtggatcgctaccatcttaggtctctcgacttcgcctgtctcctcggccacgagagcaggatgctcactgcagacaacaggggaaacaccgtcgtcttcgacgccgactcctcctccgtcctcgccttccccaacctcatttctcccaagaggtataacgccatatccctctccattatcaacaacgatggcagcaacaacaacaacgggttggaaccaccgccggaggacggcctctacgtgatgacccggagtcccgacgtccacagaatcaaggatggttgctttgaggtgctcaactactcttcttcctctgccgatttccgtgagatgacccctcattgggtttctctgccaccaccgcccttcgccggctgcatgaacgccgaaattacctcctacacggtggttcacggcaccaccatctacatttcttgcaataagccaatccattcta

SEQ ID NO: 7697 - DNA, 737 bp, Oryza sativa
tctctgaattcgtaattgactagttttattaatcacctttctgaacttgaacgaaagatgtagaataattcacatcggttgcaaattttaattcgtaattgactagttttattttgttagcttctgatttactgtcctagatttctgataagtacttagttgaagttccttattatattaattatctattacataacacgttgaactcatgtaagttctgattgattctagggaacacttatattatataagtagtaggtacaaaaatgcatttagtattacaataagccttcaaaattcttcgcattaacttttgtttggttaaagttcttacagactttcagattattatacgtaccttgttagcacttgagtgcatatcctaggacattcaattactaaatctgatgcctggttttgtttatacaggggaatcaataaaaaaaacaagcagtgaaagcctcaaggaatgctgaaagatgtgcttgcatagaagaaattttccgtgtgagataaaacagattgctggttcaccagtgctactgatctactcaagtcttgatgtgagtgatcaactttcctgcactaattctacaccatttagactccgaaacgacgatgatataagaatgttgttctccatccacgatcatgaccttggggaggatggctaaagaattgcagtccatctgattggtggtcaaaacatagtgctgagatttatatctttgtgggca

SEQ ID NO: 7698 - DNA, 1501 bp, Oryza sativa
attgctgatctctcaagtggcatgtatatgtcatctgcatttgacatgccgcagctcagatcaaacttaaaaacagctattgtacccattgtatacatgactggagtagctgttgctttgacagaagagaggtacatggttgacatggctgctagcaatatacattgctcttcttcccctgccacatcatccggtttccgcttttcaaaaatccgtgaaaatatacatgtattatctaaaaaatagataaaatgattacatttaattcgatcggcagcagcagcttcggtggctatcacctccgtcgctgcaaattagtccactggttttaaatcaaatatatacaatttaacgcacatgtgaaaaccgggccgcattggagatgcatgcctatacgccttttttaataataataataataataataataatagaaataggttatatcttcggtcttgccattatagaggtacatggttgacatggctgctagtaaaaatatacattggtcttcttccccagcggcatcatcccgtttccgcttttcaaaaatccataaaaatatacatatattatctaaaaattagataaaataattatgtttaattcgataggtggtagcagcttcagcgccatcaccttcgctgctgcaaattagtccactggtttcaaatcaaatatatacaatttaacacgcatgtgaaaatcaggctgtattggagatgcctgtacgccttttttaataataataaaatgagttatatcttcggtctttacccgttagacacactgtcatccagaggcctatatatacagagcacctatcacactgcatgccatgctcctcatccaaagttcagacaaccagaaaattaaccaagaattgctctgcctatagcaagatctagtagcaaagcttgactctgagctcaggaggaagaagatggaagggcacaagagtggcatggaagctgtagcagttgccatccctcccttgcacactggtgagagcaaccacaggattgacagcaatgtcagctcgcaatgccatgctgatcctgcagagctctctgatgaaactcagcagcaatctctgtggcatctaggcctaagaaagataataccatcatctgttcctctcctcaagaaggtacacactttttttaccccatattttcacctctcatcgtctgttttttgtcttatcagttgtgaccaaaatttgaattttaaaatataattttagagtaaattttgaggtttatttttcagtactgacttttaaactgctaaaaacataggtattataaaagttttgcccataaataatgtttggttaaacgttgttataaaagtttatttttccacactttattggccatagattaaacaataagagcaaaattcttgaacttcctcatcctctttctcttcttcttcagaaaatgtacagatatctgacagacaacaacctttttcccccgtaatctttttcttcaga

SEQ ID NO: 7699 - DNA, 536 bp, Oryza sativa
attcctgcagcccgttcatggagatggattcgatctaatcgataacccagcttattccaaaccaaagatttttctcgcggcaggtcggcaggcaaatttgactctaattttcggctgtcctcatgagcttgatgccacagggcacgagcgcgttgcgcttggtgctcgggcttgagtgcttgaccttgacgcctcgccgacgataggaagatagataaatgggaactggagagatgagggagaaaggctattctgagattcatgtgggacaggtgtcgtgcagaggaatcaagtccttcagataagggtaggacttcagtcctacgcaattttcttccaacttgattacctgcatggttacgctcactggattaagactggctataaataggtagagcacgatcacaaagagagttcagcctttattatgttctagtgcctcgccctcgccgccaccgccggcatactccaagctcgtgcccagcttgacagcaaagctacaagtacaacccatgccaatcaatgaactaagatct

SEQ ID NO: 7700 - DNA, 781 bp, Oryza sativa
attcctgcagcccgaagagaaaagagagttagcctattcaaagatttgcgcaagaggtgccggcggcgaggtgaccggcaggcggcggggcgtaggaggcggcggcgagccgtagagatcccgacggcgaggcggggctcgcctgcacacgggccgccggatctggctcctttctcgccggatccggcgcccccctccctccctcccactagatctggcctctccggcgaggaaggccagctcccgacgacgagacaggtacagcagaggaggcagtggcggcggggttgagggcgcggtggcacgtggtgaaggggcaggcggcagatgtggccctcggtgacggcatcaggcatggggagtccagcctgtgaggcccgcgtctacgtcagtgagtggcgccggaggcagtgaaaaggagaatgtgtggaggtacggcggtgcttgaggtgtagggggaggctggacgatgaggggtgacggagggaggctggcgcggcacaggtggcgccgacggcagcgggaggtcggcgtggcatgcgatgcggcgggcggaggcatgagcaagtgcatccatggccggcggggcacgcccagcgcgacgagtggctgtgaccagcggcgggatgtgtaggcgtggtggtgaccggcgatggtcgtggattgggcttaggtgctaaagggatggtgtggtggtcgggcaatggtcgttgtacaggatggttgtgtggagttttgattggaatcgctggcgaaagccttgccaggccatgggccggca

SEQ ID NO: 7701 - DNA, 264 bp, Oryza sativa
aggagaggaggaaggggaggagtttgaggagaggggatgaggaagagagttagagatgatagatccgatgagagggtgtgagattcgatctttctaagttgtaactgtggaggaccaactgggtctaaagtggtgatctttagtctcggttattaacaccaaccgagactaaagatcctcggccccctgacatacatctgacaagggatgaaccgtgtcggtgatatgggaccgggagtattgcgcccggaggcttgaggcaga

SEQ ID NO: 7702 - DNA, 260 bp, Oryza sativa
ttcgtgcggcaggcagggagggagctctcttcgccggcggtggtgtggcgatgcgaggaggtgggcggtcgcgtgcggtggtgcggcgacgcggggaggcgggaggcgagacgccggcgactcgcgacgacgaccttgacgccgctcggggcggagctcggcggcggcggctcgcgacgacctcaacggcggatctagaagggggcggcggcggagctcgaggcggagctcggcggtggcggtggcggtggccggccgca

SEQ ID NO: 7703 - DNA, 1501 bp, Oryza sativa
tagtagtatcgagtagccgacacaacctcagtttcgtgttacaagtcactttagcttttgccacaagtcgaacttcctattaacagcattcatattaaaatacactaacattcacaacaataaaactatacaattggtcgatgttagatatgtttaacttaagacaaaagctaaagtgacttaaaatatggaaccgaaggaataatagcgagtaggaagacaaggaaattaatttgtgcagttcaagtcagaacgtagcaggcggagacgatggtttttacaggtgcaggtccagagagctcctggagattttattcaggtagtgcgccgggtaagggcacctgcttgcccccttgcaagttgtcaccgggagattttcggtcgcgtgtggcgacatggtctggcagcgaagattgcaaggaacccagattataatgactaaaaatctaccctattagctccgcctgcgtcgctcgccctaggcgacacgggcagcgacaacacgcgccgacagcccgcttcctccccctctcttccgccttgccgccgcccgagcagctgccggcaaagccacgcagcagcaaggatggtggcggcggggcctcttttcttctctcaaggagtacggcggggcaccggtgggacttgagcgactgaggcggcggcggcggtgccgccagatccgcgccgctccggccggatctggcgggatggcggctggcggcggggaaggtgatggcggcgggggtgatgatggcgtcggggatggcgagctgcgtctgttattgggggccgtcgacggcggggatggaggtggcggcgaggctggcgacggcgggccggatccaggcacgccggaggcggatccggccccccgtgggtggatccggccccccatatgggcggatctggcgcgggagctccacgtgcttggcggctggtggctggtggcggtcgcggcagctggtggcggtcccgacggctggtggcggcgtcggggctgtcgcggcggcggctttggctggcgacgtcgacagaggacatggcggctgcgtcagggtggttgctggcagcggctgcgttggcggtggcggcggttcgcgatggcggtggctggcgtcggcggctggtgacagcggccggcttgcggcggccatgactgaggaggcagcggcgacatcggcggatgtggcagtggaggcggggaaggagtctgtttggtggcggcgggcgacggcgcagctgttttgcggaggcggaggctggcgtcggtggcagcggtgacgtcggctgtagccgtgaaggtggtggcaacgtcggaggatgcgggtcgctggcaacagcaagtggaggcggggaaggagtcgggtgcgaggtgaggatggcgtcggcgaggtggctgggtgttcggcaacagcggctgcggtggtggtgaccgtgtctgcggccaccgaaggcatggcggcctcggacggctagccgagggcgtgggagacgacta

SEQ ID NO: 7704 - DNA, 1501 bp, Oryza sativa
agccttgacttggactgcagcgggaacaccactccacatgcatcattgacggcacggacgaagcctactcttcggagaagccaccatctgacacgtactcaaactctggggtttgggagaaaatagagcaagactgagtactacccactgtactcagcaaatcataccggaataggggtatgatgcaggatataaccaaaggataggtagagcggttcatttgcataaagcgagcatttaaaaacagtagttgaaagcagtaaaacagttgtagtaactaatcaatattaatcatccactgtccaacgctacaccacgttgcgacaagcccaaccatccacctgaactaaccaattccattagactagactagggtgagactaatcacagtgaatctggttgatcgcccataaccgcgggcacgactattcgaatagttttactctgatcagaggtgtacaattgtacccacaacacacagccccacgacacgttaccgtgcgccgacatgccaccacgacataccggaaagaggccgtgacaggatctttcgcataaccccctctagccaagcacaccacacctcaggtttcacccccgtccgcagcgggcaacgggcagtcccctctcgtgcctaggtgaatctggaagcgacagaggccgtcgcagggcccgccccgctccatcacgcccacccttgcctggatgcgtcaactagaggaaagctacactacaagcccagccgttgcccacgctggcttgtggtaagtacgataagttcttccagggcatcccgcgaaccgatccttaagtgctatgggcgcgaccatcaaaaccatgcacccacagcccaccatttaatgcattttaattgactaacaccaggacggaggctttaatccaacaccaacactagaacctgaagtctatgcattaatgtgattcccccattgtgtgctagttgaactaagcatggctaagcaatccctagtccaatatctagtcatgttatatcccaagctaacaaaggagcatggtacaaaaatagcatggctgtacagtaggtatacatcccatagtaacattataaaacaatacagtatttaagggaaaacgatagaacatttgtaatatgggatcaacatgttcaagtgacaagcatgacttgccttgctctgctgctggtggaacctcggcgactatttcaaagtacaccggagcgtcgggagagccggaatctaatcaacatacaaagcaaacaatacaaacatgccataagactactgaaacagagaacaaaaccatttttaatggattctatgcatttttcttgatttactgagacttgcatgggtttaaacgaagctcggatgaattttctatgaattttagaagattcactgtgtttttactataaactgaaaaatccttaattgatttattgcgtaataaataaaatcctggggagagagaggggcggcgccgacatgcgggccccaca

SEQ ID NO: 7705 - DNA, 1501 bp, Oryza sativa
aataccctactcctgtgtttttggtggatctgtgtaagagcaagttacaaaaaatcaaccagccctctcctctcccgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcagggtcggggcaggagccacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcacttcggtcagcgagcgtaattaacgcacacacgatacgatctatctcgactgccacaaccgcatatctaccttatgcgccgcaagcgggcgaatggaattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgcccctaactctctctttgctgcgcctcaccttcgccacacacactcgttctcaaccctctctttctccgacgaca

SEQ ID NO: 7706 - DNA, 1501 bp, Oryza sativa
gaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggtggctcctgccccgaccctgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgggagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagagagagcttgagatctcaccctaagcccccggccgaactggcaaaggggggcctgcgcggtctcccggtgaggagccccgagctccgtcaaaccgggactaaagatcaaaatttttataacctggactaaaaacaatctttagtcccggttctttttgatccgggactattgtgaattttgccggaccgatcaaagatggtttcttcaccagtgtaacatactcagggtttgtcttttttttttttacggagagagtacgctaaaaagataaaaatcaaggataaagcgctgatatg

SEQ ID NO: 7707 - DNA, 1364 bp, Oryza sativa
agaagccaagggagagaaagaaaataaaatagcagaagaaaatgagagcaaagacagccgcatctgtgcagcagcgcggcgacgtcgtggagagcgacatgcgagcacgagaaaagccggcggtcgtctggcccgtccgtcgtggtggtcagtcaggcaggcagtcgcgcacacacgccgacgaacggcgtggctcctgttcccggacgcgccgctgcagcgatgcgcgcccgagttattttcgttttatctgtctcaccgctgcgtctacgtgttgggtttagcgcgcgacgtgtcacgctggccggttcccgcacgggacacgcacttggcgcgtagccgattcaagcccgacgcgtgtcctcgtttcgggaacttgcaggcacgttgtcacgtactactataggttttcccggtctagcagcccagtttttctacggcctcgaccttttttatgcgagaatgtctttgctttgttcagaaatggcaacggaaattgttcccccgcttttgcttttgtccggaggatgagttccgtgggaaatggatgtttaatactttaaccccgttattagccgctagtttttggagccgtttttatcttttcctgtgatccgttgttggcatctgatgaactgctggagaaaaaccttttcaatgcaagttgaaaaggagcctttcagatcaagaagaaccgcagatagccacctgtcctctgccgctgtctctgccacttcgattggataaaccaacagtcagaagtttattgacagctgttaccgtcggccccacatgtcagcggccacgaaccagccgagatgaggataagatcagacataacggggcatccttggaacagaatccgggaaagccatgtgggagtggccactggcctggccagcaccgcctttaaggcgtgcgggggccacgtaagtgggaccacctttgtcagtgtcacatgcgcaacctcccggtccgtgtgccatgttaggtaaccgcgcgccacgctcgccggcaaacgtgacgcgaggcggatcgtccgttcgcgcaatcgcgcacgcgcgcaccgttgcctccgctctttctttctttttttttttgcggcaaattccgcatgctacgttgcgttttttgttggtcaaacggacgcgcgccgtgccggtgccgcgttcgaaagcgagcgggttgttgggtgcgcggcgcgttattccgttcctcccgtatataacacgcgccacccccgcaccaccgccgctgcaaaggccagcgcccagcgagagacagccaccgccaccggagcagctgcgttttcagctacttttccgtgccgttttctgttggggggatcgcgttcgccgacgaga

SEQ ID NO: 7708 - DNA, 1022 bp, Oryza sativa
attatgcaactctatttgcatactacaccttcttttttctgtgggggagcatattggtccttttgactgttacattgggcttcattgccaaaaaagaaaaaaaaaagcaactgatcatttttggtaaagtcaaaaattggcaatgctaaaagtttgtaaaattttggcaacataaagatatgaaagtgatgtttaatttgatgccttaccaaaatttagtatagtttttatgagtagaagttcctagaattaccaaatgttggtagggattgaaaaggttacatggtaaagtcttgtttattttgttgtcttaccaaactttgataataccaaactttggtatggttgattttagtaataaattgaataagcccataattccatgcggaattgctattatatactattcttaattgttgctctctactgttaaagaaagttcactgcactagattttaaaacactgttttattggatggaacatttagttaagggtatttgtggagctacaacaatgtaattaattaatttcagtttgttattcacggaagattcatccaactaccataattcgtggaaaaaaaacaaatttcataacataaatgaataaatggtatactacggtaccttttccgtttcgatttaccatatggtattatttacgcgtcttgtttattgtccgattttgttatacacattttgttatgaaccacaccaagacaagtttgtggagtccaagttgtgccttaattagccctcaccaggtctatgaatattacattataatttagacatgtttagattcgtactatttatttgccatatcaaatataaataattatggggagagttatttcgagccatagatttaccattaagctcttatattgttcttttgacacaataagctattatattgtttatacccacacttcatcaatccattggctatcttttttatcgtgggtgcatcaaaatgttttactatagttccctagattttgtggtgtgccaaaccaaca

SEQ ID NO: 7709 - DNA, 1248 bp, Oryza sativa
gtgcgatggctggtaataggatgccacgttcttgttctaagtggaacacccacgtcatatcacggctgaatccattaattgatagtgtggttttgtgaaactatactaccaaaatatacgtacttaagcgccaagtgtcaaagtgtgtgtggttttctacaatttggaccacaaaacatatagttttgtgaaatttactctaaaaaaatgaatgtacaaatatcagaccaacccaaaattaaaattacattggtggcatctgcactacagcatttcctaacatgccacttggtcatgaataaaaagaatttgatgtatttacatttggctgaaattcatcgatcggtaagttccaagaaccatggaactcctgctgcaaaagtactccctccgtcccagaatataagaagttttagggttgggtatgattattaagaaagtaggcttcttatagggttggatacgattattaagaaagtaagtagaaatgagtggtagagggttatgattggatgagtagtggaggtaggtgtaaaaagtgaatgatggaggatggtgatggatggtgattgattagaaagagaatgttgatggacaatttgttatattttgggacaaatcctgagggctaaaagttattatattttgagacagagggagtacatcgtttcggttagtcacaagtatatatatatacagacatatatgtacctagaagaaataaatttagtaatttgcatgaatctctccataatttttgttctacgtgtttgtaactaaagtttattccaacatatgccccagtgccagcaattgatttgatggcaaccctgttgctctcgcttggctccattgtcggcacaccaactgctgcaacactaccattgctttccttctcttccctactcatctcaaaggccatgagcaatgtctgaatttccgaacttggatcagtggtgtggttgatgtttggatgaacagcacggtgcagtgaactgtactatatactgttatatgacactgttgattttcgcacaaacgtttgacccattcgtattattaaaaaatttagtacaaatatgttaaagtataagttaggattatactctatttaatgataaaataagtcactacaaaataaattatatttatataattttattaataagaccaatgattaaacgttatgtaaaaagttaacggcatcatacattttaaaatgcacggagtatatttgtgccttgactt

SEQ ID NO: 7710 - DNA, 1501 bp, Oryza sativa
tatatgccacttgttatacttttctaggaaaaacaattatctatcttacgctgatttaccaaatagaatgatagttttttcacaacctttttaacacaatttaaaaatcagcacagacaaccaaaggctgagttgaagcttgttgtaagcattgtatattctacagtatgaatgtcaaacttagaagtatgaatcaggtcttgttcaacagttcgattatgtattttaagtctttaacacaagaaagctatagttgtagtacacaaatagtcaagataattcttttaataatatggaaaagcatgttaacattagatagctctactattaccaaccataaccaccatactatacacagcaaccagtggcggagccaccacccggcctgcacaggcagccgcccaggctcgccgtcaaatacaccattgaatttttatttttttttcaaaggattaaagttagaaatattgtagcaaatattaggtatatttgagtttgcccgggcttgaaaaatttcctaactcctctgctgacagcaacagtatagataacaacaaggttcccctgctaattaagagtaactttgaacctacaagcaaaatacataagcaggattgaaacaaacattttcacacagccaagaattaggacaaaagtccaccaatttgtgttatgataagctttgcttgtgacctcacgccacacagccacattctgaagtctacacaattataaacatattagaaacccaattctgttgctataattgtttgtccatcacagatatttcgttaacaagtcatactaatggataaaatcaagcatcataaccttaattaaaatatactcacgttcgaagtcggcgatcggcggcggaccaacccgccggcagctttctgttcttcgggggtggctagccgaagagcgcacgtgaggacggcgggctcgccggcgcagcatccggcgacgtagacctcgaacgcggaggtctccgcctccgcccccgcggcggggatgcagtcgattgcccaggcgggggaggaatcgggcttggcatcagggcaccggcgaagagagccgcggagcagcgcggcgccgcggtggtcggcgacctcgaaggccgccgagggtggggggaggcgggcgaacgcggtggacacgtaggtggcctcgccggaggccgggtcccggcgatcgaggcggagcgggagggaaaggggcgtcggggcctcctcctcgtcgccgccgcggctgctgcgcagcgcgagcgcgaggcggggcggtggggtgggcccccgcggcgagaggcggacgtagaagaggcgcacctcgaggctgccgccggagtcccgcggcggcgacggcggcggcgggtggtggtccatgcgcgcgaggcggcgacggcgacggacgcgtggattgaaaggcacagtggagcaggatggtttttgtttagttaataatattttttttctgtggggaaaaatggtttaattaaggt

SEQ ID NO: 7711 - DNA, 1160 bp, Oryza sativa
gggtgcctagcgtcatggtatcatgcagtggtagtggacagacgtcaaatggataaagcggcacggaatgaaagaattcacatcctcaatggcaaaatttaaaaaggcgtgcacattgaatttcaaatttgaaaaggtttgcaaattgagtggtgtataatgaaatctatcgagcatgaaatatctttccctgttcatacaaatttcatttgaaatatgtgaaaaacatttgagcttttcaaacccagggtttaagatactataaattcgttgtattatgatgtgtctaatataggttactatatttagaatagagatagtacgcaccaaccacttgagataatacaacctctatttttaatatacgacgctattaactttttggatacgtttaaccattaatatttattaaaaaaattacgtattatgcgacttgatttattaaaggttttaagcatgaacttatatttgatcttgcttaaaatttttgagtaaaattaacattgtcgtatatttaaaaacgaagagactatatatagtactattcacgtcccatattacttgtcgctttgactttttgcttaaaatgtttgaccattcgttttatttgaaaaattagtgtaaatataaaaaagataagttatacttgaagtacatttgataaccaaacaagtcacaaacaaaataaataataattctaaattttttaataagacgaatgatcagatattataaataaaaaatcaaagcgataaataagtaatatgggatggaagtaatagtattattttttgaaaagaaaaacagacattccggatccggacacagcccacgagacctccttttcatacagccggcgtggcatttgtgggcccaatctgtcagtgccacatcaccaccacacaaccgcaaagaaagagtgggccccaaggcccaagccgagccaaaaaaaaaacccagcaggccagaatccagatcaccactagttccagcctgtgccgctcctccgtattataacgcggcggtatctcgtgctcgtgcgccgccccgcgctcccgatcgattcgctctctcgccgccgccgccgcagctgacgccgtcgatttggttggttggttgatcggcggcgaggagggggagggggggggggaggatgtggc

SEQ ID NO: 7712 - DNA, 1094 bp, Oryza sativa
tgccatcaaagaatggttgctgcttttcattttttatgtacaatttatactggtttacttgtacatggagtagatggatataagaaagcacagggattaggttatgccatggggatggcatttgaaaaaaaaaattactcgcatataaaatgcgcatatagaagtagtatgtgtacatgaagtttgaaacaatacttactgaatcttttatcatgtaattttgttattgatcagtccggtaatgtgcaagttaccatgagtaatttcttacatgaagcttgttaatttgaagtttggcgtcactcgaattacaaaacaaaacttccagattggtatttactgatatttttgcttaaacacaatttgcgtgcacagctgcagagaacaaaaatgctgctgaagcatcaaatcaatgatctttacatgacctttgataataatctttacatgacctttgattcaggaagggaagacaaattgagagcaagaggtatggtaggactggagaggagagagccaattgtttgtcatgtacatatgattcttttctcggtaattaactccgaaagaaattatcaattaataaaagccctaaagctaccgattctctcttttttttgaaatattatttttttttgctcctcgttaggagctcctcgattgggtgagctgtggagcctttccttttctctctcttcgggttccccatcggttctgccggtcacgcgctgcatgtgcgtcacgttttgcctccttggagcaaatgacgcgtgctgatatttatgcaaaaaaatcctcgtgtttgaacggaatagcgtgcactgcctcccaccgactaacatcacgttccattttatacgaaacaaccctcgtattttatagaaatacaacacgaagaagatagagttctactcttagggggtagcgatgtaaacataaaaaacaagaggttttttccaaaaaaaaacatatcatacctatcccctcccctcccagctcccacccccaaactctatcctcacatcccctccccacgacgcttcgccgccgcccctcccccttgctctctcccctatcccgccgccggccggcaa

SEQ ID NO: 7713 - DNA, 910 bp, Oryza sativa
ttttacgtaaaaaacttaatattcatcttcatctccatcttcagaagattcaaataccatcttaggtggtgtttgagccagtttggataatggattaagagaaaaaaaaatcacctatcaacatgattctcttttggatattagaggttagtcgatttcttctgccttccattatcatctccctctcactcattttaatattttatcgtaaccctgcactcattttgctaatcacaatcccaaccctcttaacatactataaaaaaaatcatagaacaagtttaataatataataactactagcttaaaaaattaaggcattatatatgaccaacctaatagtttactcatggaatactaagtaatatatagatatagacatattgtatcattaatatctaacacacttatctctctcacacagtatattgaagtttgtgctgtacggttgactataaatttagagctcgtttttcttctctctcctccacataaatacaagtatgatgtgataacttgtacgcctcatttatacttatagtatcagcttattgtacccgctctttttttaaaggttaagcaactgatttctcctttgaaacaacagaattttagaatgtttcttataggactaaatggctaaaactctcgcaaaaatcgtttaaattctgtgcattggtatgatcatgccatgaggctattgagggtgcatgcaaacagggtgactcattagcacacgatcaactaagtattagctataaaaaccttgaaaaatggccggtttaatatgtttttctaaaaataatttctatataaccttttttaatatacaatgcttagatgttcggaaaacgtacgtgcgaaagacgagggagtagaaattaaggagcgtgtactacaaaacacacca

SEQ ID NO: 7714 - DNA, 1445 bp, Oryza sativa
ccaaatgatgccacgtgggataactaccattcgcagtgtgtcccactgtaatgctgtgatgaaataagttaatttgtacgagatttgatattttctagcactacgtacgaatctgtacagacgtcgtagtgctagaaaatgtcacatcttatattagattaacttattttaggatggcgtaggagtccatgtcataaaattgtaaaacccgatttgacaaaagtttgcttactgttcatatttattttaagaaaaagaggcaggacagaacgagtagatttttttctatcaaattaatcatgcgaattatctgcggtccaatctgcctgtcgactgaaattataagtaaattttctgtcaaatctgatagggaagtttatcttctattgttttgtccacgcaacatattatagctattttaaacttgtgcatgtgtgtcatttagatccccaaactctcaaaatgcattttcggatctctaaacttgtcttggatgtcatataggtccaaacgagctacaacccactctatgcgttgatgtggcatgccacgatagtgcctacgtattagttggacccacgtgccaatcacatagaaaaataaaattaaaaaaacatattttctcctctctactttagatttttttctatctaccttatatgagaaaattatggtttttaattatatggattccacttacacgtaggcaccaccgtgacaataccacgtcaggacatggagtgggttagaactcgtttggacctatataacacccatgataagttcaaatatctaaaaatgcattttaggagtttagggacttagatgacacacccgcataagtttagggaccgcccatatacttcactcctaaataaaatctcaatcgtctcactctcacatgcatcacgctctgattgtgttgtgaaatctaactattcaagtataaagataaaaatcagttttcctcaaaaagaaaatgaaaatccagagcgataagcttttactagatttttaaattacagtatcagaacatacacatgtagaaaatgaaaagaggtgcaaaacaaaggagtcaaatacacggcaagaacaaataaaagggtgtatggaacaaagtagccatgaaacttataaaacaaattacagtgtgcaatatatatctagatatatatagacgcaaagagaatcattgcagcggaattattcatgtaaaattcttcatgcccttaccctagctatttaatttgggaaaaagtacgaattacctcccgaactatcacgatcgactgaattacccccctgaaccacaaaaccggacattcttcactcataactatgtaaaccggacgaattacccccctcgacctaatccacggtgattttggtctacgtggtgtacgtgtaacagtacagtcagctttctatttataaaaaagtagtgg

SEQ ID NO: 7715 - DNA, 691 bp, Oryza sativa
caatttcaatttaaatgctgcaaatattgtgaaacctgaagattccgaagcagattggatttatctagcgcatgctcgctcgattacttcatagctcaaaattttatagatggcgatgggaccgatcatcaatccccatggtgaattcacgtattaggggatgaagatggttaatatctaccatctaagaaaaatctaatggtccaaaacacatcactatcggggatggccggcagggaggccgctccactcccaccctaagtccctatccctcgcggtgacccgcatgcattgtagctagggaccaattatagactttattagtcgttttggctataaaattgaagcccaataaccagatatgtatagcttctaaccctagtcaacgtcaaccctccccttccccacatttctccaatctccacctccaccgcgccgccgccgccgctccagagtccaacgcgcgcgccgccggccgccgcctccccttgcgccgtcgcgcgggctcggtcccgtccccaaccgtcgacgagcgcgcgccgccggccgccgcctcccctcgcgcagtcgcgcgggcgcgctcccgtccccacgaaaccttatctctctctctctctctctctcccacgaacgcgacgacttcgatctcaaccccaccccatggctagcgacgagctccccgtggcggcag

SEQ ID NO: 7716 - DNA, 1501 bp, Oryza sativa
atgcgagggagggaaagaggcaagagaggaaaggctgtaccgttggatccacgatgcatagttcatagcgatcttcgaatttttttttctcttaaactgcttatcggatataagatccgatcacaccgttatattcattataattaaatctttagagcaacatgtcacattattttgataaaataaagatatattccctccgtcccacaaaaaactaacctaatactggatatgacacatcctagtccaatgaatctggacatatccctgtccagttcattgtactataatgtgtcacatccagtcctatatttacttttattgggatggagggagtatgttttaaccattaaaatttaatgtcttaaatgcgatagcaacatgttcatcatgtgtttcataaatttttaaatgtttcaacggctaactttttttttcatcatatacaacttagtttattattagtggtcgactgcaacatgtgacaacctgatcttttttaaaaaaatggacacctgatttatactagcttaaaaaaatttatcttttgtcaaatcaacatattgcttgttgttttttatgaaaaatgagatgatctatcatttacttctggattggtattttaccaaatttctctagagagcagcataaatttctttttttatatcctccatgtagtgtatcttatatctttgggaattggtttgtgggtattaataaattataaaaccaaatatcttatccttgttaaagcatattctatatgttaggctctacggcttagcagaaatgatatggttttggataaatcactattcaaatcttatgtacaggtacttttcaaaacaaggtattgactccgattttgggcacaactataaaggtgtgatgagaacaataaacttatgaacgctgcatgtcgaaccttaagtcaacggttatataatttttcgccaactttggatagagatttacaaataagcttcaataaatgtagagttttatctagtgttatttggatgtgcttttatggatttgttggtgtgtgctcagaattgagtggatctatgcaataatgggccatagctcgttgagtaaatgacataattttcttccgttattaaaaaaaaaatcaacgtatggcttaagaaaatacaactctttcttggtagaaatccggctacagatgatggggttatgtattagtactccatagaaagaatatccatgaaaaggacaaccgcgtacatcatcagcttatcccaagcggcaccatttggctccaagccctttaaaaagccagcagccatgccaatactatcggtaggcctggtccaggaggcaaagagcaaaccaaacacacgcgcgtgtgcatgctctatagtctatagctaagttagctacaccttcttctccatctccggcgagtacccgttgattggctggcagctgctggtggtggtcgcggccatatacatatagctaaagctgctagctacca

SEQ ID NO: 7717 - DNA, 1501 bp, Oryza sativa; identical to SEQ ID NO: 7336

SEQ ID NO: 7718 - DNA, 1501 bp, Oryza sativa
aacataacttcatcactgaaaagcataacaaatatattttctggaaaataaactaaaatattaagcatagaattgctttcaaccccccccccccctttcgatatcttcactgaatccatagtgtacttgtaagtcattattttattgctcataataattaaaatataaagtatagagtagctataattcacttcattactcttttattacaaggatacataattcattttttttccaaaactgatttgcacttcatcattcatcagtctgacagtaagttcggtagtcaacgtgggaaagcagcgatagacacatcacagctcactgcatcacaatcttaaaacttcctaatcagcaatcaccatgagctaaccaccacagcaatacaggtgtgtacagggcacaccgtacaccagacgggctcggatatccatctatcaccattcatcattaaattcaacagaaataaatcagttaacccagcggaatcatcgtcgatttcatcgctatcgtaatagcattgcccgcaatacccaatccagcgattcaccaactaaccctctaagtgaaaaactctgaaccgagaatagcattaccagtgtgcccaccatggtacattgcactgaaaacgcaccttcggggcgacgctggcggcggcggccctgacgacgaggccgcgtgacggccgcggcgcctggcggagcacccggacggccgccggcggcgggaggcggagcgcgtcgcgggaggccatccccttcgtagcgaaggccaccgcgccaactccagcggcggagaactgcacgggcgccatctccggtggattgctcgccgcgaaatccgagcggcagcaggagataaaccctagagcagcggaagcgcagcgcggagagagcagcagcagcagcagcagccgacgcgaagcggagggggaggagacgctttatcccaaacggcgaacgcgcacgaaggtgacaaaatatttttgtgggcttgtttgggcccaaaccaatgggggctactatataaaaattcttctcaaaatttatcaaatataaatataatatatataattataatgtgattacattattataatttacatgtaactacaatataatatatatgtaattttaataatttctttacaatatgctattttcgtgaaacaaagatcgtgagactgaatcttctcacctgtgtgcgtgctatgattcttttcttcccaacttacataaattttaaagttaacctaatggttttaaaatatatgaaggtaatacattgtagttacatgtaagttaggatggaattgcacatttgacaaatttttgtcgaagcaaaattgaatcgatacaatttaacgcccattttgattttgggccaacgctagtgtacttcccacggcccattttgaagccattaggcccagaagtgttcgtcacttcagcccgttcgaactgtctcgtggccaccggcgaggaatcagccatggccggcg

SEQ ID NO: 7719 - DNA, 1501 bp, Oryza sativa
ctcagggttgttgccacaccacacgttatcaaagaaaaactggtatcggaggggccatggatatccggtgcaccccaattctcttatttcttttaactccactttcatataatttaaaaaataaaccaatcaaaacttactattaaatctaaaacctcttgttcatgtcatcctcgttagtgacaacacaatcttacctaaaagaaagactttggcgtgacaacaatgaaaaatatttgactagcataggtggtgcggctaaaaaggttgttttcaaaatacatattgtagtgtttattttttatatttaaatgagacaggttaaaaaataaaataaactgcagccacgatcatgagcaatgctttaattttgctcgcgcaacttaagaacaaaggacagcggtcaagattcatggatgaatggcgatgaattgtttgacggaaatcattttgtgctggagtagtagtacgtgaagcatatctggtagtagtaatttggtagcatggatgttcattaatccagtgatattttcaacacggaggtgatttgcagttgtagagacatgttcttctttaacaatgcacttgtgcctttgtatcaagagagtaagagacacattttgtgcagttcattttgcattaatacacattttctcttcaggatttgctatttcacttgcgatatatttaggttcgtatctttcactttttcattcacaaaatcttgcatcaagaattatattcttatatatcaacttatagtacaatcagttacgcagcacttacacgcaattacggtgtatcaaaattagattttacaatgggtttttctgtagatttacgatttttgacatgtttattttttattgtatttaaaatgggttatatccattggtcagaaaaatttataggtaatcccttctccttaatttgcccggtacatgttccatccactattcagaaaataatctcattatactaaaacagagtgcctcaacagttgatgataacaacatactttctccgtttcatattataagactttttaacattgctcacattcatatatatgctaatgaatctagatatatatgtatgtctagattcattaacatctatatgaatgtgagcaatattagaaagccttctaatctgaaacggaggtagtaactaataattatgctatcataacataatttttgtctttaaaaaagagtatatcgaataaagacaaaaggcccaccggccgatatatctagtagaatccaagttaggatcgaaatcaacctcaacctagtcgtagtagcatcgcctcgctaagctttggttgctggctgacaccttgcacgtcgccgtccgacgcgccatggcgagtcaacgcgtcgcacccgacgacgcatggcgacggtataagtagccgaggcgaccccgccaggatgatccagcagcaagcaaacccaaagccaccatcaacacagcacgtacacgtacgtgcaacgtc

SEQ ID NO: 7720 - DNA, 1501 bp, Oryza sativa
tgaattgatgcaattaggtgctctaagtgatcagatcagatcagatcttcagaacatatatatgatccaaagcacaggcatctgatctttgcaatactggaacacagctgcaactgatggatgagctatatcccacctttattcgcctaacgagagacacgtctcaccaaacgctagctaactccgatccggcgagagatcagagcaacgagtagtgactgctacgccaaaaccgatcgatcggcgtccaggaagaattggtgacgctgctcatcaccagctaccgcacctaaccatcgcctcatgatatgtactactggagaagagtatgggtatagatagtgtgtgttagtcctagctaacagccagcggccaatctagctgattattactccctctttgtaaatataagtatacgaagcgtgtgaaatttattcataaatataaatgatttttttgtaaaaccaattcatctggattcaaatcctagacttgacacagttgctcacattgatcgctaataatctttaagtgaaaagtgtacttcgtcaatcttaaaatatatcggtctataatataaatatttcataaacgacttgttttattaatcatttctctctctttttttatcttaccaccctcctactattgaccatattttctttaacgaggaataccaaagtattttattctaaatcttaatatttgctaaacaactcgcacatacttgtattcgtggacggaagtagtagctagcataaggggagaaaaagaagaatatatatgtcttttgcatcagctttgtggaaaagtggagtataacaagaacaggatgactgggttgcccattgacaaggcaaagagaaagaaaaggcccgactaaagttcctgcctttcgattttctcttccacactacaatatttttatggagaaaaaggaggccggctgaacatcttggttaatttatatttggaaaaaaaacataacctaaaatggctcactattatcgcatgatttcataaggaaattgcagaaaaactccctctgtaaaattctaaattatgtggattctggactcctgtgggtaagtagttaaacatcctccgaggagataaaatacgcaccgtccgatctaaatcctacggcacgaagcagcccacgtgacgtgatggcagtgtggtaattctcatcatcttcttcccctcaaccgcaccgcaaaaagcccacatctttctcgcttccacttcactcgaaaggctccctccacttataaaccccaccaccaactcctccaatggcggaaatccccgaccctgcgccccttgcctccgccccaatccgcggaatccgagctcgccgcgtcctgccctaccgatcgatctgagcctcgccgcgcgccgtgccctagatcgggagatctcgcctccggcatcggggacagcgcaatggtggagacgtccggcggcggcgggaggctccacccccacggccagcggcgga

SEQ ID NO: 7721 - DNA, 1501 bp, Oryza sativa
gtaccagcagaggagataccctgctgtgacaaatgcatagttagatcatcacaaaccgcacgttcaagacagtacacaattgagcaaacatttccactggacttcagtaaatttgatatgtcagaataaacgtcatcaaggagatccttgtagcgaactgcaaaaagtagtttatattataatatgtaattaagagagaattgaacatagagacaaaatataggcatagcagtaaacaattgacaggaaccatatgttctgggagatacataactgaaaagtactaaataatcatgagggaagggaacatcagtaatactgtcccgcgtccacaatagatgatggaaagcatggaaatgtaaaaacagaagaatagtcaacataccaagaaaacaaatgccccagtctaaagataaaaggtcggtgcactcaagctaagtgttcaagaacccataagttggaaaacttaccttcatagaatatattaggccgattaaatgatgccctaagaattaatggatttctcaagcacagtgacgatatcacatctttctggactctggtgtaaagaaaaagagaatgaagtgtgaatagaaaacactagattaaaatatcaagagaagtgatggtggcaggtagtgactattaaggggatagtgtcttactttggaactgcggttgcagttaaagctaatataggtatgtctgggaactggttcctcagtgatgaaagcttgcggtaactaggtctgtatttcattaaaatgagtagaacaatttacaaattctgtaacaaggaggaatgcttcaacccattttttaaccaatgaatctgcaaacgggcaacagacgaaagcaagtagccaccaccaaacactaaaaataaatgcatacctgaaatcatggccccaagttgaaatgcaatgagcctgtagagacaaaaaatgcaaaataagccacagatgctcttcatcacagataaaagaagaacagggtgttactagaggagtaaagacactacttaatttatacctcatcaatagcaacaagaccaaggagacctctattgtagagctttgttagctttgccttgaacccagatgttgcaaccaactcaggagtaacatatagcaattttagagaaggattaccagaatcaaggtcttcatgtatctgggagaaaggcatgtatgacaaattacaaagtcaagaggaagagtgttatcataccgaactaaccatgtgaccaggtaaactcagccagctatgaatttatagagtcaaaatttcagttgaaactaaagagtcgaaaattttcataaataattgataatatcctaggtaaaccttaatctgcacaatgtggaaaccttaccttttgtttattgtgcgatgtttgtgttgacgagagaaactcagctggaatacctttgcttttcaagctggcaacctgattctcctgtaattttcataaaccatgatgatccatagtattcaggaa

SEQ ID NO: 7722 - DNA, 1501 bp, Oryza sativa
tcataccattgcaaaattaccgatttgagaaaatgtcactattattcgtgatatctgctgggtaccattaaaattgctatgaggggcccatagtccatcttgatactgtatcaaaatccgctcataaacggtatcatcggacttcacggaatccattgataaaccgataaaaaccaataaaatacaaataaattttgttgaaattcaggaatcggtcgtgtcttcgatggcccgattcaaaaaagttcggatttcacgaggtccgaatcggattccattggaattgtgaaccgggttcatctgtacgagtagcgtgtagccgctgtcggtttccccttcgcaattccgtacgcccctagtgccactgccagctcccccccattcttcctcgctagtcgctagcctccagattcccgcgtcccctcccctcccctccccatccatggcgcctcctctaaaccctaaccccgcgtagtccccgcccccctcccctacacctcctcggtcccccggctgtccccgtgcccgcgcccctcgctcccgcctcgccggcggaggcaggccatggagcaccaccaccacaagcccgggctgcgggtgcgcctccgcatcaccgccgcgcggcgacgcgcgtggctgtccgcgggcctgcagcccgcctgccgcaagccgccgcgccgcgacccgtccgactccgtccacaaggtcgcgcgccgcgagatcggcggggggcaccgccggccgccgcggcccgcggcgccctcctcctccgccttctcctgccccgagaaattccggaatttccagctgcaggtatgtgcagcttgcccgtctcctcgctcctaggtttccagtagtcgtgattaacctagtgccgcttggtaattcattctgatccgtgacacttgatatagttagggatcttttttttaaaactttaggtggcaatccattcgatgcgatcaaatttaaccagaaagtgttgcctgtggagacacaagtatattgctacaatagtggtaatctggttagtgaactggcaatgttataacattgcaccggtgtgttgccatggctagatctagtaattcagtgctaggaatatcaactgcaaatgcttatgatgtcctgcacgtagttttgcatgttctagtttgatatatggagtgtgcataaccaacagacttagttttttttttttaaaaaaaataaggttgttgattatttatagcatatttgcataactgaaaaaaaataaggctattgattattcatagcatatttgcataacttgtgaatcagtggttcaatgctattgaaaatttgaaatctgaatggggttgaaattagttgatgcatgagctgaataaactgtaattagcatgacaccatttgtatttcaggcatcatgagatgcatatactatacagattttaaaatacatgcttattattttatacttctcttcactctttctgttctctcaacagtaaaacattac

SEQ ID NO: 7723 - DNA, 334 bp, Oryza sativa
tgcgtgctgcaaaggaggggttcctaactcttcctcctgagcatagcctaaatatatatctactgcaaattgaagctagttttaaatttggatcaaggaagaagccaccagccacattgtacgtatatctatctatcatgccgaccttgccgccggcgactactgcatatggagaagactattatcttctctctctatttatatatctagagagagaaatagatagatagatagagagagagagagagagagatatggagacatggagatacagggagggagaggtaaggagttggagcacagtgatctgatgccaatggaagtggtccatcca

SEQ ID NO: 7724 - DNA, 756 bp, Oryza sativa
ttcctgcagcccaggagatgacataaggggtagcaattggtgtgacttttaaaaactatataattagaaacatgaggatgataaggtttcgtctttcaaagtcttaagacaatgagataactatttaataaattttaagtaaaaatcatactaaaaaatatatgattttgtttgggtgctagccgcgcaattgcgcaggccacctagctagttctttaggtttgatcaaatttatagaaaaatttagcaacatcaagtacaacactaaattagtttcattaaatttagcattaaatatattttaataatatttttattttatgttgaaaatattagtatatttttctacgaacatgcttaaacttaaaaaataactaacaaaaaatcaaacgacttataatataaaacggaggagtataacattgttgcccgcaaagtagaggggaatttaattgactagctcggtggagttcaccggagcaagaattttttttctttggaagcttaaaagtcttgtacgagaaaattaaagtactacctccgtcctagattataaggatttttagggttgaacacagttattaagaaagttgatagaattaaataagaaaggttatgattggatgataagtggaggtagttaggaaaattgaatggtaaagctagggttgtaattggttgggaatagaatcttgatgaaaaaattgctatattttgagataaatcctaaaggctaaaaattattatattttggaa

SEQ ID NO: 7725 - DNA, 1501 bp, Oryza sativa
cgacagggtggggagtaagatcggacggtggtccatccgcggcgaatcctggccgtccgatgcgccgcgcgcgttgggaaggtttgggaccggtgtggcgcgtgcagtgcatctgggccgtccgtttttttctctgacaagatacggtatacgtaaagttagggcgtaggagtacttccggtggcattcctacggagcgtatgtttgtcggtactcggtagtagagtagtactagtactagggtctttgcaggggttgcagtgcacttgggttctggagagctgtcccctatccgggcccactttcagtgagagagggctatgcgtcccggtctcgctgtgtcagaactcataagagtcagacgtctggtgacaactgaggaaacagtggccgcttgctaggcttccatttttcttggaactaagttaaaccctgtttcggaaatttagtacgataacaatgaaaaaataacatgtaaaatagctagataatatcagattaagtaaattaatatgatttatgataatttaaatttaaatagtatgtagaatggtgattcaaacgtaaaatgtaaggtggtatgaatttacggaagaagaaaagtagggagatagtttggaccgtagattaatcatctaaaggctaaaaacaattgatgtgatatgacttaattagaggaaaaaatgagaaatataatttggaccatagattaatcatttaagcactaactaagtgaggataagctatataagtagataggatatcataaaatataataaagatatacattaaaacattatgtgaattatgttggataataatttaacatgattgtatttgaaaagctcttaaattataaaaactataaagatatagcatgtttgcatgatgtttaaatgtgattattgttagtggatgatgatgtggcatcttgttaattagtggatgatgatgtggcatcttattaattagtggatgatgatgtggcatcttgttagtggatgattgtcggtgacatgggaccgagggtatcttgactagaggtttggggcagctgcagtcacccacgtggcctgaccccctcgggggggtcgggcccgagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccacgccgcatttaatgcagtgcagcacactcgttcggtccgtgacaggtcacagtgtgtgaccggtcacagaccggtcagatcgcgggttaggtggcaacaggcggcctgacacacgcctcgccccgtcccgtctgaatgatgagggcctccaggcactcgtccctagccggagccggcgtgggaactcctggagttggcacgtcagccccggccagatacattccagg

SEQ ID NO: 7726 - DNA, 1501 bp, Oryza sativa
agtactagtactactctactaccgagtaccgacaaacatacgctccgtaggaatgccaccggaagtactcctacgccctaactttacgtataccgtatcttgtcagagaaaaaaacggacggcccagatgcactgcacgcgccacaccggtcccaaaccttcccaacgcgcgcggcgcatcggacggccaggattcgccgcggatggaccaccgtccgatcttactccccaccctgtcgctgtgtgcctctctctctctctctcccgtgtctctcgccgcggcgtcctccggccaccaccccgcgccgcgccgccgtctacggatccccgctcctcgctcgagcgagcacgaaagccctagcgcgccgccccctgcaccgggtgggttccccaggtgagcactccattcgcgccgcggcgccctctctctctctcgttttgttcccacggatttctgcgggggatctcgttcttgggtggaaatgggaggagggggttggggttctagttcgtttcgaggtggttgttgacttgttgtggcggattgggtgggttttgggagggttttgtgtaggattggggggggggtgaggtgaggttaggttggtggcgattcttgatttgttcttgcgcggcggcgatcgggctgggttgcgtctgtcctctcctaggttttttttttctctttttcgctcgtgtagttggattctttggtgggttcttagcggaagtttactgttttttgacggagcggtccgcaggaatgggggccaatgttttgattttggggtatctctgcacgccctaaaaacaaaagagatttgaagggagagacttccctccaaacatttttttaagaagaaattgtgagcgttgttggggattgaacacatctttgtagcgagatgtcggcttttatgttgaaagtctgaatggtacatttttttgtatgagcatacatggtttattgtggggaagtataagtgtgtttctagtatatgtttcttttttatttcaccattctgatttaggtggtatggtggatggatttttttgctacccttatagggtcttaaatgactattccgtagaagaaagttaagttttttttttccatatacttttgtttgtctctttatttaggttttttttttggggggtgggggggggctctactagggagtttagttcatataactgttggtgcactagttcctcatttatgaaggaactgctgaatttcatcctttcaggtgtgggcacctatatgtgcgttatattttactttatcgcaatttatttatcaaccagcattgactttgattcagagatcatgtcggctttgcaggtttacttgtttttatttttaaaaataatccaagggttttcagaatataaataattgaatacggtcaaatgtgcagctaactaattatcatgaaatgccatcaatatgtttaaagacttacatagttacgtttagcaggttgttgagctagaa

SEQ ID NO: 7727 - DNA, 1501 bp, Oryza sativa
gacaaaagatttatttgtgaaggcctcaccagtgttagtggggccacaggcggagagggggctcgcctcacatgtgttgtggggaggagaggggctagagaaaggtaagattcatgtgatatataaatcttgatacaatctgagccataagcgactgaatatttggaggtaaattgggaaactatttcgataaaaaaaaaatcttcgtgtgtctgtgtgttttcctacttggcgaaacttattcaaggtgacccaaatttaacaaagaaaatggggaaatattttgaccgaaaagctatgttttgtgtttttctacttagcacaacttattcaagcttgccaaagcttgttaagaaaaaaaatatcaaaaactccgggccaaagttttccgaaatttccaatgcacctaaaatctttatttctgttctcttctattggaggtccacctgttcctggcccgtacaagggcgtggggcgacatggcagtatggttcgaaattccagagcgagatttccgaaattttggttctatcggacctccaatacgatatcatttcggctgaaatgtctaattctttatttgttaatttggtaatcttttattcaaatttgatagattttgtttaacattcaaataatttcggaccgaaatttttaaaatttcagtatatcggcacacccgatacaaatgccaaaatcgaaatatttagccctgcacggcagtatcctcgcgcggctgccaattgcccaaagcggcggcggtgtgcgggcggagaggtaggcgatcgacgacgacgacgtcctggcatgtgcattgggttgggagagccaacgaaaggcgctagctgcctcgtacattcccgacaccgcgtagcacgaggccggcctcaaaatggcgcgccggtgcatcatgcgcatcggatcgacgccggcatgcagctgtggcctcgccgagatgggtgagtaggcaggtatgtagtacgtggcgtctgaatggcggctccgatctgaatatatgatctgaatctgatcccgagttggatccccatgtcgcctcctggcaggacacacctcccggcattcgggacttgacctcagtgccatcagtgagacagaggcagcaggcgttcatcatcccaactcctctgatctcctcctcccaaactcgatcgatccaacaagtcatgagctgatctctctagctaactagatcagctctttgatcgattattgattgatccatcatttgggagcctaatttagtacttcctcatcgccctctcaccagctataaaagggaaccgtggcaaatgcactttgcgtatcagagcaatcttagccagctagcctacttcgacctactgctcttgttcctcacacacattagcactaaattttgcagctgcacaatggcaaccgctgaggtttgaatatctcttccctaaattttcctttttactgtcagcaatcagcatacatgatattacatgcgtgccaatca

SEQ ID NO: 7728 - DNA, 1501 bp, Oryza sativa
taacctgaaatggagggagtaaatcttaagtttttgtctatggctgggctcaccggaggaattcattgacatgcacaggagcggcggccgtcggtggtgaggatcagcgacgtgaagttcaggaacatcaggggggtgtcggcgacgcaggtggcggtgaagctgtcgtgcagcgcggcgagcccgtgccgaggggtggagctcagggacatcgacctcagatacgtcaggcgaggggtggccaccgtgtcgcggtgcgccaacgtcgccggaggcgtcgccggcgggacgcttgtgccgcccccttgcatatgaaaatctgttttctgtttttttttcttttttcactttcttgttttctttctatatagcgtacagtcacagagagttggcgtggacgaaattttggttcttgtaaacgaccgatgacgagattgatccttaattatggggacatcttgttctcccctgtaatggaacatatgaagtactccatccatcttaaaaaacgaaccaaaaacataacatattgggttggttttttaatgacgaagggattttgctattcccctcaccttctgttttttcttgacaaatctgcattgatgttctcaacagtgtcatggaaatatatcatatgtgcacataagctttgggtgtactcactgttcacaccaataaataaatatcacaagaattctataaattcctacataatttttttaacatagtgtacatataattttataaaattatgtacttttaacataacatgcacgtacatataaagttttcacttcagatacattatacatattgtacaaagtaggggaaaaatgattagtacccccatctgtcaaaaaagatctattcctagatccccgaggcaagtttagtattaacgtgaaattaccaaagtaccatccttaactgcattcatccatcaacactgccattctctgcacacacattaaaattgagttgcatttgcccaagaaaagattacatttgccgttagaaagggaacaacctacaagaactacaccaagaacaaagaacagagaagaaccaagaatagaggggaaaaaatggaatcaagttcttgaatcagatctgccacatataggcttgcaaactttcaccttcacctcctgcatcacaacaatatgcccctaccatcgccgccgcatccatccgccaccgcatccatctcccattgttgccgctgcatcgatctgccaccgtcgtcaccgcggcatcgatctgccaccgtcgtcaccacggcattgatctgccaccgccttcaccgccaccatcatcgccgcatccatctcctgtcgtcgccgccatccctgcagagaggagtggaaagaggggcaaatttgaagggagagattgagttgaacaactgaggaggcagagggagagagaagccaaatgagagggaggggaaaagattgccgtgtgaaccggagaaaagaaaagttgaggccctctgact

SEQ ID NO: 7729 - DNA, 1501 bp, Oryza sativa
acactctgattaatatttcgcaattgggaggaaaaaatcctaatgccccccccccctcctaaaaatcactcatctttctaatctctcccctacaaattaatttcgtgcaaaacacttctcgcaaattcattttctcttccaacttcctatttctatcagtttccggtattttctcgtgccttatgggcctgcactatattgctacccttgtcatcaaaggcagttctccttttgcttttgcttttgtatgctttaatttatcaaaggtgtggcgataaaacacgaagatgaccccatattattaaataagttgtattaaatcttatgcccaataacagagaatataagtgttaacttcgctcaccatgctggaggtccatacgatgtgagaaatcaccgatgaatgtagtgagaattacttaaaaaactagacacaggggggaagttgaaaagaaaatggacttgtggatagtgttttgtaagaaattaccttctctttctcaaaatgtggttatctaggataggatagacccgaaaggggtagtaagttgtagaggaagattcaaaataccaatggcttgtaaggggttatctggattttcaccttcgcaatttgcagatgttctccatctcatcatctcatatggtgtgaacgcaacggtttgtttgtccctattttatttaatttggcatggttgacaggatcagacttattcagagaaacatcaacatgcatttcagcaatgcgttaatatactattggcgatcgataaccagagaaaaggtgacctgcatcatgtatttcgccggttgcaatttcgtcatcactgcggttaggattacgttctcgtcgcaaccgtaaattatagggcgagaagatcattgacatgcaaattccacggcaagttgcatttgttttaagattttgttacagattcttcttgcgggtggctgcaaaccccgagctgattatctctgaacgtacgatcaagccgtcaaggtcaagtcaatgtacatattactaaagcttgtttctgctttgcagtgctagctataaagtcatctgtagcagatacaagcatagaacacacttcattaatttgtaaaatggctgaaggccccgtcgtccaatgctaaaacagaaggatttgatggtgatcagctacagctgctcggctggtaccaagctgacatggatattgtcgttgctgctcatcctggtcgcggcgacacaagtccatggcgtgtctcctcctggtaattatcagagctgtttcctctgcgagcctgcttctttgtaatccatgctccatctgcacagttcagatcacttcattatatgcagctctagaaaagtagaaatcagtgcataatacttgagagctaattaaacactctcatatacttcctcccaagaataaatatgtaagcactccccgtatacttagcgaccaaatatctagctgcatgattgtatgatgaactcgcatgaaccttaact

SEQ ID NO: 7730 - DNA, 1501 bp, Oryza sativa
cacaaaacatatattccctccgtcctaaaatataacaacatgtagcctctataatttgtcttaaaatatagtaacttctacgccaatattctcttatcaaccaatcgtaactctttaccatttaaattcttcacctaccctcacttctcatccaatcacaaccctcctcacatatagttttacataatttcttaataaccgtgtccaactctaaaaatacttatattctgaagcacagtgacaagtcaaatatttttaactttcattattagtaataaaaagataaaaaagatgaatcatataaaattaatgttactagatttattattaaataaactattataatataattttttatttaaaacatctcttggatagttcgatctcgccagtctctagtctctaccagcgttcgagccctcatgtcagaactcagaaccccgggatctgacacctcagccgtcgccgtcgccgccgccgccggcggcacatgcgtcggcaccgccgctgaagcttctctctcctccctctccgggattggtgcggaatggatcggggatatacgggtttcttctcttcgtaaggtatgccctagctctttcctagtatcgatttcactcctgaactagttcgttctgcgttaaactacgggaatctattccaaatcgaaatgttccgattagtgtacatgcgcccatggtttaggcgtggacctctgtatagaatgcccatattaactcttgcgtaggatgcatttgatgcatatgaagcccttaatgcatttccggatgacatatgggataataaacaacgatatttccattatcttgaaaagatatgggataattaacaagtaacaacgacattttcttttacggacaagtcataggagcgagcaaatgatcaaaccatctccaaaacagatgcagtaaaatagcatttcctttcaccgtccagaaatgtagcttatttctgacatcccaccggtaggaccagactgtgaggaactgccctcgttgtcgtagcttgttgttgtagctccagaaatcatcaagtggaactgccgtggaatgtctgcatccatgacgttcttctcttgaggggttgatgtaaccgatcgtttctcacttgaaatagccaccgtaaacaacaccttaagcacagaaacaacctcagtcatgcttggcctgtcaattgatgtgttttcaaggcagttcattgcaaggtctatcacagtttgcaggtgagtggcatcgtattgatctaacagtttcttgtccacaacatcgtggatgcttcccttatcaatcttttgccgcacccaatttggcaagtggacggtttggggatccataaatactgggggttgaccagtgacaatctccaagaggacaattccaaaactgtaaacgtctgtcttaacggtaagttggaaagtagcatgatactcagggtcaaggtaaccaagggtgccggcaacaacagtagatatatgcgtgtg

SEQ ID NO: 7731 - DNA, 1501 bp, Oryza sativa
gtacacaacactctacgtgagtacgtgacgagtgcagcagtgcaaaagtagggagaaataatcatgcgcgagctggattgaacaaactgaaatactaacactttagttacgtttcaaggtgattagtcaatagaaaaggggaaaaaatagtgtgctccatatagggccttcgaaagggtgagatctattcatgcatatatgtctcacaggttggggtttttttcttcttttttactcttatatatgtccatgatctctcaaatataagggtggtaatagacttaactttttagcctaaaaaaatttgagagcttaatttctatacacttttagcttaggaatatatttaaaggagtagataggattgtgaaaaaacccatagtccttgatccattacaaccgctaattaaatactaccaagattttacaccacagaatatgtggatctattgagacgcgtcgtcgctccgccttgaggatgggccgacgccgctttgccacaaagccgagccgtcgcccggggggggggggcgcctcgaggtgacgaacttgccactggtgatggagccgttatcaacctccgcgttagtgccgccgatgtcatcgctgttgtccgagagctggccagacaacaatgagagagctcactccgttgaaaatttgctgacaagtggggcctaccatatgcacgtcagcaaaatcagaggaatttttggtccatactaccataggacctactttgcacggcttttaatagttgaggggtagagatttatgtattgtggtttagagaccttagacaaacttgatgtaaagttaagggatgtcatgtgaactaatattattttcaagtaaaattcacattgacatccggcccagcccaacacacatatggggcctggtcatgagctgattggctgacagatcatacgtactcccatcaaactcacaaataaagctccactcgtgcgtgcttgggttattcgagtcccacatatgccttgtagtattacgtaataataataatgtaattacagcagtcgtgataaatacggacactattcgttcgtgtttaaaaggttattttgaatgcccccggccccgccgcactatcatacgatctcgtgcgtgagatcgcttaaattgtaggcctccgactcatcagatcgcttaaatcgcggtaaattcgctgtccgaattgaatctccgtcgacggcaatggctgaatcctccgaatctgcgtggccgcagcagagtcagcagctgcagattagcagcacaatgccggccggttctgcatggccggaggaggagaatctcgagaatctcgagcagccgcttcccctgctgatgccatcgtcggaggatcatcgcgagcagcagcttgttcccgttccatggctgcagcaggatcaggatcaggagtggcatgagcaggagcagtttcttcccctcaaaaatcagaatcaggagcagcttcaggatcagcaacctctgcagg

SEQ ID NO: 7732 - DNA, 1501 bp, Oryza sativa
atagtgatatgttaatatagtgtgatatacatatatatgttaacaaagaaaaaaatgtacaaattgaacacagcaaacctactaagttctttaggatggtcggagtagacgtcgcagacatgcatgtagctgtagctgggcagctgctcgccgcgtagtttcggccggaggaagtcaaggataagttctatatccgacggcacgaaccggattccgggcacgcccaaatatctacgcgtctcctcctgatcctgcagaggttgctgatcctgaagctgctcctgattctgatttttgaggggaagaaactgctcctgctcatgccactcctgatcctgatcctgctgcagccatggaacgggaacaagctgctgctcgcgatgatcctccgacgatggcatcagcaggggaagcggctgctcgagattctcgagattctcctcctccggccatgcagaaccggccggcattgtgctgctaatctgcagctgctgactctgctgcggccacgcagattcggaggattcagccattgccgtcgacggagattcaattcggacagcgaatttaccgcgatttaagcgatctgatgagtcggaggcctacaatttaagcgatctcacgcacgagatcgtatgatagtgcggcggggccgggggcattcaaaataaccttttaaacacgaacgaatagtgtccgtatttatcacgactgctgtaattacattattattattacgtaatactacaaggcatatgtgggactcgaataacccaagcacgcacgagtggagctttatttgtgagtttgatgggagtacgtatgatctgtcagccaatcagctcatgaccaggccccatatgtgtgttgggctgggccggatgtcaatgtgaattttacttgaaaataatattagttcacatgacatcccttaactttacatcaagtttgtctaaggtctctaaaccacaatacataaatctctacccctcaactattaaaagccgtgcaaagtaggtcctatggtagtatggaccaaaaattcctctgattttgctgacgtgcatatggtaggccccacttgtcagcaaattttcaacggagtgagctctctcattgttgtctggccagctctcggacaacagcgatgacatcggcggcactaacgcggaggttgataacggctccatcaccagtggcaagttcgtcacctcgaggcgccccccccccccgggcgacggctcggctttgtggcaaagcggcgtcggcccatcctcaaggcggagcgacgacgcgtctcaatagatccacatattctgtggtgtaaaatcttggtagtatttaattagcggttgtaatggatcaaggactatgggttttttcacaatcctatctactcctttaaatatattcctaagctaaaagtgtatagaaattaagctctcaaatttttttaggctaaaaagttaagtctattaccacccttatatttgagagatca

SEQ ID NO: 7733 - DNA, 1501 bp, Oryza sativa
ttgtgtttatgcattattttgtgaccgactaagggcgttttcaatattctcattttctaacttatactttctaatttttcaacttatactttctctttttttcacgtgtatattttctaaaccactaaacagattttctttaaagtttatgcagaaaagtttcttaaaaaattatattaatctaatttttggctaataactaaataatcttcgctaattaatcactttgttttacgagtgataaaatggttttcaaccctcgacaccaaacacagcctaacatgtgctactagtacgtgaaaaaaatatgaattttcagaattcccagaacacacgtttgttgtctcgagaaatgaataattaataaatacatgggacaaaaatataatcatgctagcaactaaataaaaaagaggaaataaaaacaaattcaaccccagagagagagagggagaggaaaaatggggtgcccatgcggccctgcccaatagcgttgctgtacctttcagctttataatctcgcccctcgcgagagagactccccccatcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccaggttagctcctgttcttgcggaattctggctctttttttttttggggtggagaggggatgatctgggtggggtggggagtggtggaattctggtttttttttttttgttctttctttggctggttttgttccgtggggattgaattctcggttctcgtcacctcaggagtggtgttcgcgctgcttgttttggttgatctgtgaattatgggggaagacaccaccttttctctcgtttcttgcacttaaaaatcgtctttggtgagctgttgtgcttggggagctcttgagctgagcaggttcggtttaatctttgattgggttctatacttcactgtttcggtgttcccctctgccgaatttgggaatcaagaggttctgatccatcagtatcactcggcttctcgtcattgcatatgtacaaaacctgcttttttcaatcactcatgtagtcatgtctaattggtttgtcttttatcatcttttggtgtaacttgtctgtgtcactaaccatgccataatttttttttcatgggtactatgtgatcgatttcttcttcttcttcttcttcttcttttttaaatttttacctgtcataattcaagtagtagcagtagtaatctaatctaaagcttccaaattttccggtgtagttgagacgcca

SEQ ID NO: 7734 - DNA, 1501 bp, Oryza sativa
aagtactattcatgttttatcatccataataacaataaaaatactaatcataaaaaaatttaaattagatgaacggttaaacgttgaaaatgaataatgcaaaactgcacttattttggaacagatggagtatgtattatgccaaacctttctatataaaagttattctacgatatcaaataaatcaaatttgttaagttatagtaataaataaaacttaattaattattttaatggttttctcgttttgccaccgtgtattctactcaactctctactgctgtgatctgaacacgcttcgcccgcgtttgcagatcgatttcgttttactcctttcccacagtgacaaccagacgacagggttttttttccataaaccccgtctcccgcacacggttccaacttccaacccccgtttccttccccgggaagcgacgcacccgcacgcccgaggcgggccccacctgtcagcgaccccgcgagatccgcgtgcagggccccacctccgcgtctcctatataatcccctccgcctccaaactctaccgcctctctctctctccggcgtctgtcctgaccacctcgcacgtccgccgtctcctccttcctctcttcgcaatcacaatcctgaagaaattccggaacacatcgagatcgatcgaggagagaacgacgagcggtctcgtccagcaagctgtgcaaggtttggctttaattttttttcgttttttttggtctctacccgcttctgatttttctgatctgatttggcgccgttttttgaactttgggaatgtggttatgtactgcatatgtatatattggtttctcttgatcaaagctcgtgtttttggaatgttgggtaaaggtttttgtccagagctagagcatagagagtgttttgcttgcacactgtatatatgcatggccttaaattgcagtcgatcgatggcttgcatcaacagtcattttgagcaaaaaaactgcaggaactgaaatggtcaatctggaagtacaactatacagaaatgcacataattcacagattcggccttcgcaaaattcaatactcttatattgctgcgttttattggtggaaagaacatagacagtttgctttttttttttaaaaaaaaggagagctttaaattaaatcaatagttctggtttagattttttaggtgaaaactcttcgttgatattcctaaatggtactggtacagtattacatcgacggcctaaatttgatttgcactgacacccatcgcatcgacaccgttcgatatgaatcgatcactttagtatttttttaacaaaatttaatttatgactaattgagcttatgcatgcatgcataaaacgcgcagattgattcggacgcccgcctcgaggagcagccgatggtgccgcacggccgcgtccacccggcggcggcggcgagcagctccgacttctccggcgagatgaaccagtccgccgcctcctccgacccctcctccagc

SEQ ID NO: 7735 - DNA, 1188 bp, Oryza sativa
tcccattgagacggtgaggcctttcttattaagatagttggactgactttttctgtgttatgtaggtcagtctgtatatcacctccatattcatcttctagggggacgtcagatgaactggcctcctggataagttgtatattcccaaagaggtgctctgttatgaaaatgtaaccggtaacattctctttatctccatctgatgtgatgagcagtttcctttatggtatgtgctctgtaactgctatatactggtcttaaggttttccgtttcctgtttgcgacaacatagccatgtcaacagattgatctctgaagcagtggctaatttctattgacagccgcaagagcatccttcttctccctgaatgaatgttatccctgaaagaatgcagaaatgttttcgcgtgtgttctgacaattcctgctagataactgactttcgcatgttatgccagagtgcttgacaactctacctaaacttgacaaaaaaaaaacgcgacagcctgaaacagtgaaactgtgaaacattctaattatgctgtgttcctttttgcaagttctcaacttcttttcgcacgcacggttcccaaattgctaaacagagtgtcttttttagaaattttctatatgaattttgctttaagaaaatcatactaatccatttttcatttttttagataatacataattaattatttgctaaactattacttcctccgtttcacaatgcaaatcattctagcatttactatattcatattgatgcaacagaggaattacgtcgttttcccaacccatacctccgaaacacagccataactagcaatctggctttgagccatagttggaatcagagacaatctcagaagaaatcaccgtacttcaattttgaaacggcaaaattccaattttgcattcaagcagttcgagaatcatatgcgtcgattttttccaatcagaaggagtaggtctcgtcgctctcgcgtcgcgtccaggtgcagccgtcgttctgttgcaagcgcatcgcatgttgtacagtacaaaatggccacccacccccaccaaacacctttcactaccactcctgcacagcacagcctgcactacaccaaccaaccaccaaaacccttcttcccccatcgaaagcccatctcactctcctccccgccgccgccgccaagcctg

SEQ ID NO: 7736 - DNA, 1501 bp, Oryza sativa
gcttggaagttaccggggccagcgtcaaggaaaatctcatgtgtagtagtgacgaatagatggggatattaatagaataacagaaagtaaatccttttatttttaacaaaaatgtgaagaaggggccactagtccactacagtggctccaccctcttatgcgaaagtcaccattccccatgttgcattaaccttttctctatatctaactagcgcataattaattttggaaagacaacgatatatctttctccctattactgctgattgtacagtgcaccaatactaatagctagctactgcttccgtcccatcgtagcactacgaatctgaacatgcatgcactatgtccagattcatagtccgaatgagtcataggttcatatccagattcataatcctagaataagtcataggttactatattttaggacggaggaagtacccgttatgaacaagctctgatgaatcattctctcaatgatgtatgtcacatcaatattaactctatcttatctaattatcacaagctgccgtctgtgccgccaactgattggtggatttagcggccatccatttgctgacactgtttggacatggtgcattacctgttcaccaaacggaaaagaggcatgtacactactagaaaatcgatttttcatggcgtttggaaaatatttttcatggtggctatgtggaaaaaccgccagtgcagaaaattgtggggtgggggggtcaagggcctccagcagaaacatatcttcgctagcgatctatttaagaaggccgccagcgaagataggatatcttctctgtcggccctcttaagctgacgccaacgaaggtatggtatcttcgctggcggccatctaaaccgtccgccacctctaatcattttcaatggcgattcaaacgaaccgacatatgacgaccgccagggaaaatgcgctgaactatatcacccagctacagtaacttcgagcaccattaggagcacgattttctctctcttaagaacacatacataggggggaaggttttgatcttgaatcttttgaaagatttattgtaccagaggttagttatactttctcctactctttttgtcaagtttttttttcatttttattggttgtatgttgagatttttcatcgcaaaaagtacttgacatggaggaagaaaaacattttttatttgttatttggagctcaaaatgggcaaactttgcaagaaatattgtgcatgatcgatgttccatatacatatctagtttttgataggtttatgtttagcagatttatatattagttaactgcaaaagaatgagctagctaggaagagaagaagagaaagaagggtagtttggtaattcttcaagttgtatgctttatatatgcagatttttggctagctttaattatcgtgttcaaaatatttaaactaactaaagttgtattattttttccgtaattaattaattaatgcatagatggcggacagg

SEQ ID NO: 7737 - DNA, 1501 bp, Oryza sativa
ccaatctatcaattcatccatttcagctaaatttcaaaccctaaacctaattaagttccttaattatcaaagaatgacagatttcgaagtgcatggaaaatttcggtgtctaggtcggttccgtccatggactaccctgaccaatccaacaaaattccccatgcacttcgtattctgtgatggtttgatatcacatataacatctcacatctcaataacccctaagtcccaaagtttacatatctcaaagtgcacatatgaaatatgaactacatctcacatatgaactacttatggacaaagttcatggcaatgtaaatcagatttcatttagaacatatcagatttcagaatttcagagtatatgaaaatttcacccccaattcctgcattcagaatttcacccaaaattgcattctctcatatttcaaacactcattctctcagatactacaacatttcattgcaaaaccatatatatagccatacatcactggatttcagaatttaaatcacacttgcaacaatctgaatttatatggaaaaaagagcacgatgatatatatgcagtttcagtgcatcagtcaaacaaaacagcaaataaaatctatccaaattcatccatccatcaaccaattcatattgcacaatctgaacttatatgaaaaaaaaatagcaacaatccacaagtttcaaactagctacaatctgaacttatatgacaaaaaatagcaaaatttcatatgcagtttcagttcataattccatccaaaagttcatccaaaattttgaattgggctagctatagatatgacatctcaataatccctaagtcccaactacatctcacatatatatcatttcatcaatatatatcaattacagattacgaaatggggtgaaaaaaatatatcatttcatcaattcatccatccatcaaccaatcacttctgattcaaaagggaacataacaacatataaagcagtatgcatgtcaaaatagcaagttttaaatcacatttgcaacattctgaacttatttgaaaaaaaaaggttacaattatatatatatgcggtttcatttaagaattccatccaaaatttcatccaaaagttcgtccaaaattccattaactactgctgtaactataaattataaagttcatccaaaatgccttctgccacatattgcaaaccccccaaatatttctgcattcccccaaattttaccaaccaatttgcattcatccaaaattgatctcaaccatttgcaacattcaagttttaaatcatctatacattcatgtttttaaatcacatttgcaaccattcaattgcagtgccatctgccacattgcaaatcccctgcaaaccccccaaccaatttgcattcacccaaaattcatctcaattcagtcattcatcattcatcaattttcatcaccattcatcaattctcagcattcatcagcatttccagcataggtaggatgcgcagagg

SEQ ID NO: 7738 - DNA, 1501 bp, Oryza sativa
tgttatttgtgtaataacggtggagtttaatttccttagatatatattcagagactggctaatgactgggtaattataactgcaaaacacttgggctgattattatctcccacttggccctagtcgatttcagtgtttgttagcttgcaggctaccatgactgaatgattgattattccgtaatctgtagctaatcagatcggatacgctaatacggcgcagtaggtatagggaggacaaagtccacaggcccagtagcactctttctgtcactcactcactcactcactcactcactagagttatagagcagacgactctctcactgtcagtcctcatgaaactgaaagctatgaaaatcccatcaaaagaacttgaccgtgaaaaataccccaattaaattacataaccatctaattttatgatgatagtttggttcgttaaaaacctaaaccaattaggccccgttctttcacgattaagatataagtagattttagcacggtttttaaactgttgaacgatatgttttatctgaaaactttctatatttatatatttccttcgtttcatactataaattgtttgatttttttcccagtcaaactctattaaatttgactaagttttttgcaacatataaaatattaaattggttttactaaatctaatattgaatataatttgataatatgtatgttttgtgttgaaaataatactatatattttttatatatttggtcaaacttaaaaatatttgattgaaaaataggtaaacaatttataatatgaaacggacggagcatcagcatattttaagtttgcaataatcaaggctcaattatgcactaatgttttttttcttgttttgtgtaagtaatctgagccgttcgatcacgcctcttctctccggatcacacgacacccaccgtttgcctactttttatctccgtcctcttggattggatgcgtccgacactcgagccacaccgaatcccaaccaccattgccgcgccgagctcttcttcttcaccatcagcgaagcagagcagagcagaagcagagcgcggagatatgctcggaggtcgacggcgaggtcagcagcaagaagcgaggtagcgggcggcggccgcagagagacatgtggacgccgtcgcgggggtcggcgagcgggcggcgggcgacgggtcaccgccgcatcgcggactacctcgccgacgaccggacggaggcgtcgacggagaacgggtcgttcaacacggcctacagcgacgagctgttcgcgccgacgtcgtcgtccgccggcggcgatggcgtcggtggaatgctgccggcgttcctcgccgaccagagcgacctcgtggaggtcatgctggagctcgacgaggagtccatggtggtgcggagcgtgacgcccaccacgggcgcgctgtacgggcccacgtcgttggccgggggcggcgccgcgcacacgccgccggggagcgggcggagcctgagc

SEQ ID NO: 7739 - DNA, 1501 bp, Oryza sativa
ttcatcatatagcgatgaacataggaatagggtattacactcccaagtggcccgaagatgtattcattgcttgtccacatttttacaggaccctcgaccctaacacgagctcgggtacgtgcaccttggatgaacttccaagggtatctagccttcccactagaggagcttgtgctttgatatgtaatagtccaccctccagaatcgcatagcctagcccatccgatgggtgggcccatttataaataccaccccacttacactttccttcttgcttcgtgtaaaaggtttaagtcaggagatatggttggagggataatccattataagttggttccatccttgctaaactagcaagatggtactaaatatgcgcacacaactctcatggaccacacatgccatgttctaattgggttgggatgtcacacaatagcagcaacaacggcggaggagcagcaatagatgcctaggttgcacatcttgtttttgttcggcttgatgagcaacgctcgacagtatgtcccctttgcttccatgtagttcttttgtatcagcgcccaccaagattaattgatgcgtgcatcattgacaagaagaaattttatcaactatattgatttgaattgatacgaccaagataacagttgaagcttcatgagtcgataaatgagaaatgtgagctctcttaccaatgacggatgcaggattttaagactagatattcactcaacattgtaagtatattgtcccttatgtttggtgattaggggatttgagatagttgactaccatgttagaagtggtgtgagttgaagtcttgaagaatagatttgttaagaaaaaatctagaatcaagtatcaggtcaaattaagtatatggatatatgatatacctatatatactaattttgtttcatagtattttgaatattctcgggaatacccaagaaccccttacatccgccagtagctcttacaagaagtatggttgtatcttgctgggtgaccttgtagaggttgatgaggatgtcctcgacgcactcttataattggggactcggagtaccacagatgtgcggcgactttgatggcctcatggcctccatgcggttctagctctccgctggtactatttcctatgtttcatatgataatactataaggcgttttgggttttgaatagattcatacattgatccacatatatgtttcatatatgtgcataaatttatatgatgttagtgaatctacaagagagatgaagaggccaaaacatcttgtaatgtgagggagtacttatcaagctggattcataagttgggtaggttatttgatagggaggcgtgcgagtgcatcgatggcgcagccgctgctgctggtggctgcttcgggttcacgactccacatgatgcttgagaagggagagatctcgcagtggagtacatgcgagggtgttaagttcggcacggtggcatcaaggagggagccgcctaaacga

SEQ ID NO: 7740 - DNA, 1501 bp, Oryza sativa
ttacacccattgacctggagtaactgatgcggacagctgggaaaaaaaataaagacgacaacaagctactcgcaatatacaatgtagtaatataaatataaatttcagtttgagatttatcacatgtttgttgaggaaaataaaaaaggcaaagtcgtcgcatgttttgacatatatgctgagttgacacatcttgttcgtcggcgctcgcaatatacaagagcacgtagcaggggagcatgcagcagcagtttatacaagcctcaaacatgaagtttgggtgtgttatataccacatgtttacaacttctagtcttctactcctttatctttatctctcatgtgtgcgtttttttattattaaacggtatatttttttaagaaatttttttataaaaaatcgctttaaaaccacactaatctattatttatagctaatattctctctatttttaatatatgacgccgttgactttttaagatgcgtttgattattcgtcttattaaaaaaattatgtaattgtgttgacagaaaacacgaggactggaagatctgcttaactctagtggaggtccaaagctcgccttcgaatgtatgagtgtgccagttgatttgattctgtaatcaacaataaatagagacaaagaattcgtggttaaatctataaatgatagccgatcggctaggtgccgatgacatatcatttatctttaagccgatgtcatatatgaatcgatcggcggttataaatagacagtaagggactaaatctattcgatcggctgtagatattaacgatatatagtttttatattaatatatacttaaatcaagtgattgggaaatatcggtcaccatgccgagaaaatataaataacttagatcgaaatatatattaataacaggattatatatgtttatagcatagccgatcagatagatctagcatgtatcggctaatactccgatactactctatataaagatatcaaaacaagtataatataccaaacaaaagcttaatatatttaaatgcaataagatattgatataaagggcggatttaacatgtcactgaagcatatagatcgaatatggttaaatcagataagatcggctgaaacttcgatactaccctaatcggcaaccagaggacaggctagagattgatattctaagcacgacttaatagatcaaacttaactgatgcagcaataagtatgaaaagaaaaataatatctagacaatcaagccgctggatgttttataaagtgatagatatcttatataatctaggacaatgtcgctatttaacctaatcggctgtcttctattaacagatgttagccgattgtaggttagataacaatattgccaaggattatataagatatatgataactcgacgaattatatagacaagattagagtgtcataaagatggaagcactgatctcgagaacacaagtcgtcataacaagttttacctcttattgaaga

SEQ ID NO: 7741 - DNA, 1501 bp, Oryza sativa
tatgaattgaattttatttgttgaaaataatatcattggatttgacatttgaatttactttcatataattataattttgtttctataaaattatatgagaaattataagtcaaatattatttttgaacatcatgccagtcttagccatctaatttatgtgtcttttatattgctacaatagcaagtcaaattggttaccaacatgtttattttatgaaaccaggttatgtctcatgtgtcaaaatggttatgttttttgcaagtcgaacaatattactatgttagtagatctgggttctatgaaatgtactcttttaattaagaagtatctaatataggttacatgcttaacccctcctttgcttataagggaatcctcaatgtagccaagattggtctaaatggtgagtcgaaagtttcaaaattgagttaaaagttctcatttgtttagaaattttactcaaaattttcagttttgaaatgacactttacgttaagaaattctctcacgaaattttactttttttttgcggggatacaaaagtttacttgaatttaagaattcaaaaaaaaactcggaattatctattgcgcgtcaggcgcagccgtgtcgcgtcggcggcgcacggcagacggccgggcagaagcggcgctaattagatctcgcgcttatagaaactacaagtctacaatcgaaccttggtatactctcctaccaatcaaaattaacctgatatcctgttttgccaaatctttactgctactcaagcttagattcactgcggttttgcttcaggcaagttgatgcacacagcattttctcagcctttcagatacgtacgcttcacccacaagctagcataccaaccgttcatgatttgacggcgccgccgtagcgacgcatgcatgcaggtccgttttgccctataaataggcagcctctgcactgatccagtgcactcaccaccactgcactgcaacacagcaagcaagctcacttcttgcattcttagctcatcgattcttagccccttttctactatggcttgcactagggaggttgctttcggcgtgaacctgatcggcaacaacggcgccgcaccggcggacgaggccagcagcctcgccggctgggcgccggtcggctcgcgcaccacgctgtccgctcacgtcgagaaggacgacccgccggcggccatgctcccggctgtggacgacggcgggcgcgagcaccggccgagcggctctcggtacgtcctcgcggcgcgccgtgacggcgaggaggacgggctgcggcacccggtcccggccggcgcgctcgtgccccgggtgacgtaccgtgtcgccgggtgggtcgccgtgcagagcggtggcggcgaacacgccggcggggagagccacgtggtgcgtgtcagcctccacgtggacgatggcggcgagtgccgcgttctcggctgcggcgcggtgtgcgccggagtggccggcggctgggtggagatca

SEQ ID NO: 7742 - DNA, 428 bp, Oryza sativa
atataatatatgtagtaacatattagttcattgaatatatttttacagtataaatctattatatgtgtgttcaatggagtgcacaacggatatgaataattctaccatcatcgtcaaggtcgtgcctggcagcctgggtagtcgcgtttcagaataatcccaatctacgagatatagttatactctctgcaactcacacaactacttagagttgcctatatacaaggttcgcatacttacatggcttaattcacatacttggctctgattgttacgaaacatgttttacgtggacaaattaaaggaattagtggaaagcttactacgagaagataacttagcatggaaggaagcttagggtgtaagcaagcttgccgcggaagcaagcttaagacggaagccgtcaaccttctctgcctataaataga

SEQ ID NO: 7743 - DNA, 1501 bp, Oryza sativa
ccataatccatatattattaatttttccttggccgacaaacaaaacacaaccaaacgcaccgttgctcatagcaatggcccgaatacataattcaattccagcgcagttttcgccatcgattctgtcttgtctgaatatattacaagtcgttttcaattttgccgggggtgtacgtacgtagtaacgtactgtacggtctcattcccaggattcgaccaaatcgcggccaatcgatggaggtaactgcaaaatatatagagcgcacaaaaaaatcaaacctgcacggtcgattggagaatatatatgccaccatagccctttcctgatcgcactgcaacaacccgatttgattaattagctactagcaggatcgtacgattgatctgtccttttcacacgtgcgacccagccttgtttcctcactcagccgacacatccatccatcgatcagaagagaaaaattagtgccagtgcaatttatttgtatagaactagtctaattaatactgtagctagcctacgcgcttgtctgattgtgcattgtcttatccacttcggcagcagtggcagtataactaatgtgatgattagtactccctccctccgtttcaaaatgtttgacaccattaactttttagcacatatttgaccgttcgtcttattaaaaaaatttatgaaatatgtaaaactatatgtgtacatgaaagtatatttaacaatgaatcaaattatatgaaaaaaataaatgattacttaaattttttttcgaataagacgaatggtcaaacacgtactaaaaagtcaacggtgtcaaacattttgaaacggagggagtagtaagtagtataattatattgctgctgttagagaggcagctatagcttagtagctgctgttagagaggcagctatagcttagtagctctcgatggccatggccagtgccgggtcgccgttaatttcactgtgctggtggttgggaagtggttggagttggctggaattgaaacggtcgatcgatctcgacggcccccggccagcagctgacagctgcgttcctatgatcgaatcgatcgatcgaacgtgtggtctgatatgatcatggaagaagaatcgatcccagcaaataccttttcctgtcgtcgctgtcgcctgcgatattccttcccgtatcgtacgtcgctctcacctctctcacatatggccgtggttgttgcgaccctggaaattcatcagaacccccacgaggcaacgtaccttagctctagaaggagatcgatcagatgatgaggaggaagacgacgagcatgcgctgccactgatcgatcatcctatttgtttattgcgactgcctagcttgtcttcacgcacacatgtgcagtgtgcaaccggtatatataaaggtgtagcgggtgcctctgccatggacattagctagctcagctcagctcactgccactgccgctctgcctgccggcgatcgaggagaagaccggccggc

SEQ ID NO: 7744 - DNA, 409 bp, Oryza sativa
caataagggattcaaatagttatggcttgagaccagggcaagatcatatcaatctcttgaaaaaaaaaggagaaacagcacaacgaatcaactatacgtcacatccacctaacaatacaagattcccccaattgtgtggcaggggatcagatccgaatagacaatcacatgatcaatagctgcacaacgaattaacaagtatacgccaaatccacctaacaacaagatacaccaatcatagcaggggatcagatccgcataggtaatcacttgatcaatagcagcacaacgaattaacaagtgaacgtcaaaacaacctaacaagaagaatcaccaggggatcagatccgaatagacgaagaaatggcaaaaatataacatacgaagggcgtgccgctggcgcaacagg

SEQ ID NO: 7745 - DNA, 904 bp, Oryza sativa
ccggatctcctcttcgatcctgccgcgcatctccgcgagcagcgcagcgtctgtctccagcacgccgccggcccccagcgactcgtacagagacgccatatctgacgccaagcacatcgatcagatcaaatcaaatcaaatcaactcaagcgccaaattcccacacacacacacacacacacacacacacacacacacacacacacacacacacacacacacacacagagtcagaagcacgcggcaagcggaagctgccacggccattgattcgagtggagggggggggttgaggttttctaccatcggatttgactgcggcgaggacatcggcgcggaggtcgaccttggcgaggtcgtccacgtccgggtgcgagagcaggaacagcttgtgcgccagcaccaggtgcggctgctgcttcccttcctcgcctacgccgccgtccatctcgccgccgcttccgccgccgccgccgccggagaagagtcgcctcgcttctcgctttgcttccgccgcaagaagagattgggagagaacacgagagagaaggagagaaggctagtttcgtcctccaaagtttttaattcgggagagtatttccaggctactacgacgttgcagagcgacgtggtcttatctgagacgtccgtaccacgatccgacggctgtgcggggggccgagatctagtacggcacgtgtacaagggcaaagcgcaacaccgacccgagtccaaactccaaaccccattccgtttccgagttccgacccgcgccgccacgccacgctacatcccgagctctcaccgagagacccaaaaccctttccaccgatggccaccgccgtagccgccgccggcggtggcggcggcggcgagcagccgcgcaggaggaagccggcgccgg

SEQ ID NO: 7746 - DNA, 1501 bp, Oryza sativa
gtccagcttgttcaggatgacgagcagggcctcgtccggcagatcgctcaggctcatcgtgttgtcttgtcgtcgctggcgttggttacttgcttttgcaccgtgaatgcccacaggccacagcccaccgtctcaaggcctgaacagcagcaggaaacctgcttgtctgtagttctgatttctgaaccgaaaccaaacctgcggcgagccggcgagagcaagtgcccttgtcacactgtatttatctgcgacgctaccgctggccgcggcgtactcgtttccgactacagtcctactgacctactccctctatttcaggttacaacacgttttgactttagtcaaaatcaaactactataaattcgattaattttgtagaaaaaatagcaatatttttaacacaagacaaatatataatgaaaaatttatttaattatagatttaacaaaatgttgtaaatattactattttttttctacagagttagttaaattttaagtagtttgactttgactaaagttaaagcgtcgtttaacctttaaacggaatttaaacggaggggaaaaagtacacccaaggtccctcaacttgtcatcgggataaaaaacgtcctcaaaccacaaaaccagatatacggggtcccttaattatataaaaccggtcaccggaggtccttcggtggttttgaacctggttttatccgacgtggcggctaaattagcgcaggaccccgtgggccccacatgtcagctggccacgtcatcaaactcctctctcttttcccctcttctctctcttcctcatctctctcccttctctgccgccggcagtgcctcggcggcgggcatcggcggtgatggcggcggcggtggggggagcggcgtacgggctccccgccggtcgccgtccacgcatagctcctccccccgcagcttgcgcccaccgcctgcggtgcgccgccgcctccccgtcggcgaggacgcggtgcttgaggttggatatgtcgaagcagcagaggaagcatgtaggcttggtgcagctggggatgtagtcgcggagcatgtcagcgacgccgcggtagcggcggaacgcgaggagagagcacgcccggagctcgagagcggcctccatgcgcggcgacaactctagcactgcttccactagtccaagcgccgtcgtggccgctgagtggtcgccacattccccattgagcggcgcggcggcagcgaaagcagcccgtgcctcaatgaggtagtcgccgatgatctgctgcacaatgcagagcaccaacaaatcagttgctgaagccaaaggcaaaggcaaatctaaattgggagcaaaaccgcccaaattgccatcattttttgtggcacattagatgaagaattaaagagggagcaagaaacaacctttcggtgtccgcggagccaaatccttctcttgtcaggaggggaagaagacggcgaggacaccgtcgccgaccaccgccgttcgtccgca

SEQ ID NO: 7747 - DNA, 1501 bp, Oryza sativa
tttcccctcttctctctcttcctcatctctctcccttctctgccgccggcagtgcctcggcggcgggcatcggcggtgatggcggcggcggtggggggagcggcgtacgggctccccgccggtcgccgtccacgcatagctcctccccccgcagcttgcgcccaccgcctgcggtgcgccgccgcctccccgtcggcgaggacgcggtgcttgaggttggatatgtcgaagcagcagaggaagcatgtaggcttggtgcagctggggatgtagtcgcggagcatgtcagcgacgccgcggtagcggcggaacgcgaggagagagcacgcccggagctcgagagcggcctccatgcgcggcgacaactctagcactgcttccactagtccaagcgccgtcgtggccgctgagtggtcgccacattccccattgagcggcgcggcggcagcgaaagcagcccgtgcctcaatgaggtagtcgccgatgatctgctgcacaatgcagagcaccaacaaatcagttgctgaagccaaaggcaaaggcaaatctaaattgggagcaaaaccgcccaaattgccatcattttttgtggcacattagatgaagaattaaagagggagcaagaaacaacctttcggtgtccgcggagccaaatccttctcttgtcaggaggggaagaagacggcgaggacaccgtcgccgaccaccgccgttcgtccgcaagccggctgtcgacgagatgtccccgcgcagcctcgcacacctgcagtgcctcctcacgctcgggctccatcgccgacgagtggcggctgggacgggctactcgacccgctcgaccagaacctccgccgcgaggtcctccgctacggcgacttcgtgcaggccgcatacacagcgttccattccatgctgtcggcggcggcggcgtcgcagcacatctcgggtgggcgcaccggacgctcgtgctccccgacctgcggcggcgtcgcagcacagccagaagggagagagagatgaggaagagagagaagaggggaaaagagagaggagtttgatgacgtggccagctgacatgtggggcccacgtgggtcccgcgccgactcagccgccacgtcggataaaaccggattcagaaccaccgaaggacctcggtgaccggttttgtataattaagggaccccgtatatctggttttgtggttcgaggatgtttttttatccccatgacaagttgagggaccttcggtgtactttttccaatggagggagtagtatccaaccccagcgtccgactccgactcccgcttgcacgcgttcgtcacggcccgttgaggcccaactaagtccaagatgggccgtcggcccacggtgcgaacgccggcgccaccgttgtccctgctgctccccacgagggttttaggcacgcctccgcctccgcctccgcctccggcagcaagtgagcgcggggagagagacagaagccggcggcggcggggcgaga

SEQ ID NO: 7748 - DNA, 1501 bp, Oryza sativa
ccatccacgtcgtcgtcgtcgtcgtcgtcgtctactccggcggagggaggagggcggctggtggcggagctggtgggcgcgttcaacgagctgacggggaggatgggggagggcctggccacctcgtcgtcgtcgcgcctcctcttccgcgcgctcaagctcgccctccccgccctccgcgacggcgacggcggccgggctctcgcccgcgcgctcgctatcgccgcctccctcgccgacctccaggtagtttgctcgaatcgaatgattgcatcctgtagctcgacttgccgaattgggtgaaatgcattgcaaatttagtagtttcattcatctcattaagcttagcaatccacatgagttatggtcttatggataaagtagtactagtacctcgatatcatttaaaaccatgtggtgcaactcctctttgcttctagcaaaggataattcatcgtcacataattcccattgtaatcaaaactctggaagcaagatatattttgctgctggtgtggcagtaattgtcatacacacattggctacgattgtcagtttagttttatgttagtacttagtagtaccaattattattgtttgcttcgcagttttcatctgggtgcttatttctaccattaccacaagtacaactagtagaggacattattatcatagctaaactggcattgatgagttagtagtttccattaccagagtaaaaaaatgacattcctaatgactaggacttgttctttttttaaaaaaaaaagataataatgtcggttgtgcagctgtgtgcgactatggaggaggagtggggaatgtggggagctgcgggcttggtgccaggaggaagcttgcagcagtcaaccgagcccttgcagtagtagtggtggtagctcgctgccgggaggtgtcgtctcgcgtttgacgcagcggcaggcagccatgtaaaagtgtgttgctggctttgccggcatgtagctctttgctgtagcttgtaacttgttcttccttttctcttaataaatctcggctggctcttcacgccagcccggcgaaaaaaaagataatattggttaggacttgttacgaaacagctatcccttatttgtcgtttggcttctgtccatgagaattttctaactcttcatttccttgtattgttctggtaattcataagatactttatacttacacttctttgtgtcatagaacagttaagcatctctggtttatttatccactttaaactgtaagatctaaccagttttttttggcacatggtggcagatggacgccgaagttatttcagccggaatactgagggaagcacttgatgcaggagcaataagcatgagggatgtcaaatctgagattgggatcagcacagctcatttgctgcacgagagtttacggcttaagcatgccccttcaaagcttgatgtacttgatgatgaaagtgcaagtgcattgagaaagttttgtctttcttactatg

SEQ ID NO: 7749 - DNA, 1501 bp, Oryza sativa
agggttacctaaatggtccgagcgtccaaagtgtgggtgcagagatcgctgtcaggtggctacatcctttgctgaacaaacatttggaaggagatattttgtctgccccaatgtagacaacgatttcgttgtatgtctaaccgtttacaaaatccgctatgatttgcacaaaattactacccaaactgaattacattactatttttacagggcaatccaaggatgtgtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgaatttttgtatgcgtaagactaagggcctatttggattgctaccaaaaacatgccctaccaatatttttgtaatttgaatagtacttgtgtttgatttcgattgaagcctattcattggtaatacctaatctagatttgagattatgtagaacattcttcactacaattttacattttggcagcaaaccaaatatgatcaaatgcaattttaccttaccaaagatttggtagtgccaaaacttgcttatattttggcactaacaaaatatttgtacggtgacattccaaataggccctaaaaaataataaaattgtattttaccagtcttggagattttaatctagtatagttttcaatataaaaagatttgataactattgatatttataaaaaaaatatatttctcaaataaagtacagtataaaatcgtcctcccccagggctgcaaaggggcgcctgcaaaattccaggccccccgccgcccatttgcaggcggccccccgcacagtagaaaatcgccttattggagggcggcaagggggccgcctgcaaatttccatgccccctcgctgcccatttgcaggcggccccccgcacagtacaaaatcgccctagcggagggcagcaagggggccgcctgcaaatttcgttgacggccgtcgcccgagagcgaacagccgtctgccacgtcactttcgccgccctttgggatggcgatttttaaggcgactacttctgtcaattttcaaaatggaaaattatttttgtaaaacttttaataaaaaaattaaaaacaaaaaaaaattctagaatgtctcatctcatcctatctcttctctactattataaaaattgaagatatttttgccgatattttggtacatcatccgtgtattagtcggtttttaagttcgtttgattttgaaaatacatatctgtatttgattcaattttgaaaatacatatctgtatttgattcagtttttaagatcgatcacttttggtaatacagaaggaatcatataagaaat

SEQ ID NO: 7750 - DNA, 1501 bp, Oryza sativa
tgaactcttgcagcggccgcagaggacaaagttgtgcaggcacggtctgcatcaccctgacgaatcgtccgatccatgcatgcgtcctcgtgccacgggttacgctcgtagccatggtctccgtcgcgtctatggcagtggaacgtcttggcccgaacgccgcttttaaacattggtggcggcggcggcagccagccggccaccaaaaaatcagcacacggtgatctactattacgttattatcacacgtcgctgcctctcggatatattatgatgatcgtatatcgtatcgagccttgcgttttggaatggatcctattccgtttctcacacaagaacgcgatccgattgaaaattgaatcgggtgattttgttcgacagaaatgaaaacgttccatgctttttaagtagtagagaagagaagatataaatataggtaatgatagaattagaaaccaattcaaatacggatgacgtaccaaaatctcggtaaaaacaacttcaatttttataatagtatagacagagattccggtcaaaaaaaaatagtagagatagggatatggtttagttaagatgaatttattgtgggagttcgcttgaatatatatatttttagaaaatcatgagctgcagttaggtgtctgatcgtctcaagttagcatgcgagttttttttaaacatatttcttatatgattccttctgtattaccaaaagtgatcgatcttaaaaactgaatcaaatacagatatgtattttcaaaattgaatcaaatacagatatgtattttcaaaatcaaacgaacttaaaaaccgactaatacacggatgatgtaccaaaatatcggcaaaaatatcttcaatttttataatagtagagaagagataggatgagatgagacattctagaatttttttttgtttttaatttttttattaaaagttttacaaaaataattttccattttgaaaattgacagaagtagtcgccttaaaaatcgccatcccaaagggcggcgaaagtgacgtggcagacggctgttcgctctcgggcgacggccgtcaacgaaatttgcaggcggcccccttgctgccctccgctagggcgattttgtactgtgcggggggccgcctgcaaatgggcagcgagggggcatggaaatttgcaggcggcccccttgccgccctccaataaggcgattttctactgtgcggggggccgcctgcaaatgggcggcggggggcctggaattttgcaggcgcccctttgcagccctgggggaggacgattttatactgtactttatttgagaaatatattttttttataaatatcaatagttatcaaatctttttatattgaaaactatactagattaaaatctccaagactggtaaaatacaattttattattttttagggcctatttggaatgtcaccgtacaaatattttgttagtgccaaaatataagcaagttttggcactaccaaatctttggt

SEQ ID NO: 7751 - DNA, 250 bp, Oryza sativa
tcatgaccaagttggccacgtcttccagccatcgttgggctggagactccgggtcatggacgacgggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggagg

SEQ ID NO: 7752 - DNA, 509 bp, Oryza sativa
agattgttattgacactatcatcactgattttacatttagaactattagaagaaagggacaattgtgtttttgcccctatttcatgttacaaatgtgatttaacctttactttttagggtttgtgtttttgcccttacttttttcaaacgtagctgcagtttgcccctgttttgaatggccgttagggagacccaaatttgtgagacaaaagagaagaaaaaaatatttacaaaatgcaaaaaggactattgtacccctggaagaaataactagcccaacaccacgtccgttcgaccgtccccatccaaatccggtgcagggctcaagcctcaagcagttagcggcggcgggcggtgaagcgccacgggaaggcggcagctccagagggcagcgtacgggcaagcggcggcttcggcgatgatgtagaagggggaggagcagggcgcctcggctacgcttcagcagggggggctcgttgctctttcccctcttgtgcgtcaactacagg

SEQ ID NO: 7753 - DNA, 654 bp, Oryza sativa
ccagctaggataaaaaagatcaccataattctatcaattcaccaccagttgcccgttggaagcattttaagtcttggtaatgaaaagtcagccaagcaaaagtggcagttggctataaacattcacccagggagaagaaggccatatgtggaataaccaggcaacacagttatcggtgtagatagcccaataaggcagtcatagacattttcccgtttaaatcagcttttatcattttacccattctgcacaccaaccaagcactactcaagtttcctttattaagagaagtgatcttcagcaaaatttcttgtttcaacagcaagtaactacgggtcactcataaccttctaatcctctattcaagtttcctttattaagttcagagaaaaaaagtatatgaactatgagttgtttcgttaagtatggcaaactaaattagcatccaatcaaaatgataaaagcatgctatacatgacatcaaacaacaatgagaagctgtacacaataatctccctcgctcaatttatccacgctatcgctgctactgtacctttgatgagagagacactgggaagagaactcacaggttgaggtttttggatttatagcagctgccggtcttgtacctttcctgcttctccgtcgcgcagg

SEQ ID NO: 7754 - DNA, 562 bp, Oryza sativa
aagagcatttcagtgattaatttaattggaaaagtatttaaaatcacctttaccttttcgggccgaattaggaaaagtcctctcactctcggcccagtctcctctcagcctgcagcccttttcctctctttcccgaagtctgcttttgtccctcctttaatcagtctttggaagtagaagcccagcagaaagtctactttccctccctggcactgttcatcttccagctctggacagagccgagccgcccgtgctgtgccctgtgccgccgcctcttccttccaaatctcgcctccccgttgctcctttttccaatttagttgaggggaaatattcctcttatcctcctctatctttaccccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagc

SEQ ID NO: 7755 - DNA, 1253 bp, Oryza sativa
aggaaatgtcagtatgaggttctggtctcaaggtgccaacgacttgaaacttgaaagaatggcacatttgccatgtgcaggatataaacaaagaggagtagtaggtgagagaccgtgagagagaccctcgttgaaggtgcaaaggtgctctttacgacttgatcttgccttgctgttcttgcattggaagtacacaaaaactactccaaaccagtacactccgtactcgccattggcaagctaaatactaccagaccattcgactaaaaagaagataaaaaagaaagaaaatgggtacagtaacttattttttttactatctcatctgttgcctaaaaagaataaactgaactaaaaaactttaacttttaagttgattttaaaatattttaaacttttttcaacattaaattttaaataattaaaaacatatataaaaattttacttataaaatattttttatctgttaataaatcattattgtttataatcagctgttaagcaaccgtgagacaaccattcactgtccattcaagtagtcaatttgctgcgaaagggtatatagtctaatggttataagagcctcaatagtattttaggtcctagattcaactctttatgggagcgaatttttcaggatttaatagtattatgctttcagtggtaggtgacgtacccgttgtgtgttgtgttgtactgtataatcttttttaaaaaatagtcaacttgccactttggcagagtttattattattttttactgcagggtaagaaccccaagaggcaagtaggcaaccgcaaccagccaaccacaggagttaggacaggagacatgctcccaaagaggcaaagatagcaaggaccgggtcgcacaattttgacggctgccacgtgtcagcaacaccaccccgcgcgtgccgcgtgccaggagcgggaagacgagctgtccgcgtcgtgcgatccagcgttgctctctccatcccaaccgttaattaatcaacacacctgccttttctttcattctctcttcttttcctttccttagacaaaactccaaatccattccaaaaacttttttcttaaaaaatggcaaacctaccgtgacattggaccattttgcaaaagaacaaataaaataaaataaaatgattttcactccccttttttccctgaggggtggttgtcacgttctgatcaagcatccaggttccaagctggaacctggagaaaaaaaaatagggacgtcctacca

SEQ ID NO: 7756 - DNA, 1501 bp, Oryza sativa
tcctaacattttgaagtttaataattagtaattggcgaaacaattcttcaaatgcacctttttttgttgctactaacattttgtataaatacttggggctgaagttacatttatgatttttctatacctcgatctcgtccaaaatttgaaaatatatccatgctcaaaatattaaagtatgacttgaaaccataagtccatatcgaaaacacgtttttttgtgaccgaagcaagtattctaacatggtgacggctactatatataccaaaaaaacaacatgacaaatacgtatgggatccaccgttaattagggtgttagttaaacggcctagctgtcggcgactgtaacagtgggacatcgtacagtactccctccgtaaaaaaaaaaggcaaaccacgggtttgcgtgccaacgtttgactgtccatcttatatgaaatttttttataattagtatttttattgttgttagatgataaaacatgattaatactttatgcgtgacttatctttttaatttttttcataatttttttaaataagatggacggtcaaacattggacacggaaaccagggtttgtctttttttttgggacggagggagtacatacgaagctgcccagcagcagccgccaaatgcacaaaaaaaacactttttcccctttttgaatacgaaaatcaaagaaatgccttggaattaccagtgctatgtactccctccgtcctaaaatataattatttttaaatcataacacggtctccgagatactactttgaccaataatatctataaaaataaaacgttttaaataaaaagagttatatattatgatagtttgtttaatgataaatctagtaacatcaattttacatgattgatctttttttattaatgattaaaattaaaaatgtttgatatattattatgctaaaaatacttatattttaggatattttgggatggaaggattgcctaattaaatcatgcggcaattgcttcaggagcagacaagccaatcaggcagagataccatcatgagattacaaaaggccatttgatcgatgtgccatcatgtacatgcacgaaaaaaaataatgttttatatattaccacatcatggcaatatatggtttggcagtagaaaaaggtgacaggtacgcgcctgaaaatgcaaatatcttcttctaatgatcaaggcccctgcctcagcttagtccaaataaacttactattaacttaccaaacaaatttaaacgagctgttcctttcagatctaccaaacgatgtagtttgtcgatggaaatgagaaccaatttggtagttagtattactttccagtacttaaggagtagttagcaagtggatggagatgatgacatataattgtatatataatggagacatggagttggtagtacggagtactcccttcgtcaaaaaataaatctaaaatttgatatgacacattctgaatctcgggtatgtctagatttgtaac

SEQ ID NO: 7757 - DNA, 1501 bp, Oryza sativa
ttgaaataatatggaacgatgtggttaaaacatctagtttgtttaccatttcctcagcggaactgtgaattcgcaccttcacttcttattgtagttatattctttttccttgctagctggcgcgtctgttcctactccttaataatatggtaaaaacttaatgctgaatatgtttcttttttctgttgatacctgagacaagaataccacagaggctggctcccctagatcagatggcgcccttcatctctggaattttttgcttaatcccaattctgatagtctattttcagtatctttgttgggacataaaagatgtataattgtgtgcatgtcacaaatctttccatgattcattattgctcaaattattaaattctactgtaattacttgcagttgcaaacttgcaatatgtcttcagttctgcttggttactcaaacttatcaacgaaaccgcaaggtcaagggcgatttattgaaataaatatttggcactggattttttttttaggcaaatgttttgttgcttccagcatcaagcaaggcctctgcgatttttttagaaaaaatcccgtggaacaatactacacaggaatgaaatgaaaccaaactcctgaaattttatataccaacgacctgtttggcaacaattggggaggggcataatattagctctgggagttgagtgagggaattaatatgggaattgacttttaattccaatctcttgtttgggaatttgattcacattctctgtttgttgcgtgggttttgaggtacgaaattatatcggaagacatgataaacggtaagattaacgagagttggatcaattagtttcccatcctaatccctctaaatttcccacatcctccaatcaaactgagattataatgcttaagggtgagttcgagggataggggattgagaagattgggaagatacgcaaaacgaggtgagccattagcatgtgattaattgagtattaactattttaaattgcaaaaatggattaatatgattttttaaagcaactttcctatagaaaatttttgcaaaaaacacaccgtttagtagtttgggaagcgtgcgcgtggaaaacgatgtgctatatcactcattgtccatgaaacgaacgcactctaaatctcctaaacttccattccctcttttcaaaccccccaaccaaacaaactgcaaatgctttctaaaattgagtacgcaaaaagtgtaactatgtcacatgtcacacaacacagatcttgaaacagttatatcaaactttaggatccaaatttgtacgagttgaatacaaggaaacatttttatatctcctgatgttaaggcccgtattaaattaagcccaaaaacaaaatcacatctctatccaagattccagacaagccaacaagtagagtaaccatcacagaaaccttcaactatccaaaactcctcatcctccccccattctatcaccaagaaaagaggggaaaaaaaaag

SEQ ID NO: 7758 - DNA, 1157 bp, Oryza sativa
ggggaggaggacgaccggagggtcttactagagccactgatgccttctggcagtcgatgagactagggcactgggcggtggtggaggtgatgtgaatcgcgctctcgcactactaagcggcggcaacatgagggagtcgagagaaaggggatgagaagaagttttttgggcttggttgcctgcacgaatcttaaagcaatcgggtggtctaaaatttacaagatttataggggctttcagtcaaatgatgtataggcagtcccattattttttgaggtatatcaattatttcatgttttgctgtgcattattttgtctctaactatttttactcttgcttgatgttgcattgtttgtatttatactcattttttgtttggtgtcgcataaaagaaatataaatgcattctacaacggtccaagaccttccacgcatagcatactccgtatttttcattgtgtgtatgtgatctcctacaatgaagtttgaacagttcatggacacttgacggcccgtttggttggagggagtttttaaaagggattgagagtttagagggatgaggctattaagtgttttgtttggttgggagacatgagaattttggtaggataaggatggggaattgagggaattggataggggcaggtaattgggagggaattcctcctttactttgtctaagcaaatctcagccatccgtttttattaatgacgtaatctccaactaaactccctatcaatttccatcacctctaccaaacaagatattgggattaaaaatcaaattcccatcttaatgtcatcatccctatcaattctcaactttttcttcaaacttttaactttttcttcaaactttcaactttttcatcacatcgagactttcctacacacataaactatcaacttttccgtcacatcgttccaattttaatcaaatttctaattttggcgtgaactagatgtgttttatctatataattaattacatatgataaatttcagacgaagtagcaccattggaataatctttgctattataaaaattaaaaattaaagatgttttcgtgtttcgtcatccgtatttgagtcggttttaatatattgatgtgtcaagatgtttccgcggtccgtcattcgtgtttgagtcggt

SEQ ID NO: 7759 - DNA, 1501 bp, Oryza sativa
gagatgagagaaataacaacagagaatgttgtagcttactcttctgtttctgttttccaatatacttttacagggggagaagggatagatctcattactctgcttaaagatatgtaggcctgaatcattctgaataacagtgctacctgattatttcctacctgaactttcagaaagtccctctatgtaatgtagcacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctagctagctaatctaagctatagtgtgttgttgtgaagtggagtactagctagctaccactctatcttcttcttcttctacctcctcctttatatcttgcccctcacatgcacgcatgcctctccatctccattgccgtcctagctagctagctaagctagtacactagctaggccatggcatggtggtgatcaagaaagcgagagaggtggagcggcaa

SEQ ID NO: 7760 - DNA, 750 bp, Oryza sativa
aatgactaccgattaattaataataattagtgattaattatcatgattaacagtaattaaggctgtcggtctcactggttgaggatgcgagaccgctgctcggtctcgctggatgggtatgcaagaccgctcagtctcacagctcgagactacaatatcaacgatatatttgtgcgaataatttgtacctgaatatttctaagagcaaaaaaataaatagtatattttcaaattttatgagggacctaagtaaattattcctgtggatgaaacgtccatacacagttcatattgtcggccaggtggggcccaggcccatgactgagctctccacgtcagcacaccacgcaagaacactggacaataaacgtgcgtctacttaccattaactatgtctaaatacgtgctgcattattaattgtgttatccaaattgtagacagtactaggactagtagtatattagtagtagtagaaatttaaaacacagtacgcatatatatgtacagtactatagatcactggctaacaataattaattccttctagacaacataagacaaattaattatctagtctcagctcatgccaaaataaccttatatctatattttaatgaaattaaacatttatttgtttttatagattcactctatccaaaaatcttaaaaatatttctttttttttcaaatgtccaaaagtcttaagtatattatttcatttttctcaaatgatataatatttttttatt

SEQ ID NO: 7761 - DNA, 1501 bp, Oryza sativa
gcttatgcacatctgtgttctaatgttctatagcctgatagatatgatgtgttgaaaccttctttgctgcttttctttcttctgtgaaagtttatgttaccatttattggtaactgctgtctcctgggacataattgttggtttctgattgtgaatttataaatttttaaaattttggatgtgcaatgcaacattagactggggagatccagatttttttcagagatctgagctcttctcgacttctcctagcctcctgatatagttataaaagtggtcagaactaataagatagataagttgtcatatatgttgacaaattgtcattgtatccctataatttggatggaggtatattcttctttgcggagttgattgataagtaccctttatgtaattgtggttatgaattaaagtttgttttagtctggtgttgactagtactctctctgtttcatattataagattttcgtattgtccacattcatatagatgttaatgaatcttaaacacatatgctagaaagtcttgtaatataaaatggggggagtagtttttaatttcttgtgtcaattaaaactatacatttacataagcataaaatcaagaaaaggttttgttttaaaaaaaagattagccatgtcattctaaagggacaatgttacaacaataattttgatcaaagattaagctattttgactgcacaaattagaaaggaacattctttttgtgattaaacgtactactccgccgtttctgctcaaaacttaccgacaacgacacacagatttccggcgcatctaattcccccactatgataagataagcaaaagcaagggctatgattttacacggcagagttcaagattctcacaattaaataaggaacataaaaaagcatgctttatttatcgccaaaataaaccttactaatttctttccataagccaaacaaaccaaataggacctcaccattatgacctttaccaaaatctaataaagttccaaaaccaaatagcactttcacactaataaccttatgatctttctgctttacaacatattggtaagatttattttagcaacaaagtaaacatgccataaatgaacaattagaacaaccagtgcaagtctccttctccaataaacatctccttccatacataaacaccaccaagtcaaaaatcagcacgtcactacggctatatatatagtacacgtgaagaacaatcaggtcgcaatttagcttttactattctaatcagcaactccaaccgatccactaattacacgtcagcttgcttagccgcgtcgcgctgctctgcttgatcatcatcaccttctccgatcgatcctcctcgacgccgcccacaaatataaatcccacacgcgtcctcctcctcctaataaactcctccaattcctcgacgaatcagttttctcctctgattttccaccacaagatctctagtttctttgatttcttgatcagacgacga

SEQ ID NO: 7762 - DNA, 1501 bp, Oryza sativa
taatctttatcttcatcttcatcttcaagagattcaaacaccaccgtattcttttagtgactaaaaaatatacccgtgcgttgcaacaggtaaatgatattttaattttattgttgttatatggtttagctagagtaaattcacagtaggattcgcttggatatttttttagaaaatcataagttgtaattaggaatcattatttcattccaaattagcatgcgagtttttttaaagagattttttatataacttcttttgtatttctaaaagcaagttagcttaaaatccaacttaaacaaggatttgtatttctaaaaacgaataaatttaaaaaccgactcaaacacagatgacgtaccaaaataccggcaaaaaaatcttcaatttttataatagtagaagtaggtggcatgcctatcaatagtaagttaattatgatgattttatcaagagtaaaatgcagtagcgtgtcggcgcgaccatcctcctcccctagtcgccgccgtccccctccctcccatcagtgccgccgtcctcctccccaagtcaccgccgtcccctccctcctgtcagtgccgctgtcctccctcccgttgcgcgcttgcctctggcacggctgctcggcgaaaccgcggcagtggcggcgctcatggcgtgcggtggttcagcatcgccaccgctgtcctccccccatcaacgccgccccgcgctctcgccgccctccttccaccgtgccggttggccggcgcctcgccaagcaccaccgcgacggcccctcccctcgtgccgcctcttaccaccgagaaaaaagaaggaagaaagagaaaaaagaaggaagaagggagaaaaaaaatttcatgtcatcgtccacgtgacatgctacttaggcaagaccacggtcaaacgcggctttggaccgggatgatacatacaataaactaagtttagagacctcgatgtgcgctttacaagttcgtgaatctaagtgaaacctcctgataagtttaagaatcgctggtgcattttactcttttatcaatctcgttttgtatttgaaggtagggggtaaaatatgtctacttacattctagaaatacttacgtgtaataaagtgtgtctttaaaagaaaaaaaaaggttaaatgcattcctcccctaccacatggacgacgcggtccggtcgcctatggcccacatggcagtgacgtggagcacaaatgacacgcttcatcccgcccaccattccgggtaataatcaggttgctaatcctccatccatcgcgtcgccttgcttagccgcgtcgccatctccctccatcaccttctccgatcgatcctccccgacgccctccacgcgccaccgccatcgcgttcgctatatataccccacacacgcgaacacatcttcttcatcttcctcagctcgatcacttcgatttctcctctaacttcccgcgacaaagctctagtttctttctcgatcagaccacgtacgacaa

SEQ ID NO: 7763 - DNA, 1501 bp, Oryza sativa
  unsure (1)..(1501): unsure at all n locations
tcactgcctttttcgttcctcaattccgtagtcctccaactctactcgccttcacctagcacatcagataggtataggtgcgtgcgtgccacttggctgctgtacagtgttaacaatttttaccggtccggcatttcgaaccatgtcacgatcataaattgctccgtttttcgaccaagtctaaaaaaatgaaactaaaattttagttttttataagatttatctagatttcacccatttggatccnaacgaaatgangaatatncgtgaggggcggtttttctggtgtttcttcgtacacactaaaaatttatctattctgaatgtaaaacatgatagttattatagtatattaattaagtataagcttaaaaaaattaatatgatgtttttaagtaaatttttataaatttattttggaaaagtaatgtttaacagtttaaattaaggtcaacaaagagataggagcgaggtttacgttaccgctggtaaccgcgcggttaccgggcttaccgcggagtacagtaatataaatacgtggtaaccttcttagattcaaataaatttaaaaaataatttaaatgtttgataaattttacacggttttgtatgatttcacggttaccgtggtaatcgtgtctaccgctggggcgcggtagcctcggccccaggcggttttgggaaaccctggtaggagctgagaaggatgcgaaaccaacggtgctggctgctctgaacgctgttggttgctgctgccccgtggcgacgacacctcaccggaggcaacacaacgcaacgcatcgaaatcgaaccgcagcgatccagcgagcggttgagtgttgccgcatcaccgagtcaccgagacatttttccttttttctttttttgtaattgcagccgcctcgcgaagcttcgtgccaccttcctcccgtcgccactgcgtcaccttccctcttttcaactctctccctctcacacaccgcattgcagatttcatttgctgcaccgccctcccctcccctgcaaatactactagtagcacaagagccccgcatgccgttcacacctgcccaccaccaccactcgtagcccccaccgcaaccacccacacccacaccactctcgatccttcttccccgactccggccggcattggcggtggtggaggaggaggaggaggggaggactctgggctgtgtctctgtcttgcgcggcggcggcgcgagagggagagattggttgtgattttgggagtcccgacgtcgcacgcgcgcgcgtgtggagtggaggaagaagagatcgcgtctcttcgcccgaggatttctcgggatatttttatttgttagttagtatttataaagacgccgcggcggcgagggcgaggtccccgattcagtttggtttttcttctcgccgacgcgcagatcgatcgcgtcgtggactgggaattcttccccccgcattgttgtttgaggtgaggtggtggtggtggtgatcacga

SEQ ID NO: 7764 - DNA, 1332 bp, Oryza sativa
aattgggctgggctctgggcctgctcggcccaccattcagtgactcggtgaacgttggtgtgaagcatagaaggcgtgaacgtgcacgtgccccgcgccgccgagaggaaacacgacaactcaaaccaatcctgtccgtccattcatcccgtagacaatctgacccgtccatccagatctgcgacgccgaataaatagccctcctcctcccacatcccgagctccgcccttctgacagccgccgcatccgcgccgcccccgacctaggatttcgccgccattctcctccaaggttcgagatcctcctccccgagctccggatttttttttctcaatttttctctcgctgttgttcgattccgttcctgcacgcgcgcgcgcgcgcgctcgccgtaggttcgtttgtttcatcgattatagcaacctagtgtggggaaggaagggataggagcgaaatcggaatcgaacatgtcagatttggaggccatcgaccatggctgccccatcgatcgccggcgcgggtttgtagagcttcgcgtcgcctgtgtgccgctcgcagagaggatttggtcatgttgcatctgattggatttacttttcgccgagggcaacaagtaacaagctctagataatttttgacctgaaatcagaaagctcaagtaaaaagggtaaagctgtgaagcctcttaaacccatatgtttaaacccccacccttgtgcttaaacccctcttatgtataggtttatgtgagtattaatgatagcatagactgttggtgacgcgctgctttctttgtaagtggacattgatgattctatcatatagtgcaagcgccccagtttttagtctctgctatgtgttaattagttcatgcaacctaagatgctacaattgctcatattgtgattctttgtagttacattgaattgtttgcaggcacgtcaagtagatttatttcatgttagtcctaagattacaggttcttataggggatgctatggctagacttgccttaactgattctttgtgaactttaatggctgcatctatgcctgttgatcttgtgtatgctgctctgggcggcaaggcctatctaatcatgccatagctcatcctctaatgtgattacttgctaggccccctaaatatgagtctattctgtagtgaaatggatgttgtaattatcaaaaacttctattccgttagtttttcctgcataaaaaagcatccactaactgtagatcttcatttgtaccagtattcatcctccttccaatcattcattagattttgaatagtactgatgtatttttgctgttgtcttcaggaga

SEQ ID NO: 7765 - DNA, 1501 bp, Oryza sativa
atcagctatccgtaagctatactagtgaaaaaaaaaacatactagttcttattttttttatagacaaaatggacacaagtaatcgctgggaatactaaaaatgacgaaagggctgcaccgtttgtcatttaattcaaaagatcatgctcacggcgtgattaaatcatataaaatgcaaattatattcgatcctaagtgccaccaattcgaacgcccaaatcaaacaagtcgaaccaataactgagacatatgcgagattgatatgaaccaaccagttcctgccgagcacctcctccgcgcggtatcccgtggcctcctcgaacccgcagttgacgtagatgatggggcagtcgggctcgagcgcgtcggtgacgacgagcccgcacggccccgaagcgcgcagcatcccttcaatcgcgaacgagaacatccctccgccgccgcccccaccaccacctcctcccccaaaaccaccctcctcctcctcttcctcctcctcctcctcctcgccggcgccgatgctgccggcgccgtccgactcgctgtcccactccatgggcaaactcgcggcccgaaaccctagctccggatccgagctcccgcgccgccgcggctcatcccatggcgcgctgctgcgcgaccgcgcgcgtgtgcgtgtgcgtgtgcgtgttggggattagggtttggtggctcgcgattggatgagagaagaggagaagaggaggaggaggtttcgagaggaggcggaaatgggcggaggtggtgggttcgggcttgggtttgctgctgctgtcgctggagaggaagaggtgaaaaaacccaacgagtggacgggaaaccgaccttgccgtgcactggacgaggtccagtgcggtcgatccgcgccgttggatttggtcggccggggtacgtggacggtggagatcggcggtttccggagcacggatcgaagttggttgctctcccccacggacaccagatgagaatgcccaccggaaccgccgtggccggtggtgagcctgttcctttgtgctggtacctcgctgggtgtacaacacagcatggtcatacctttcctataggtaatagaattgatgacaaatgaaaactttttcataataaatggtatatattaatgagactttcgttatgatttgtcattgtacacaagaacatttggtggtacattataaggttaggaaaagtctatacatactaacttttttttactaaattcttactaacactgatgtgtcatgctatgagtgcatctagattttttgtaacttccatctacttaaatcaaacggttgagatgattgttagtaaaagtttagtaagaaaaatttagtacgtgtagcattgctctaaaggttatagctataaataaaacaagttttctagcaaaagtactgtacaacaactactacttatgacgatagctaaaacgattgatggaacttatattttagaaaaagtaaaatatatgcaatgaaagttg

SEQ ID NO: 7766 - DNA, 1501 bp, Oryza sativa
taatatattgctagagggaaagggctaaaaggggaggttgtgatgtgaagttatttgttcatagtagtatattaagctacaattttaattatagggacaaactatggtttagaaaagaaagtacaacaattgagattgtctagcaagaatgtcaccaagaagacagtggcaatgtcgaggaggcgagccacgcctatggtgtggagaaggaagacaaaaggttgcataaaggcagggaccggttgcagatttgattattgtttttaagtattctaatgtcgatcctattgtttagaaattaatggtcgaatgtgagtgtacccctcaaaaatggttaaagtctcttttaagaatatagacaagactcaacatcacatgacatccagaaagaagaaaaatattaaaaggatgggatattatttattgacctttgtgatatagggcaaacaaatatttttagataaactacaaatcatatatttagtgttgtggagttatactcttttataaaaaaaaagttttattgatttcaaccgttgtcgaactttttatacgcaactttcattgcatatattttactttttctaaaatataagttccatcaatcgttttagctatcgtcataagtagtagttgttgtacagtacttttgctagaaaacttgttttatttatagctataacctttagagcaatgctacacgtactaaatttttcttactaaacttttactaacaatcatctcaaccgtttgatttaagtagatggaagttacaaaaaatctagatgcactcatagcatgacacatcagtgttagtaagaatttagtaaaaaaaagttagtatgtatagacttttcctaaccttataatgtaccaccaaatgttcttgtgtacaatgacaaatcataacgaaagtctcattaatatataccatttattatgaaaaagttttcatttgtcatcaattctattacctataggaaaggtatgaccatgctgtgttgtacacccagcgaggtaccagcacaaaggaacaggctcaccaccggccacggcggttccggtgggcattctcatctggtgtccgtgggggagagcaaccaacttcgatccgtgctccggaaaccgccgatctccaccgtccacgtaccccggccgaccaaatccaacggcgcggatcgaccgcactggacctcgtccagtgcacggcaaggtcggtttcccgtccactcgttgggttttttcacctcttcctctccagcgacagcagcagcaaacccaagcccgaacccaccacctccgcccatttccgcctcctctcgaaacctcctcctcctcttctcctcttctctcatccaatcgcgagccaccaaaccctaatccccaacacgcacacgcacacgcacacgcgcgcggtcgcgcagcagcgcgccatgggatgagccgcggcggcgcgggagctcggatccggagctagggtttcgggccgcgagtttgccca

SEQ ID NO: 7767 - DNA, 1501 bp, Oryza sativa
aacgtagcagcgctagcctttgcgcacaaatgtcgcaacgaaactacgaaagcaacatgtataaaatggaaatgaagccccgacacgattgccatgctcttcaataatacaaagcatcacatcaggatgaaacatgcatcgtacatggcatcgaatcgtgctattattcgcatttagaattgaaaccttgaaggagattggtaggatcaacacgggagattccaagaagattgtaattagctgtcctgctcgtgtcaacacgtcttactgtaagggactcctaaacaaatataaaccacaacacactgcatattatagatcgatcagagattgctggtttggtttgcttttgggtgccttcaacacgcaagtacatcagcaaacgctatcatcacaagcaaagaacaacttttcttcagtaatcagcacagcactctttccagacgcttgcctgatgcgtcgtgagctcaaagctgccagccactgtggctgttcacgggtcaagcagcagaaatcttgtaactgttgtggctaaggccgttttgagcaattgaccagtggcagtggcagtggcagttgcagttttcagttgtacaactgaaaactgtaactgtctactcatcgaaacagaagcaactccaggcaaaccactgggaatgaactcaatcttgttctgggaatgtcctatgaagtctgctacatccaagcagcatttttccagcattttccaaaaacagaagttttcaccaacatcgctatagagatgggtgctggatatatacaaaatgaaactagaatcatgaaacctgttgcgaacgatcaatggagagttctgttgctaatttatatgcacaggaagtttaggctggggggcagggcagcacctagcaacgatagaggtcgaaaagaaatgtaaatgagcagaggtacaatgttctcatgatcgctgcatcacataaagactatgctcctttttaatagctggtcctacaagtacaccatttatcgtccatatcttgtatccctggatccatcaagagaacatcatatatcaactcgtcagaaatgaaacaaggacagcgtcatgctttagagttttaaatttaaagaaaaacatgaactatattatttacatctcatgctgaatttggaaggtagtatcaaattgttttctccacaatgaaatcaaaattttagggtaggtagcctcatgttttcagtattgtactgcacatgcatgtctcaggcactaaaatcctctcctgaaactttactaaccccacctaaacataccaaaagtcttaacacctagcgcataaatatgcaatagatcggttaaaaggagctacctcaaagatgctttcactatgcataatgccatcaagaagaaaacagggaacatgacaaagagtaaaaaatgtaaacggctgtattttctatgcataacatggcagctcaagtaggtactgtaaaagtaagtgcatcaggaacaagaagattc

SEQ ID NO: 7768 - DNA, 1501 bp, Oryza sativa
gcgttggaggatgcctccatgcttgtggtcgtcaggctcgacgtccctgaggagctcgtggaggtagcgcttcttgagcttctcgccgcagaggcggttgcgatcgccggcgccggcgtgacgacgatggtacgggccgacggacacgaacttgggcgcgtacgcttcctccttgttgatggcgcgcacctgctccgggactcgccacagacggtacttcttcgtcttccaccggaacgacagcgacgatggcgggaggtcgccgccatcgtcgttgtcgtcgtggattatgttcaccctcacctccggcagctgctgctgccctgcctcgtccagaaaaaccatttctgtagtagtgtcatcaccgtttcccataatatgtatcttattgtacgtacgcagcatgctgcatgcacttagttatccaattccaagtatatataggcacgtcgtcgatcgatcgtccgaccggaatttgagatggcgtgtcgccggcggcgatcgatcggcgtgatggtggtgcatgcgacaatggcataaaataaaggaagaagcctcttctctggcctaatcgattctttttggttggcaaatggacgtatcaagcgatcagtgcaagctttgatgttctcatgcatgcatgctgatctgtatgtaagctagcccctttaatcttcttctttttttcctcttcactaatacagttagcatctcaaccttttttcctcttcactatatatatagctagctagaatcgtcaagcttttccttatgttgctacctgctcatgaagtaagctcaggttcttcttcctatattagtctatatacagatagtgcatacgtacgtaatagaaagagccctgtagatggaaaggttctttttttttcagtcgtatggacatacgtcgtttcatgatcaatgccgtcaaaaaattattttttagaaaaatatactaaaatagattaatatgtgatattttgctatataaaagtgcaagtaaatattcgactcatacaaccagaaacaaagacaataacaaatatcaaccatgaattatacgcacacctttttcatggtcatatatattggttgtttttggttcacacacatttgtaatttctagttgtgtatattaaatctaaacttgcatgcatgtttgtgaagtgatatatctcacatattgatatattttgtaaaaaaaatattactttttatgacctttttagttgacatgctttagttggcatgcgcgcataaaatagtctatgtccactcaaatgataaaaagactttcatatgtacatgggattttacatggatgttcagcaattactcatttcatctacttctggaaaagtcatttcatcttaaagaatgccctctctttttatatccatccaaataattatgatttatttaagggaacatatcatatgcacacaacattcctatgcatatactccgtgcatatcaactaacaaatgtcacagaaaattct

SEQ ID NO: 7769 - DNA, 1501 bp, Oryza sativa
aacaaatctacgcaacgggaaccaccttacatccgcccatgaccgtgggcacggctgttcgaacagttagttaacctctacagaggggtacactttacccacaagacacgaacttactccagacactggccggtgtcagaggttcgcgacaaagcctttcccaagccgacccagggatacctcatgccacatagaatgatcaaatcctcacataaacataggccattataggcgttcacaattcaaactccaaccacctcgatcggtaattcagcaaacttctcgttcttgcattaccaggaacccggtttggctccaaccgaccccgccccggcgttcccaactattggcatgcgaggtttccctgaatcgactagctacttagccagggtgtcccattccaccttgtggttgcactttgattatgttcgatgagttttccacaggaatcggtccttatatgcgaatacgggacagtgccacataggcacaacccccgcatcgcgagttttcacaattcattttattttcaaacacaccgacaccacatatcgggttttgaaggcttcacaaactcatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacacaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccggtaaccgcaactatacgcaaacaatcaaaaacctaaacaaaagaccaaaagaaagatcctatttagactaattagtagtgccattaaatagatctcaatttacggaattattggaagtggaacggagtcaatcggatgagcggttcggaagatatggattttcgaagtttaattggattttccgaaataggagaaatgatttatggaatttatagaaataatattctcaagaatattattgacagtcactgacgcgcgggaccaaaggaaatgatttgtggaattttgggaataaggaattgatttatgggacaaaggaaaaaggatttattaaatccctgaaaaagaaaaggatggagggatgtgatttagacttcctcgggcggcttgagtgcggcccaatagataagcacggcgcggccgagccaatgggctgggcgcgggcgcgaggaggcggcccatggccgggcaaggcgcggcccaagcgggcggggcgcgcgggaggagagagggggatgggtccgggtggaccgaatccaccttgcggggtcccgggtggggcccgcttgtcagtggcgcggctcaccgt

SEQ ID NO: 7770 - DNA, 1501 bp, Oryza sativa
aacttgccttgggagatgggagaatgaatacggccgcagtgggcgcgaggacgaacctgcgaggaggtcggctaaacttccaccttgggggggagatgaggtttccccggcatggttcggtcccccccatcttgcggagccgcttcttttttcgctccccctcgggctatgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccggggtagattgttcccccctgtggctcccgcccgcgccatcgtggcctcgaggagcccgctcccctaacgccccgaccgcctgcatgatggtcaggatgttggcgcgctctggatcgctgcagagggggaggacaccttgggggatgagggatgcctccacggagctgagattcagcacccgttggatcaccatcttgaagtcttcagggacccagtcccatttgaccccctggtgggtcctcgtgtagtccttggacccggtgtactcccaggcgccccgggcgcgccgctggagcggcgcgatccggcgacgaaggtaatcgccgtacaccatggcccccgtgagcccctggaatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccctgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaagacggaccgccccgggtagtgtggcgccgggtgtccctcacccagcgcgaccacctcccggctggtggcagattccggcatgaatcggcgcggcagcccagcctgcctctcgctcacgatgcgagaaggcggcagcacgctaccgtcgagcggtgcggagccccgtgccatgacgccggcggaggaggggcttgagagcgagtgagtatggcaagggtagggcgccggaaacggagagtcagagcacaagtggcaaaggcaaggggaagagtggcgagaggaaggaaacgaatctcttcctcggcgtctttatacccttgccaacgctatgcccggctcctcgcttcccgcgcc

SEQ ID NO: 7771 - DNA, 1501 bp, Oryza sativa
ttcgctcaattccacctcaaattggtttagatactgttgcttgctatttgcttggtgcatcgggttgctaacagcctaaagggatcctatgtctcgacgcaagcagctagcagcacagtgcagctctgctctgctgctctgagagattcggtcgtctgcactgccgcgtcttacttacacggggcacctcttcaacgacgacgacgacgccgccgccgtggcaccggccaccgccgagacgacgccgctttggacgctagcccgctcccactcccacagccctgccccggcggcgccgagccggcatcacggtcgcatcaccgaccgcgaacaatggtgacgacgactactcggcggcggcgtgcagcagcaggtggacaggaaggctgcctccgtgtcacccgcggccgccgccgctccgtgtcacccgccgccgccgaccagtgagagaagaagagtgagacagagtgagagagaggaagagtatgacatgtgggtctcatatttttttataaatagaatgctaactggactaccacgcgtatgtcacgtagattaaaatcaccgcggattgggtcgagggagataattcgttcggtttgcatagttgggtgtgaagaatgtctggttttgcgattcagaggggtaattcgtacgttttccttttcataatatttcaatccaaattgttttattatttctccattatctaacatatatctcgcagcaaagcgcggggcatcatctagtatatttatatgggtgtgtagcccaaatttagtaccctattcattagtaatacatgaaactctaatcagtgtctgttttcttaatttaacaatataattaattctgttataccctaacttcaaaaagttgtaaagaagtagtacttgcaaaattgtaaaatatctcatgaatgtaaactgtcgccgcgcggttttcaatttggaaaaaaacaggtttcctttagtttgcagtgtttatacttttgcgcaaatcagcggccgctttaataccactcaaagaacttgacctttaaatcagcggccgctttgttccacttgcaagtgggacaatggtagccgtaaattgatcgtacgtgcggctgaatttttttctgccgacgccatcagatgcgctgaattttgatcatcgccagaaaattaagagagaaaagatcgagttagctagcgtggaatatcgccaaggaatatatgcacgcttgcgctttaattacttgaatgcatattgtgccacacgacaactaattttctgtccagacgtactgcttttggagagaaatttcatcaaaaagcatatgccgatcatgttggactttttgctttgtttaatttcgtcgatcccttccttcactcgatcaagcttccaccgtaaaggtttcacgcgtacgtcgtgtgttggccgacgtgctggccgtggctggcatgtatgtcttgatagatgcgtttttgtgcatcgacctagcaaacagcagcta

SEQ ID NO: 7772 - DNA, 1501 bp, Oryza sativa
cgcgccgttggctgcttgtcaccgcgccgtcccggctcggtagtgcctccctcccgttccccttccccgctcaccctcgtcccctctagcttgcgtggtagctcggtagccctgccgaacgcgcgtagacgccgccccaaggaccgccgccacccggcatggccccgccgccattgccgcccacccccggaggccgcctctcatcgccggctgtcctcggtgctcctccgtcccatccggcgccggaaacggattccttgaaccccggatatgctcccaccccttttaatcgaacccccgttgctccagtgaagtttcccccttttctcgccgccggcgtgcgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccatcagccgtccatctcggccgccccttcttcctcctcccgccggtccgcgtggctgccacgtaggcgccacgtcggcaccacctcggctttgaccgagccgagccggtcagccgcctccttccttgcccccctcccgtgcacgcggtccacggtgcaccaaccggctgcgcgtgggcccgccgcatccctggtccatccggtgcacgcgcgtgaaccgcgctcacccggaaccctagagctgccctcatgcgccgctcccacggtgagccgcgccactgacaagcgggccccacccgggaccccgcaaggtggattcggtccacccggacccatccccctctctcctcccgcgcgccccgcccgcttgggccgcgccttgcccggccatgggccgcctcctcgcgcccgcgcccagcccattggctcggccgcgccgtgcttatctattgggccgcactcaagccgcccgaggaagtctaaatcacatccctccatccttttctttttcagggatttaataaatcctttttcctttgtcccataaatcaattccttattcccaaaattccacaaatcatttcctttggtcccgcgcgtcagtgactgtcaataatattcttgagaatattatttctataaattccataaatcatttctcctatttcggaaaatccaattaaacttcgaaaatccatatcttccgaaccgctcatccgattgactccgttccacttccaataattccgtaaattgagatctatttaatggcactactaattagtctaaataggatctttcttttggtcttttgtttaggtttttgattgtttgcgtatagttgcggttaccggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgtg

SEQ ID NO: 7773 - DNA, 1501 bp, Oryza sativa
aaacacgcatcgatgggacaccattggctagaaccaacacctttatgaagataggtgtcgattctgaataaaaactgacactgacggagcgtggggctcctcaccgggagaccgcgcgggcccccctttgccggttcggccgggggcgctaggtgaggttctaagccctcgatctgtggaatgtttcgcgagagagcaaatgcctaagacacgggcgatgtagacaggttcgggccgctgagaagcgtaataccctactcctgtgttctggtggatctgtgtatgaaggagttacaaagagctggagagcaatagagttcaaactctagagaccctcttcctctttctctcctctacgagctcaggtgttctcccctttttttcccttttttctcttaagtgggcaaggtcctccttttatatctcaaggggataccacatgcaccacttctacctactcttcttttgggtggggactcaccctatcttccaaaaaaaagactggcttgcgccttcgcctggaagctaaatcacagcttgtctttgagtgaggcccagcgttatcactcgcctggcaccgaggatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgttagaccagtcacaaaccggtcattcttgtctaccacgcgtcagtttagcatgccacacatcagcccttcttcctaaaatgacttccttgtaatggttgcgatgaagcctggtatgaatctagccgggactgacgtgctaactccaggagttagcacgccggctccggttagggacgagtgcctagaggctctcatcattccgacgggacggggcgaggcgtgcgaaaggctgcctgttgccacctaacccgcgatctgaccggtctgtgaccggtcacacactgtgacctgtcacggaccaaacgagtgtgctgcgctgcattaaatgcgccgtggggcgctcgtccaacccgcaataaacgcggttaggtgagcgccgctgtgctcacctaacccacacacgtggcgccaaacccacagggggtcggggcgccccagccctcggggccgaaacgggagtggcccgaccccttggggagacagagggaggggcggccacatcaccctcgggcccgacccccccgagggggtcaggccacgtgggtgaccgcggctgccccaaacctctagtcaagatacccccggtcccatgtcaccgacagtagcccccggcgttatgccagggcgatcgccctcctcgaggaaagcgctcgggcgtgacgccactccttaggcctggtgacaggtggggccggtctctacaggcgggcaggaatccagtggtcgcaaatcgcgcgcatcggcaagggaaaaccgaccgacaataa

SEQ ID NO: 7774 - DNA, 1501 bp, Oryza sativa
aattagattattgccctaagatcacgtgttttatgcttttaggttcacaaagttcacaaaaaggcaggaggcatgtgtttacacctaaatttagcacttaggattaaaataggagaatattgccaaagtttgaaaagagtcgggtttcgttcatagagctgatctgaccgctgcctgtcggccgatttgaccagcggtatatagccggtcaaactggcaaagtccgactccgagctgttttcgtcaggtctcggacttccttgctcgggaatgtatgtttcgggtttccattagtttctaacccgagttagacgtggaggaggacctgtagggggcaagaccaacccccttatatagggcaatacaatctactctcaatacaatttatccaattgaatcgatttttcaatattgcatctaatttccgtctagttttttagcctagttttgtccatctttgtcaatttgcaccgtaaatcatccgcattagttgtaagagtgcgaaatctcttcgtagatttgtctcgtaaacctttcgttcgctcacgagatgggtaatttatctttattccatctaaatcggcttcgctagccggttcaatctatcaaaacccatcttaatctagtttttactaatttgagggggttgaccactttatatcaccgtaatatgttcaggtatccgatcgtaattgtcttcctcacgagtcaacaacttctatcgctcttaaaatgaatgcaacgggccctcgtgctgctgtgcagcccatatacatgttagtccgcaacgggattcaggcttcacgtgctacccatttagttggggaaaaagtacaccgaaggtccctcaacttgtcatcgggatacaaaaacgttcttgaaccgcaaaatcagatatgcggagtcccttaactatacaaaaccgatcacccgaggtccttcggtggttttaaacctggttttgttctacgtggcggctgcgtcagcgcgggacccacatgggccccacatgtcagactggccacgtcatctctctctttcctatcttctctccctttctcttctccatcactttcttgtcaaggactctgggcaggccgacggccgaccgacgggtgcggaagaggccggcggggtgaggcgggagaggaggaggtccggttgccggcgacggctggctctgtggcggctgctttggccgagggtgaaaaggagggaggcagtgctcttgcgagctcaccggcgtggacccggcggcggcgaggtgagcgaggatacgcggggtggtgggggcagagctgtgggtggagaggtgacggaggcggcgggcggcggtcgacgtcgaccatctggaggtggaggcgccgtgccgttcctggatctcgaccaccacgccgagcacctcgtcacggccatctggattgcgtgttgcaggagacgtggtgtccagggacgtgcgcctctccgccttctccgcagcccgccgctgttgctgtcggag

SEQ ID NO: 7775 - DNA, 906 bp, Oryza sativa
cccttggggagacagagggaggggcggccacatcaccctcgggcccgacccccccgagggggtcaggccacgtgggtgaccgcggctgccccaaacctctagtcaagatacccccggtcccatgtcaccgacagacacctattgtactagtgttggatttttttttggaagaaccgatacccatatttatattataggtgccggttttataaaagagaatcggctgacatcgaagtttagattgagggggagtgttagatcataacatattggtgtacttatctatgtgtgttagttgagatacccggtagtttagataagctaatcatcccatgaactccctcctttcttaaatgtttggcgccgttgacttttttaaacatgtttgaccattcgtcttattcaaaaacttttgtgaaatatgtaaaactatatgtatacattgaagtatatttaacaataaatcaaatgataggaaaagaattaataattacttaatttttttgaataagacgaacaatcaaacatgttttaaaaagtcagcggcgtcaaacattttgggatggagggagtaaataggatccgggttatccatgcaacacacatatatatgcctgtacttctcccgtgcgatttatgcacaacaaaattaacatgtagcagtagcgtcacaccgatcgacgttaactcagattagattttctttcaatgtgatgtggggatttggggatttcaatttggtttgggatgtttggggaaatcaatatgcaagcagcaaaaacattgaaaaaaaggaaaaaaatatctgtagtcccgctaaagattgcagtgtgtcacacacgttatcaatgtcgaactggacgatgacatggatcaagagctgatcgaaatccgttcttgatcagg

SEQ ID NO: 7776 - DNA, 314 bp, Oryza sativa
cccacagacaccgctgttgatgccccgcctatcgcggacgccccacccaccgccgcccctccccgctcgagtccatccctcggccagatcaacgccaccgccgtcgccgtcgcacgcattcctccccgtccaccccgccgccaacgcccaacccagcaccgcccctcccctccatcctgccgcctgttcgccgtcgcacgctgcatcaccaggatctgcatcgccgtcgcacgccttcctccatgacaatctgtgcttgcgacattcatcaacaacatgttgatttgtttgtctgtctgctcaatgatgtacag

SEQ ID NO: 7777 - DNA, 1501 bp, Oryza sativa
tgtctaattatcgtgtcagtcacttcgcttatagatatgcttatcatgcaaatgctaaaaaaataaatctttatctttatcttttatttatactattataaaattgaatatgtttttgctagtactctggtacgttatccttgtttgagtcggtttttaatgttgttcgcttttggaaatatggattcgtgtttgagtcggtttttatgtttgttcacttttgaaagtataaaaggagtcgtataagaaatatctttaagaaaactcacatgctaacttgagacgaaagttggactcctaattgcagctcataattttctaaaaaaagattaagcgaatttctagtgtaaattttatcttagctaaactgtataacaataataagattaaaatagccttcacccattgcaacgcacgggtattttttatagttaaaaattaaattttggtttataggtataaatataaacgaagcgatgggatttaaaaaattaacttgttgcaaaccggagttggtgaatcgtccttttgcaactttggtcatttggtgcatgagcgcctcgttttacttgctcctctttatgcttacatcctacctaatagctatcatgatgaatttgttgaatgccttagaacagaggaacaggaggttcccatgtcaagcaaaagggaatgctttaggcagatcatggagataaagactctatagaagcagcacacgtgaacgattcttgcgtaagtactccgccataatttctgacgaagatcggtttactaataggaacggacctttgtagggtaagtgtgcgtgtagatataagtgctcgcgtccatactacttcctctgtcttaaaaatataagtattttttatagacacgagtatattaataaaatatgtagaaatgattggataaggattgtgattggtggagaagataaagtatgtcaagacaacaacagttgtaaatgtgatctggacataagcatccactcaaaatcccttatatttttgggacggatggattagtatttatcaaaaatagaaaagaaaaacagcaagtaattagtaaggatcagctaaaaagatcaagaaaagcaatagtacgtgattagtaaagatttgctcattaaaaaaaagtataggtacgattacggtgaagaagcggagaaggtgattataaaaaagaagaagaaaggggcgcatcaccttcacgttccgagatgtggcacgaatcccgaggactgcagcccgagatcgggcgcgtgtcccgaggcagcatcggcgccatcaaccaacaacaaagatagtactagtataacaactaatcccaactcgcggagcagcgagatgagatgacactcttcttcacttgctgaacctgatagcgacattattcttcctctcaccttgccccttcacactcgtcactcgctccaaccagccgcctgagctctctcgccgtacgtcggcgctccatcggccggaattatcggcggcga

SEQ ID NO: 7778 - DNA, 1501 bp, Oryza sativa
tttccattgccaattcgccgttgttcttgcagctacctctggtgcagatcagcgagacgtgacgtccgagaggatcaacggcacgccgaacagcaggaggaagaaccaggtcgatcaatcagtctcagttgtgaccaaacgccggctataatgcagcgcaaagaacagcaacgacgtgccagggatgcccaactcgttgggccaagcacccagcccggtcgcctgagcaagacgctgatgtcagagtactccaacactgaacaaattcaagtaattgagttttgttactctggtgttcaagtaattgagttttgttactctggtgtgtttggttcacgtttaaattggaacgatgtgatgaaaaagttaaaaatttgtgtgtagaaaaattttgatgtgatggaaaagttggaagtttgaagcaaaagttatgaactaaaccaggcctctgatgatagagagttaagggccggaagaaaattattaattgagcggcgaagtgagcgtagcttaactgattatattttttaggtgacctatctgggttcaagtgttagacttgatactgatgcttatatagttatatttacgactaattattcttttagtggtaagtgacatacccgtcgactatgagatacctataatgactttattaatctcagtatatatatcagttcagtttttttaaggtgattatatagataagatacatgcgtgtatattcgtagggacgagtgtgtgcgtgttgtgagcacatgcgcatgtgttgtactatgtttaaaaaaatattaattgtatttataggatttaaatttgtcccaaaataattgtcacaatagagtactcgtaatctcattaatcatttctcatttaaaatatttctaattttatcctcaaccacccatccactcttacctacaaatcatttaataaaagacgtcacaatcttttttcttaaattttaatatatgctaaactatttagaattataattattttgggatgcatgtagtaagtctacttttaacatccgactcgtttggaagtaactaaaaaccttcaaaacactacactactttgtcattagaaatttttaaatgctcataataaagttgggtggcacaaacctctcttcataataatttttactaaatgcttaacaaaatcctatctcctcctgcctgtcaccggtcaccgaccgatggtccccgcaatccaatccagccagccagcctcgcatccccccctcccccactcgccggcgaccgctgccgtcgccgtcgtccacctcattccccacctcgtgcctcgtctcccttccaagccaagccaaaaacccctccacgagccgcgccgtacgccatcgccaaccaccactccactactacttccccccacactcactcactccactcccaccacagcaaccgcttgctttgcttcgcccatctgagctataattagctcgaggagagagccctaacccgccgcgccatgg

SEQ ID NO: 7779 - DNA, 1501 bp, Oryza sativa
cagatgtactatttcatcccaatatatacttacattagttttagtagcatcaatctttgaaatttttaggattatatgatatctttcttaagcaataatatatatccatggcaagagtactgcatgccacattgctacactgaacatgcttaatcagcaaaagaaaacctgtagcaccgcacgatatccacaaaatccatcgaactaattaaacaaatatacacggacaggaacggctcaacaattcaacggatcactgatgaaaggattgatgctctagctgctacacatggccaaatggtctttctttacaacagcagctagcggaggagtgttgtttgtgtgtagtgtttgtgtggatggaaatggagctactagtcctacatggataaactccgcacgtcagtcgccctggtggtcgtcgctgcatgcgctttctgcactttttttctgaactttttgcttacaaaaccttgcgctttttgcccttttccccgacgagttgggcggttatggcgagggttgggtttctggacgcaagttggcagcggtgtagcacgcaggattgattgcacgttcgttgcagcattgagaatctgctggctttcgcataccagcggccggacgtgtacgacgccggttttgggctcgagaccaaaaacgggtggtggcgtccttgcctctattgggctctgacgaatgctatgtttatccggatgaggtagttagcctactagtagtagaagaatatttgtttccgttttaaggcttattgtttgattaatcgccgatcgagattgtcatagtggagtgctactctacgagttgatgatgggccgaccaacgagaattgcttactccctcaatactaaaaaagaataaaactatttttacacctttcgaccaagcataactttttttatttaatttattcaattattttttttcttcttaataaactaatcataactattttttatttaatttattaattttcttctaaagcaaccataacattttacatccactttcttgatccacatgaaaatattatgctgatatgttttttctttagaaacatagtataaatacaggcgctcacagagaatctattacgctcacttggttctgtgctggcatgttgaccttcattttctgtgaaactctggatgcagaaacatttattcagtttaaggttgcccattccattccagagcgagtgcgacctgtgcacgccgtgaccaccaatcaggatagacttccttccacggctgcacctctcgcccactggaccaaaccaaaccaaaaccattgccacccccacaaccttccacgtctcgtcacaagccgcttacaaatactcgcgttccaaaccaccatttcccaccacaaacacctccatcaccatcaccacggcaccaccacctccaaattccaatgtgtacgagcaaactagaggagatcaccggcgagtggccgccgccggcattgcaggccgcct

SEQ ID NO: 7780 - DNA, 1501 bp, Oryza sativa
ccacatcagcgccacgtagaataccagaggggatgtgtcgatttgggacctagatgatacactttggcaagttttaggacatggatatgtattttgagagtttagagatatatataacacaaccctacaaatttaagaactgccaatacattttactcttttttttttcctgaaatgtcaccgggggagctcgcataattaagtacatatgatgcatcaggagctagtcagtgaaacaagagaaaggggtaactcggcagcattcagatttttcagtatcactagcttaattgtagtgattaaacaactacatatacagaacattaacagttaattttataattcataagttcatcaacatatattcctagtgtgataaactcatctccatgcattattacgtccacattgcaaatactaatatttccgtccttagtccttacaaggtcaactaaacatcaaccacatgtaagattattattcagagttatctcaccatttcgcacgatggtgaaaacatactatccatatacactccaatcaatgaatgagtgaaacaacttgatgggatgactctctcagcattcagatttttcagtatgatatatcactacctagcttagtggtaatggcctactagtgatccaaccactagtacaatatgcagacaaattcagagctagagattgtggacttaatgccttgggcctatcacatcttgcatcgcttgcacagtatgggaaaagtctatgcgatctacccatatactactaactgaaataatgctcggtgacgcaggcgcagtttgagtgaattgaaatccatggcggctggctatacctttctgcactacatttgcaatgcgctgcatacgtagaactgtaatgcagagattactgaatttccaggcacgcacgcgcgtgcaattgttcattcagaaagggatttttaaagtggatgaatcgatcgagagtgacccacttcgccgctgcgatggcaacgtacggcgatagccaaggtgatgcatggcatctggccatggatgccagctgcagatgcgacgcccacgtactacgtctgaaattataccaatgccacagaaatattgattaaaaaatggtttcagaagattgttcgtcgactgattgattgccctgatggcaattttatatggttaatatgatacgattcggacattcagttagttgcgtttgcatgcatgagtgacactacatacgccgctatcttcagagaggcacagagagcttttttgactcttgctacaacatgatctctccaccgtttagtgctctggtttttggattcatccatgtcgtgcactacgtacattaatcaattgtgcataattcaaatcaatcgacatcgttcatgtgcttcagcttcagctataaataccgcatcatacatgtgatcactcactcactctcacacacactctcatcttcttcatcgcaagctagtaagagtgaatcgaagatga

SEQ ID NO: 7781 - DNA, 1501 bp, Oryza sativa
tatataaatgtttttttaaaaaaaaacatacccctctgtcccataatatagtaacctagtacctgatatgatacttcatgatacaatgaatctggatagaaactatatccaaatttattgtactatgaagtgtcctatctggtactatattgctatattgttggacggatggagtattgtctagaagtttggggaacgtgcgcgcgaaaaacaggtgagttgaagttggaaaagtggacttaagaaaacagcctaaaagacatgcaagagagggagtccacttttacatgtctgggctcatctggtgaatatgaagattatgttggcgtacgtaaaacgagaaacttattaactagcacatgactaattaagttttaattattataaatttaacaagtcaatatatttaatattttaaagcaacttttatataaaaggttttcgtaaaaaacattgttcagtaatttgaaaaacgtgttaaccaaaaataaaatctaagtcttaacgtagaaaagatgtgcctccgtttacacgattgaagaagcactttcacaatccacggtcgatgacacgccaatcacagtggcaatatgacagtatgtctatggcacggcagcgcatttactcctcgaagtaaattcagatttggggcaagtcaggctaggttattttcaaattattcatcggattgttaaacagatattatttacttcacgcttcaagaaatacattttcacgagtaaattgaatcagtagtataagaactaccatgggttgcgatttagtgcaacaacttaaaaaatatatagaccggtacataaacttagcaattaagtgcattttggtaaaaaacgttgttacatacatatgattcaacctattttgtttgttctattataattattggtgatgagtacaattgaatatatttgagtagtagaatcgttcggaaactatgttacaacaatttttatgcacttagttttaacgatattttcggtttcgaatcgacatgttatttattattgtaagcaagcaaatacaatacatctagaccattattatttgacaatcattatccttattagattattggcaacgacgatttttttttactacgtggcttaaaaggtgtggtgtctaatattgtttttttaaaccagaatgcacgtactaaccagaataatcatttttcaagttgttacactagatcgcacccacctactaagtttatgtaccgtggacgcaatttactctatattttctcacatgaagaattattgtgttgcttattattattgtgttgcttattaaatctatctattaggtttatttaccaaaatatttaatttatatttataattaaatagataatccgtaaccagaatttgcttagtaatgtagtatttgaaactaagcctaagtttgttaaaatggagtaaatgcagcgaacccaccctgctttatattaactcagcctactgcacccacctgcacagtg

SEQ ID NO: 7782 - DNA, 1501 bp, Oryza sativa
ggacgttgatgggggagacgacgtcggcgccgccgtagaaagcctccctggcgatgagcacgttgaccgccgccgtcgggtggaaggcgtcccagaacacgtagcggtcgcggccgtcgcacggcggcatgaacgggaggcacgtcacctggccggcgttcctcccgatgccgcagcatccgcggtccaccacggcgaacccgtgcgccgccgggtcgccgaggatggccttgaacacgccgtagttgtccaggaacaccaggctcgcgccggggaggccgccgccgtcgaggcggcccagcatcgccctcacgttggcgttgaacggcaccaccagcgcgtccacctccggcgagcaccggctctccacgctctgcgccagcacgttcgggatgcaccccatcgaccccactccggccaccacaaacttcctcgccccggccttgtacagcctctgcatccattattgaggacattgataagctcgaagatgatcgatcaatggcggcggcggctaattacgtacggtgagctgggcggcgtagcggtcggcgaggaggtcggcgaactggcgcggggtgtagcggcggcgggtgttgtagttgggcatgaggtagttgttgaggtagtcgttgctgcccagcccgacgaagaggatggaccgcgccaccatggacgccgccgcctccttgccgccgacggcgccggcgatctgctccaccgtggcctcgaagttgtcgatctgctggttgaacggaatccgtcccacctgcatttgcaatcaaacaacatcagttcttgatcgatcatttccttgcatgaatgatcaatccatggatcgagaggaggattgattgattggttgtgatttacgaagttcccgccgctttcgtcgaggatgccggcggcggcggaggcgaagttgacgccctgaagaagctgctgcacatgcccggacgcttgggagtatggtggcaccagtggcagcccaagcagctcagctgcaattagctcagtcagttaccattttgttctatattatgatgttttgagtttatcttaagtcaaactatttaccacttgacaaaatctatctatctatctatctattatatactaaaaatccattaaatttcctacaaacactcctaaaccgccatgtggcttatacaaacgctcttataccgctatgtggcgctctaacaaattatagaaattctaaggaaaaaataaaaatccgaccatcgattttcacttaatacggtggacccaccatttcacaccattagatatctatcttgtaacaaggaaaaaaaattcacaaaacccatccgtatcccctccatcacgtacataccgtacgtacgttccccaccttctctctctttctttccatttatttataggtagcaaattttatattaaaatattaatattaaataattagaatttcttataatatatttgattttaattattccatgtgttggagtgtgtgtgt

SEQ ID NO: 7783 - DNA, 1501 bp, Oryza sativa
tcagcatttggaagcgaaacgcaacactgtgcaggtgggtgcagtaggctgagttaatataaagcagggtgggttcgctgcatttactccattttaacaaacttaggcttagtttcaaatactacattactaagcaaattctggttacggattatctatttaattataaatataaattaaatattttggtaaataaacctaatagatagatttaataagcaacacaataataataagcaacacaataattcttcatgtgagaaaatatagagtaaattgcgtccacggtacataaacttagtaggtgggtgcgatctagtgtaacaacttgaaaaatgattattctggttagtacgtgcattctggtttaaaaaaacaatattagacaccacaccttttaagccacgtagtaaaaaaaaatcgtcgttgccaataatctaataaggataatgattgtcaaataataatggtctagatgtattgtatttgcttgcttacaataataaataacatgtcgattcgaaaccgaaaatatcgttaaaactaagtgcataaaaattgttgtaacatagtttccgaacgattctactactcaaatatattcaattgtactcatcaccaataattataatagaacaaacaaaataggttgaatcatatgtatgtaacaacgttttttaccaaaatgcacttaattgctaagtttatgtaccggtctatatattttttaagttgttgcactaaatcgcaacccatggtagttcttatactactgattcaatttactcgtgaaaatgtatttcttgaagcgtgaagtaaataatatctgtttaacaatccgatgaataatttgaaaataacctagcctgacttgccccaaatctgaatttacttcgaggagtaaatgcgctgccgtgccatagacatactgtcatattgccactgtgattggcgtgtcatcgaccgtggattgtgaaagtgcttcttcaatcgtgtaaacggaggcacatcttttctacgttaagacttagattttatttttggttaacacgtttttcaaattactgaacaatgttttttacgaaaaccttttatataaaagttgctttaaaatattaaatatattgacttgttaaatttataataattaaaacttaattagtcatgtgctagttaataagtttctcgttttacgtacgccaacataatcttcatattcaccagatgagcccagacatgtaaaagtggactccctctcttgcatgtcttttaggctgttttcttaagtccacttttccaacttcaactcacctgtttttcgcgcgcacgttccccaaacttctagacaatactccatccgtccaacaatatagcaatatagtaccagataggacacttcatagtacaataaatttggatatagtttctatccagattcattgtatcatgaagtatcatatcaggtactaggttactatattatgggacagaggggtatgtt

SEQ ID NO: 7784 - DNA, 1501 bp, Oryza sativa
tggaggggcggcgcggccggcgcctctccggctaggggtggaggcgtggtgggaaggcgatgggcggcggcgcgcagtggggacggcggcgacgcgggtggagaggagaggggcgctggcgcagtgtggagacggctgctggtggaggggcggcgcggaggagaggcgaggggagggtgcggggcggcgatggaggcgcgcggaggagggggcgcgggttgcggggcgacatggctttttacgcttttttgttccgcatcgcgtgtacctcttttaaattttcgtcgctccaaactagtctacgttactacgttggatcgcatgtctactttggcttcaccatcactaatccagattttttaagtagtagagattcagtgccatgaaaaaaatacattccatctagcaagcaatattaaggccttgtttagttgggaaacaaattaggtttggttgtcacatcggatatacaagcacacatttgaagtattaaatgtactctaataaaaaaacaaattacagattccgcttagaaactgtgagataaatttattaagcctaattaatccgtcattagagtttattgtagcaccacattgtcaaatcatggcgcaagtaggcttaaaagattcgtctcgcaatttacacgtaaactgtgtaattggtttttttccacatttaatactccatgcatgtgtccaaacattcgatacgataggtgaaaaggttttgttttgggaactaaacaaggcctaagagcatctccaacagcctctccaaatcgaactctccaaacacccatatagccaactctctatctgatttagctagtcaaactatatacttactccaacagaatctttattaatcctctccaaaataaaatcggacccacatgtgagtctctctctcctcttcttcctctctccccccttctttctctttccttcttttcccccttccttcccgtcgaggcggccgacgcatggcgcggtggtgcggtggcgcggggaggcgggaggcggtgacggcgacaacggtttggggggcgcggcggtggagctcagggcggggatggcgatggtggcagcggcttgcgacgacgacctcgacgacgaccccgacgatgacctcgacaacgacgacaacgcccccgacgacctcgcgaggagtacagttgctgcgggccaccgttggcgagacgttttgactggccaaatctagctagccagccaacgattttggtctgctggatggcttggccatccggttagccaatctgttggacctccttttttggttgaataaccaaaatttggcttggagaggctgatagagaggttgttagagatgctctaacatctgagagctcgacatgcatttatatcatgtcaccagccaaagcaatcacagattcataccttgatataaactcctaagctactacgtaccattagtccaacacgtacgtaccactgagctcgagagctagtcgaaatgg

SEQ ID NO: 7785 - DNA, 1501 bp, Oryza sativa
gcgttctgcaggtccgccaccatcatgaagctcggcttctccggccacgccgccaccatgcgcctcacgctcgcctcgtcgcccgacgccgccacggcgcggttcagcagccacgccgcccagcccagccctttgtcgaggagctcgccggcggtggccttcgcgacggcgcccaccaccgtgttgcccatgtactcttgtggcacctccttgacccgtgctcgcaatcccacggaaaggccatagctcgtctccatctccggcgcgaggcggcgggctcggcacacagctcgccaggtgtgcgcgagcaccgactggagcgaggatatggtggccgtggcggcggcggcggccatctcggcgttcgccttctccttcagcgtcctcacgctctccgccgagaaatggaggaagcactcctccaccggcgtgtacacaggccgccggaccatgtcctccagcttggcgaagggtagagggatcggcattgggatgccgtccacgaaccatctgtcgaacaccggcggcggcgtggagagctcgaggtcggcgctgtcatcgctgcggcggctgatctccgaccaggtgcggaacaagtgccagaaggtgaacccgtcggcgacgccgtggttgagcgacatggcgacgaacatgccgtcggcgagctcggtgacctgcgccgccaggacagggcgggactccacggcggcgtccgtgccaagcatgccgttgagcgggaagaaggaccacaccacccttgggacgtagagcgagtcggcgatgtcggcgacggtgacgccgggcgccacggcgtggacgaactccgccccctcgccgttgcagcggagcgagatggagatggtcggaacaccaccaggcgacgccgtctcggcgatggcgaggcggccggccagcgggtagaagcgggccagtgcgcgagcgaacgacgagacaaggtgttcgacgacgtgctcaactccgccgggaggcttgggcaggacgacgcccttctggacgtagtcgacggtgatcatctggagatccaatggcgtgaggtggtgcaccgtctcgtggtccggcagctcgccagcgtgctccgccgccggtcggaccatgcgccgcgacatgatgtggacgccgccttccatttcgactagctctcgagctcagtggtacgtacgtgttggactaatggtacgtagtagcttaggagtttatatcaaggtatgaatctgtgattgctttggctggtgacatgatataaatgcatgtcgagctctcagatgttagagcatctctaacaacctctctatcagcctctccaagccaaattttggttattcaaccaaaaaaggaggtccaacagattggctaaccggatggccaagccatccagcagaccaaaatcgttggctggctagctagatttggccagtcaaaacgtctcgccaacggtggcccgcagcaactgtactcctcgcgaggtcgtcgggggcgttgt

SEQ ID NO: 7786 - DNA, 422 bp, Oryza sativa
gggagtggcggcgatagaaggagtgaacggccggcgtcagtggtgggagcgagcggatccaccgtccccgcccgcgtgagtggcggtggcgcacggatccgtcgtccccatcctcaggagcgacgggcgacaagcgatgggaatggatggatccactgtccccaccctaggaagcgatggtggcgcgtggatccgccgtccccgctctagccaggggcggagctagaacgaaacggaggtatagctgattcggttttaacgcttaatttactctattttagatcgagtttaagctgattcgggtgtctatgtttgtattgaggggggtgcacacatgataaaaataggtgaggtatagctaaatttttttcttggccggtttcctagacactcctctaatatactatgcctccgcccctagc

SEQ ID NO: 7787 - DNA, 1501 bp, Oryza sativa
ctgtttagacagcaacatagcgtgtacgcctcatttattaggctatcatgtatgccaattaggtcaatgaacaataaacctatacatatttgtgacttcataaggagtttattttttcaattatcattgaaaaaaactctcattcatctgtttttaacactggctcgtgaatataaatgctcaatcgcacaaggcttcatgctaacaatatctccacatgcatacaactttatatgtccattttagttttgcaccaacaatctaacacgcctctcttcttagttcttaggaaatactacttggaaaaaaggcacgggctacaaatacaaaataggtgtattctagccatatgcatcaagcaatcctagcaaactccatattgcatccagtgttacgtgtccgttcgttcgtttgcagttggagacaaaatacgccttcgaattcacttcgcgcaagaaaactgaaatacgcctctctccctcatacacgtattacaaacaccgcaaccgcaaaatacgcctaggtgttccctctataaagcggagaaggcaaagacacgagctctctcttccaaccccacacaaagcggcgcctccgcacccgtgtgtaaagaaaaaaaaatcggaggcgaaaacctctcaaaccctaatcccctcgtcccccccatggcggagtcggacgcggcggcgccgccgccggaggtagtcgcccccgtggaggagcagacggcccccgcggtcggcgcatccacgctggaagaggccgagcccgccgcggccgcggccccggccgccgagggcgagggcgagcacaagaggagctcgaggaggtcgacgccgcccccgacgcgaacggcggcggcgaggacgccaagcggccccgcgtggaaggcgacggcgaaggtggatcttctccctccttccccgcgtctgtttgcgcatagggttttgcatctcagaggggatgatgcttgtgtgttttctaattcattcggtgcttgaataatcctcgaagggtttatgctccgtgtgatctgattgtgttctctctttgaatcaggtgtcgtgcagagcaacgagtcctccgcgaaggtcgatgagccggtagctacagagaacagtgacgctgcccctgctgaggcatctgttgatgctgtgaatggcaaggttcctcctaccgaggattcgcagatgggctctggggagaagcctgcagcagaagcagcagtgactgaagccccgccgcaagaaggtggtggcgcaccaggacaggagacgtctcggataatcaacgtgcccaataacaaggtataattactggcatggggcaaatatggcaacctgtttggtttcatgtagaaatctgcagaacattctgtaactatttatacatggcctctatgaagctgcgtaaaattcaggacgaaaaccacggaaagttattaatgagtgcagacattcggacttgtggtttgctaatgctagccatgaaaattcatgca

SEQ ID NO: 7788 - DNA, 1501 bp, Oryza sativa
gcgccacggacgcgtacacagcgaggtggaggtacatggtggcgtgctcgagggcatccggccggatagtgaacaagagcagtgggaaattgacgagttggtcgacgatggcgagcacggagaaggagaggaggaggtagctaccgtgcggccgccgacgccctccacgaccccaacgtcgacatgctagatgtcggcctcagcggcccgcagctctacgactcggactcacctgctgccaccggcgtgtcccctgccccggcggcggcgaccaccacgatcgtcgtatcacatgccaagggctccaattctagcgctgcctgcaagtgtgtgaagaggaacgataccatatggggcgcgtggttcttcttcacccactacttcaagccggtcatgttggctgacaagaacggcaaggcgaaggcccccatcgccgtgggaacggtaataatgctacactagatgcttttctagtgcagcacgacatggagtacatgtatatgtgggtgttcaaggagcggccagagaatgccctggggaagatgtacatgtggggaagatgtcgtcgccgccgctcctcctcatctcatccccgccggcccactccgaaacccggatcggcgggaggagggatccctccccggacgccgccgctcctcgtccatcttcttggttcgcaacgaggaggagcccgcgggctgggatgatccgaaggcgccggcgccggaggatgaggaggaggagtcggccttcatggtgtcgagcttgcgggagtggcgcttgatggcggcacggagggagttgtaggtggcggatgccgccgccggacgaggaaggagtcgccggcttggaggacggggagggatctcgatttggttgcggtgggcggcgtggatggaggtggcggtggccatcgctccctgcggcggcggccatgccgccgcgccggtcgccggtctcgccgcgccaccccgcccctcttggccgcatggccgccttgccgccgcgcctggccgcttgtctgccacaccgcctgtcctctctctgaaagggtaagagcgacatttttcctacccggacccacatgtcagacctatcaaacggttaaacccacacagaatagcgacggaatggtgcggagggcgcgacaaagttcaacgatggcacagagggaggctcgaattttttagtggcacagaggcagacatcatcttttttaatggcatacaggtaaaaacctctatttaatcaataccacttctattacatgcataaactgcacagttcgattcatagtaaagatttgaatagttcatcaataccacttctagcatatgtatatactgcacggttcgattcatagtaacatgagaaagtttgtcaaccagttgccagccaatggcgcaaacaagtatgatctctaactgcgtgttggtagcagcaggcaaaacatcttttcacattgcaaccaaccagcggcaagcatagcacaaacaacttg

SEQ ID NO: 7789 - DNA, 1501 bp, Oryza sativa
atatagtcaaattagggtgattgatagcatatcaaatctaacttttaaagcagtaccaaccatccacctcagttagtttctatagcattaaatatgatgtcatgtaggaaaaaaaccgatgtgataaaagagttaataagaagagaaagaaaaagatgaaaaaaaatcatttctcatataaaaaccgactctacgtaggaaccaagaatggaaacgatggaataggtggatgaaatgagagagacgagaggtgattagataagaatttttttttttgaaaaaaacaaccaactataggtacataatttctatatatatagtatctatatgatatggtgagtatggaaactactttaatattttctagattggaattgtccttataactatgttcgatttcatacaattttaattctgcatttcaaaaatattatagtagggtctgattgctgggatctttagctcctcaaatactagaatctcaaaataggagcccaaccataaaatacactggtcctatttggcagagctctagatctcagatctatgataaatttgatgtttatatgttaaattatagtagtttggtagggctccaaactccaactcagagctctaaacttccactccagagggagctggcttctgtgggagttggagacctgctgaaaagggagttggagacctgctgaaaagtgtttgttaggttttaagctccagatctaaaatttaaaaaaaagaaaaaaaaatcctcaatcgcaacgtccgcagcagctgcgttgtcatcgtcctcgtgtgcggctggccgccgcctgccacgcgccgcctgccacagtccacacgccggctgcgcgctgtccccaacgctggccgccgcctgccatagtccgcacgccggccgcgcaccactgccgcacgccgcccatcacgtgccgcccgccgtgcgccgttgaccccgccacccgccgtgcaccacccgccgcccaccgtcgacctcgccgccaaccgtgtgctgaccgccggctgccgtcgagcccgttggattggagagtgagggtgacgggagggagagagagagaggtgagagatgagttagaggtagttgagtggtattttttataaatatgtaaaaaatttaaagggtagtgggtcttttgggttggagtggagctgtggagcaacaaaaacccagctccacccccgtagtacaaattcgtgtagcagctctgtcaactccgctcccaaaaacagaggatttggactgtttagcatatctcctgctacaggtaagttggagttgggagctagagctgtgccaaacggagcctaaaatttaaattttcatgcaaaagaaaaacaaattggatctggagccatgcccaagagcgccactatatgtatatgctcaaggtgttgtgtgtccagtagaggcgtacggattacaagagaagagagcagcgtgacatgggaagcaatgaccaccggaacgtagctctcgccg

SEQ ID NO: 7790 - DNA, 976 bp, Oryza sativa
caaatggcggatcccggtgacgccaccatgtgcgctgacctccccttccccatccatctccactctccctcccccatcctctccacgtccgcgcgctgctatgcgtgtcgccgctcactgtccgtccccacgcaccgccacccatcgcccatccccgcgccgaccatccccgcgcaccgccatccatcgcccatccccgagccgaccatccccgcgcgctgccgcccgtccactgcccgttccagcactgcagtgcatgccttttgcccaagagagagaaaaagagaggaaaaggggaaaggaggtatgataggtgggtcctgttgtgaaacaaatctcttggagataagtttcttgtaggccaatccgaaccggagtagagataagatctatcttctcctaagacccctatatatacaggggcagggtgtgacatctaatggctaatggctggcttatactacagatgagatctataatgaagagagagctccatcctatatctgcgttcattgtctacttctgcaatattcttgatggcaacgggatgggcgcgggtgttctacatcatctcatgtctctactgctgtggaagggacagggaacggatccggtgatccgctaataggcgcgttggtttacaacacgttatcagcagctcttccatcaccggtttgtcgttccaatctgtttttattattagattaatttctattcacagattgatctgttccggtattgcttttgtttgcatataccgctggtgatcgagatgccggtgtgtcagccgcacgacgagatgtattgatcgctacaaccatgcatggatcggcatgcatgcatgtcgttggacaagtggatggatggatttaatatgcatcattgtgtcgatatacatatctaactccttgatgctaatctaattggatttgtttgttttgcatgtacgccggccggacatgtggccgcggcaaca

SEQ ID NO: 7791 - DNA, 1501 bp, Oryza sativa
acacttgccgatcctgcaccgtccttttctccatctccaacgccttcccccttctgtccatgtcgctgcctctctctagatctctgaccgaggctagagtagctactatctccgtcccaaaataagtatagctgtggatatctgtacctaacgtttgaccgtccgtcttatttgaaaaatttgtgaaaaaattaaaaatatttagtcacacataaagtactattcatattttatcatctaatagcaatgaaaatactaatcataaaaaaattttaaataagacgacgggtcaatcgttgaacacgtgaatagtcaaaactgcacttatttgggacagagggagtacctagctagccacctgcacacatatttcatgcaggtcggccatagatcgaacaggagagagagagagatcgggcggggaagttgtgatccggttatgacatgtctaatcgccagcttccaggtcttgttgtgaaatgttcggcgaggaaagctacgtgtatttataaaagatcaattttagtcagggtgtgtttagttcacgttaaaataaaagtttagttaaaattgaaacgatgacggaaaagttgaaagtttgtgtgtagaaaagttttaatgtgatggaaaagttgaaagtttgaagaaaaaatctacaactaaacacggccaaaggtgtaaagcataaaaagatttcttgtacagtatatatgtcctaaaattttagccgatcacttctatatggccctactattttctcacttcctttatattactactgaatttcggtttaatcccttacatgccaattccgttacttgacagttgatcatttaatgcttatgatttatgaaaatgtctattttacccttagacatagaagaaacataaaatttgtgtataacattattggaagtgtagaaaacttactacatgaaactattatattgatgagtttgtgtgaggtacgagtattattcatgccaatttatttttagataatgataaaatttagtaatatttatttttattaattaaaagagtatattagcgtatttcggtgatggtagtataacaaatttgccacctgttgtatgtattatctaaaaaaagttaaactaaactaattattatgtttactgtctaaagatacactacacttactatttttaatatatattaaattttgtatgtataatacttcctcaaacaactactttttggtagactcacaaatttctatgttccttccatatccgagggtaaaactaaattttttacggtcaactaaatggtcaattaacaaaaaaaagtatgtgtgtgtgtgtgtctctctctctctctctctctctctatatatatatatatatatatatatatatatatatatatatgcttcggacaaaaaacactgttcaaaaacactatttagtttactgtttaaattactgttcaatactgttcacttcgagagatattttaactttaggatctttgcagg

SEQ ID NO: 7792 - DNA, 608 bp, Oryza sativa
ccatcccttccacctcccagcgcgctgccgttcatgtcgtctgcctgcccgtccatgggcgccgccacccaccgcccctccccttccatctccatctcctccccttccccatcgacctctccctcccccatccctccacctccccgcacgtgaccgcgcacccgtccacgagcgccacaatgtgcccactgcctgttcccgtgccgactgcccgcccgtccccgcgtaccaccgtcggccaaccacccgtctccgtgccgccgtgcactccttgcaactaagagaaagagaaagagagaggaagaggggaagatgaggtatgacaggtgggtcccaacatttttttaaaaaaaaagaagtgctggttggattgccacacgcacaccacgtagggcaaaactattctagattgagccgagtgtggtaattcgtccagtattaaaagttcaaggttaaaatttggtcgaccgcgatagttctgcgagtaattcataatttttccttactagaaaaaaatacccgtgtgttgcaacaggtgaagactaatttaaacttattatttttatatggtttaattaagattaaattcacagtgggaattcgcttgt

SEQ ID NO: 7793 - DNA, 1501 bp, Oryza sativa
agttctccgaacccggagcagagtgtaccgacagcttcggtactcctccagaattcctcctagagagctacactcgtcgaggtagaagtcggatgagcgccaaacttccaggcactcctccagagcttctcctcactatctacctaattctaatgtacaaaagatacaatagagcctcttgtaatttagctcaaagttgtgtgtgagtgaagtgagggagaggagctttatttatagccttcatatgacggttacagctatgggaaatgtcctaaatgccctccaaccatcattgagacttcaaccggagcgtacacgtcgaaggtcaggatgagaggaggctgtggtggttcggccgaacccatggtgggccccacctcctggcctctcctttgacagggacactgactggtgggccctgatggcggttatgacagttatgactcattccatggtggttccacctgacttgtgggccctccaatctatgtgcttgtgtctgattggccggaggtgtgtttcctcacatgccgggtgtgttttctccttaaaatacctacatacacatattttaccaacactagtggaattgattagtaataatccctaccactaagttagataccatattttatttaattatatgcatgtattgacggtcaaatattacgatttaaggatcatcaacaacatccccacacttaacatttgctcgtcccgagtgaaggctatggactctacaaaaggtttatgacttccttataattatgcaaacaaattattcaaagtcatatctatacttgtgggtctttgtagtgtctaccatgcgatcttggggaattgagaaatggaacaatcttgactcaagtcgcccttacttttcatgaaattataactttgctttgctcctcaattgattctctcgatcactcaaagtgtataatttctcacaaaggcatatgattgtgccaagtcctttcatagcctcccaatgacggttatggcagttggaatggtcggaaatgctctctaaccgtcattggagagcaatcctggacgtccacgccaaaccctgcatccaacggagcagatgggggttcggccgaaccccttagttcggccgaaccatgggctggtccaatccagcacatttttggttggcggcctcctggacttctcctctctatagacttgtgaattttggtccaattggtcgtgtcatttctgagttcttggcccattcatacataagtctgatcctcgacatcgtcagattgatttattgtctggtttgatgtagattcctctccattttatggttattctttgcaaaaggttagtgatccaaatgctagaggaatattattattctaacatggatattgcaagcataactagttctctattttggtaacactgaggtcgaaactaatcgctaatgaccgtcaacagggggagagggatccgaagagaaaaaaacacttgtatcctcccaccagaa

SEQ ID NO: 7794 - DNA, 262 bp, Oryza sativa
cccgcggcaacagttccagtccctccgcgcccccaccaagccccccttccacttcccccacctcctcctcccctcccgctcctcctcccgccgctgctgctgcgtccccgtccccgcccccggggcgaggtcccgcggcctgcccgctcccgtatccgcctccgcgctgcccctgcgggtgacgcctccgcccggggtggaggtggagggtggcgtggggagggcggtggcggcggcggcggcggtgaggagggtcgcggtg

SEQ ID NO: 7795 - DNA, 1501 bp, Oryza sativa
ttggatgaagtacaaatcaaagatttatttggatcacaatcttaaataacaacactttaggacgaaggaagaaagtaggtagcaaattaaccagacgaatgaccagtcagtagagtacaaacagcacgaataagcggcagtaggttaacttttcgttatttttagcaatcggatatttcaatgcactcattaggtatagcttgtacatggacaacacacaaaagtcagatcacatcattcctacatttacatagttgttcgattcataatcaagatcataagccctatttgtttgacacattcaattatatactattagaatatattatattactaaagtatatgatagttaaatttgtaatacgataggattgattgtatcctatcctttcttatctctatccatataatctctatatatactggtcatatatacaggactcaatacaacgaatccaatatatattacaaagtaatctaattcctcctatactatattaaacaactataccgtatgttttcatttcttcatgatatatagtgctagtttcttttaagtaatttatctgctcagtacaattacaaaagaaccatagcagaacgtccagctaagaaatgtcagcccattcaaaaaataagtactctcttattaatataacacttctactatacttactccatcccaaaatatttgacgccgttgatttttttaaaaatgtttgaccgttcgtcttattcaaaaaatttaagtaattattaattcttttcctatcatttgatttattgttaaatataattttatgtatacatatagttttacacatttcataaaagtttttgaataaaacgaacggtcaaatatatttaaaaaagttaacggcgtcaaacatttagggggaaggagagagtattttgaaagacacattagtatcatggatgaaaccacaaatatgcataatcacgaacaattttccgtcgcccgcggtcaaaccgtctctcctacacattcatctgtacggcaagcaatccgtacacaccacggcattctgtacggccgctaatctcattccattccgtgcatccgatccttcccgccattgaagcgcgcgaagccgccgcgcaatccttcaccccacactcctacctagccgatcacacgcactccgatcgaggcaccccaacatggccgcgccgcccgcaaatcaacgcaaatgcaagaaagatcgccattaaatacgagcaatctcgcagccgatcccgtctctggatctccctctctctcgatcagcttgagatcgagcagaggagatgagcgtcatcacggtggttgtggtggtcggcgtcgtcctcgcgctcgcggcggcggcgtcagtaatggcggcggagtacagcgtggtggactacggcgcgcgggcgggcgggagggcggacgcggcgggggcgttcctggccgcgtgggcggcggcgtgcggcgacgacggcgagcggccggtgatgcgcg

SEQ ID NO: 7796 - DNA, 1501 bp, Oryza sativa
ttgtttgggctttattctcttttttttttaataagatggctcgtaagcctaaataaagaggagctcatcaagataatgaaaacactattatcaaagatacctatgcttgtagatggagatgtgacttcttctagtaaaatgaatatggacagatcacatcctatattatcctatattatgttgagttcttttttggatgaagtacaaatcaaagatttatttggatcacaatcttaaataacaacactttaggacgaaggaagaaagtaggtagcaaattaaccagacgaatgaccagtcagtagagtacaaacagcacgaataagcggcagtaggttaacttttcgttatttttagcaatcggatatttcaatgcactcattaggtatagcttgtacatggacaacacacaaaagtcagatcacatcattcctacatttacatagttgttcgattcataatcaagatcataagccctatttgtttgacacattcaattatatactattagaatatattatattactaaagtatatgatagttaaatttgtaatacgataggattgattgtatcctatcctttcttatctctatccatataatctctatatatactggtcatatatacaggactcaatacaacgaatccaatatatattacaaagtaatctaattcctcctatactatattaaacaactataccgtatgttttcatttcttcatgatatatagtgctagtttcttttaagtaatttatctgctcagtacaattacaaaagaaccatagcagaacgtccagctaagaaatgtcagcccattcaaaaaataagtactctcttattaatataacacttctactatacttactccatcccaaaatatttgacgccgttgatttttttaaaaatgtttgaccgttcgtcttattcaaaaaatttaagtaattattaattcttttcctatcatttgatttattgttaaatataattttatgtatacatatagttttacacatttcataaaagtttttgaataaaacgaacggtcaaatatatttaaaaaagttaacggcgtcaaacatttagggggaaggagagagtattttgaaagacacattagtatcatggatgaaaccacaaatatgcataatcacgaacaattttccgtcgcccgcggtcaaaccgtctctcctacacattcatctgtacggcaagcaatccgtacacaccacggcattctgtacggccgctaatctcattccattccgtgcatccgatccttcccgccattgaagcgcgcgaagccgccgcgcaatccttcaccccacactcctacctagccgatcacacgcactccgatcgaggcaccccaacatggccgcgccgcccgcaaatcaacgcaaatgcaagaaagatcgccattaaatacgagcaatctcgcagccgatcccgtctctggatctccctctctctcgatcagcttgagatcgagcagaggaga

SEQ ID NO: 7797 - DNA, 1501 bp, Oryza sativa
attgaaagtttcttagggcattctcaatggttaaggtcactagagcaataagatgggacccacattcttatgttcttttgtatataacatatgctacaatatatatagctttttcttgatattaagctgggacccactcatgaaaaaactctattcaacataaagagcatcatgcgtggtgcaaaaggtatgaaatatttttttatttcttatggtctaaccttaaggttggttatagccatatttttactttctcctctcccaatgcataaaggtagaaaaaatactactttattctttaaggtggctttgcatgcaacgttgtggatgcccttatggaaaagttttcgagaataacgatttatgatagacttgacaatcccaagccaaaccatacacatttatgtgtgcaccggggatgcaagtgtgcttctttttctcgcttatcctatctatatttttttttctaaaatttatattaccatgtaaaaaataaaccaccaagcatgtttttatatggagagtagaactgcccatttatgcatttgtacgtgtttttatatggataatagaactgcccactttcatggctaaagtacataaacattcgccaatctatctattatataattaaaggaatagaaaaagaagcctccacggtcgctcttatggcctagaaattctcatattaatcggagaaaaagaaaaaacagagtccatatagaaatataatttaaaaatagttgaaattcgaaattaaataataaggaatattaaaagaggagactagagtccatatagaaatacaatttagaaatagttgaaatcggaattaaaaaataagaaatattagaagaggagactagagtccatatagaaatacaattaggaaataactgaaattcggaattaaaaataaggaatattagaagaagagactagagtccatattaaaatacaattaggaaataactgaaattcgaaattaaaaataaggaatattagaagaggagactagagtccatatagaaatataattagaaaataactgaaattcggaattaaaaataagaaatattagaagaggaggctagagtccatatagaaaaacaattaggaaataactgaaattcgaaattaaaaataagaaatattagaagtagagtatagagtccatatagaaatacaattaggaaataactgaaattcgaaattaaaaataaagaatattagaaatagagtatagagtccatatataaatacaattaggaaataactgaaattcgaaattaaaaataagggatattagaagtagagtatagagtctatatagaaatataatttacagaaaatttagaattttttaaaaaaatatattaaaagacgagtgtagagtccatataggaatatatataatttacaaataactaaaatttgatattaaaaataattaataactaacacgtatataaaatataatatgaatattacacattagtag

SEQ ID NO: 7798 - DNA, 1501 bp, Oryza sativa
taaaaattgagaaggttaccgcacgtgtgataaccataataacagcactgttttataaatcctatgtcagcatgacgtatcggtgacgtcatcatctatgaattaccactaccctggttaattactccgttaattaattttgtcaaggtaacagcggcgtggcggcgcgaccaagctattcccagtggccgcatctgcgccatccagcccactaccaatgctactgtcctccaatcaaaccggctcattgttgctaagaaactagtaagtcagctgcaaacatattttaaaaagataaataaggagagagaagtgcagcgggctacttgtagccagctgtagcacgaactccaagacacagtgtgtgtatgataggtgggattagatattaatagtgtagtatgtaactattgtataaatgagctactagattagctattgataaactgaagctagtagttggcaatactattgaacttgctcgtagcagtgtcacgttatctgcagacagccggatgcacacgtcgtgttgttcgatgtgcaatcatcgagaagattgcactactgggggcacagggtagcgtagttggcactttgtgaaatgaacatggttcaccggtcccaacagccgatccattcgattcgagcaccctccaacactagctttgccgtacgccatcaggaaggaaggaggatgacacaaactgcaatgcctagcagagggttcccagatctcgagctggtgcgaacaacacaccttccaatcttccatatctcgtagtcctatatatgcactccccccttttcgtttggatgataagtgaaaaagacaatgctacctccgtcccaaaataagtgcagccatatgaatccatgtctaatatttgaccatccgtcttatttgaaaaaaatttatgagaaaattaaaataagttagtcacacatagagtactattcatgttttatcatctaataacaataaaaatattaatcgtaaaaaaaattcaaataaaacgaacgatcaaacgtgagacatgaacagtgtaaaactgcacttattttgggacggaggtagtacaacatactcgtttactttgaataaaaattttatatacttattcttaacgatgaaatagtaaaggctaaaaaaataaactttgacaaaaaaaaatcaaaataaactttaaaattaaagttgaaaatttaaattttctttaataagcataaacgaaaagatgaggcctcgcacacaaacaagaggatctttagtatatcctccatcttgttgcacgtacaatatgtgtttctaactctttgatagacgggttttttctccgaaacaggatagatttatgctaagaagatattacagtagatctttgttgttaaaagaaagagagagaaaaacatatgaacacttcaaacaaacgggttctacattttgaaatgtcgcaagagctgcaagaagacaaaccataacgctcgtagactctggtacata

SEQ ID NO: 7799 - DNA, 1501 bp, Oryza sativa
attatgttgcttgaaaaatattatgcattgataggattgcacttaatctgtttgccccgtctgcaaggcagaccgatgggcctacctagcttattgcatcttatccttcctttgttaattgttataccatgttcccttgtaaccacctagttgcgcctcggtaatcgtgcactctgcacgagtatcgacggtcgccttcaaacttaaaaactgagaaacatcttgggtaaaacttgggttttacaaaagacttggaaaacccgacacctgggtcggtgcttgcgaactaaatgaatttccaaaatcgcggaccggggaacgtaccgggtgtacggtttcctgctcttgcacttaaggaccgtttccttggaagttcatccgaacataagacaagtgcgaccacatgggtggaatgggacacccctggctgagtaactagctaatcgggggagccatgatgccaagagacatgtggattcaacggggtggtgtcggggagaacccccgggtttcctggcacagtatggtctgggacccctcttgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgtagaggttattaaactgttcgaacagccatgcccacggtcatgggtggatgtgaggtgattcctagcgtagttttgtttgcctactgcttgtgaaatttgctgatgtggtttgggttcgatgtttggaaaatctgcggctgatgggatcagccaggcccgggtggccgtttaaaagccgttggccgggtgccaaccatgatcaattcaaaagactgataccttgcacatactccgaccggacgagacgcacggtctcattcgtgtcgtttgagaagcactcacttaattgtttcagaaaagagtttaaataaaatcaattgcaaaaacaacagcctttccttgaagcctgcattaaacacttatttcccatggcttgctgagtactcccgtactcacccttgctctatataaataacccccccagttgctaaggaagatgaagcggatcccgctgacgaggagttcttccaggagcaagtcggctacgatgagttttagggtttcggcctagttcccaagtcgcgcctatgatgtttggtccaagtcttggcttccgcttccctttcgtaatgcagttgtgagctcgggtccgcagcccaacatgactgtactcctactctataataaagagacctctgttgctgtgatattctgtctccctgtgataccagcactgtttcctgggactggtatcgattaatgggttaaattggagcgtcacgggctagttccgctcggggctagttcggggcgtgacacgtcgcgccgccgcgagcttcgcgcggaggaggttgacttcccggagctcgccaccctgcgacg

SEQ ID NO: 7800 - DNA, 1037 bp, Oryza sativa
ccatagatgaccccttgtccaagtaatacctaacgatcgatgaattttttccttctcttattagtgatgaaaggacaacaatcggctatggattctggaaggtgagggttggtcaggtgatattacttcgtattagaacttgttgatatgtttgttggttgatcgatggtctgaactccaagcagaaaattttatctataggtttggttgtgtagtgggggatgttttgtccaagtgctaaggttaacctctgaacatagacattagttgtaattactaaggtaagaacctttttaatttagtagagatagaaaaaaggaaaaacttagccatatgaacagatcctaaccaccctccttgtctctgttcttcctctatccctttacaacctgaaaatatttgatcagtatatcttggacagtccaatcacaaaatctatggtcttattcctgggtagaggcaatgtgaaatacaggagttggttaattaccatagtaaacaacaaaaaaaagttacaagttccaatcaaggcctataaatgtctcatagtgatcaccatgtcatcttgatcttctatctgtaaatgacaggatactttatatcacaatcttcattttagcttttgtgtactgttttggatttatggtacgaaaagggagatagtctgcttgcttttagcatcacatttgtgtaaagatgcattcatgccttggaatgactacttgtagaatagaatgatatccatacatatgtcatcagactaagatagtcaaagaagtcatgcaaacaatgtacaaggacaggttttctgcatgtgtataattataatatgttaacataatgatggttgatttgaatttattttgcaagataagttaaattattataaattgactggttttgaattgtgcatgccatttgctaatgttataattgtgtgtgcagcctcaaggagcatcgtttggaaactatgtgctatgccttacctctggtaattgtatgtctgaccttggttccgatttctgaactttggctac

SEQ ID NO: 7801 - DNA, 1501 bp, Oryza sativa
ttcaaacaaatactgaactactctataatatttaaaaaatatcagggctaatttataaaactgcaaagggaatggtaagatggtaccataatgtattttgaaggagcatagataaataatgctctacagtctacccatatcacacattacttgtgaagttgtgatcaatttgacagtggttttgctgccatgaacgtcaatcagctaagtttgtagtgtatgtacctaactaaggctgtgtttggaggaaccctcctcccggcacgtaaaacgaagcacatattattgcacgattaattaagtattaacttttttttgaaaaatagattaatatgattttttaaaacaactttcgtatagaatttttttttttgcaaaaaacacacggtttaacagtttaaaaagcatgcacgcggaaaatgagatagatgagttggtaaactgggataagaactcagccgaagtgaagtctacattaaaaaaatatgcgttatgagagtatacactgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgccgggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcacagtagagatcgtgcgggcgccctgatcaagcgacccttctctatataaaccgacccgccgtcttcacgcaatatatgcgaaaatcaatctagggtttgcctcctactctgtactgcgccatcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 7802 - DNA, 586 bp, Oryza sativa
tatatatatatatatacgtgtgtatatatatatatatatatatatatatatatatatatatatatacacgtatatatatatatacacgtatatatatatatacacgtatatacgtatacgtatacacgtatatacgtatacgtatacacgtatatacgtatacgtatacacgtatatacgtatacgtatacacgtatacacgtatatacgtatacacgtatacacgtatacgtatacacgtatacacgtatacgtatacacgtatacacgtatacgtatacacgtatatacgtatacgtatatctaatatacgtatacgtatatatatacgtatacgtatatatatatatatatacatatgattataccttcgaagtaaacctaataccttagatgagaaaaaacaaacaagagcaatgcgatcttgcaaaatagccatttatgttggataaacaagaaatgaaggaagatcctagcgcagatgacaaactaaccaaccaattgttatcatgtcatggtctcgtagataatggcattatcattggtcgatctttttgtgtaccagggtaccagcccagaagacaga

SEQ ID NO: 7803 - DNA, 1501 bp, Oryza sativa
gggcgcaacgtcagcggtttcggcacggcatggttgcgggcgtggcaacgacgggctgatgcgggctggaggcgcggcagctctacctccatcgctaatcagaggcgggcacgacgtcggcggatccggcacggcacggctgccagcgcggcggcaactggtgactacgtgtagggggtgaggaggcggcgcatctggctgccgctccgcgccccacgcgcgtggatctggcgtggatattgcacgggtgacggtgggtgcggctgtgacgggcaactgcgggcaggaggcaaggcggcggcgaatctggccgccgttccgcccgtacgcgcacggcgcgacctctgcggcggcaagctcggactcggatggatatggaggaacagcggcggccacccccacgacacgccgcaatcgatgtccggagcaagcgctaacaaaaaattaacatatgatatagactgtgaggatgtatttgttgagtcaaaattttgttgtcataccaagttaattttttaattagtaaggataccaagcatatgatgtatatgaaaaagggtttctaataaaaacatagccgccagttttattaagagtaattatcgcacgaaaaaagctcatctagccgttttttcatttaacgccgaatcaatactccctaagataacgcatatttttttacgaactaaattacgtatttcagatatcatatgggtatttttataacaataagttgtttttaactattaaatccaataattataacatcacacaaatttcttatatatatatatagacgtgtgtatatatatatatatatatatacacgtatatatatatatacacgtatatatatatatacacgtatatacgtatacgtatacacgtatatacgtatacgtatacacgtatatacgtatacgtatacacgtatatacgtatacgtatacacgtatacacgtatatacgtatacacgtatacacgtatacgtatacacgtatacacgtatacgtatacacgtatacacgtatacgtatacacgtatatacgtatacgtatatctaatatacgtatacgtatatatatacgtatacgtatatatatacgtatacgtatatatatatacgtatacgtatatatatatatacgtatacgtatatatatatatacgtatacgtatatatatatacgtatatatatatatatatatacgtatatatatatatatatatatatatatatacgtatatatatatatatatacatatgattataccttcgaagtaaacctaataccttagatgagaaaaaacaaacaagagcaatgcgatcttgcaaaatagccatttatgttggataaacaagaaatgaaggaagatcctagcgcagatgacaaactaaccaaccaattgttatcatgtcatggtctcgtagataatggcattatcattggtcgatctttttgtgtaccagggtaccagcccagaagacagagaaaat

SEQ ID NO: 7804 - DNA, 1501 bp, Oryza sativa
cactattaagaaatcagacggtaatatggaccctcaccgttctagaacatatcttggaatcatgagagcgaagtcacttgtcagtaagcacatatctatattaataacatacgacatattggcataaagaataaggaagtccagaaaggttcttctttttctgacaggagaaaggttcttctttagcgcgtctaagaaatgaaaaggacccttcaacaagagcaatcaccatgctcccccctgactcctcatacaggtctttgtctaaaacaaaacttcatcatatagataaggctgaaatcctacaatcccctattgcatagtcactggttgcataaaacaatgccacccttttcaacctgtcaagaacaaaaattggacagactggaggtaggatgtaggccatcagcactgacatgcacgaagtggcaatgcgcatttgcttcagaaaagaatgcaaatatggccccagcaaccacacaaaggaaatgaaaatactaatataaagtagtggccacctccattccatcaagaagctgaaaaaaatgtatatatataggacaggagacccacaacagtgacaaggtactaatgccaccagtttaatccaatcaggagaaacagcaaacacattcttcaatcaatgaattaactaactggctggctgtatcaattccaacaaggaacaccgaatgttttaatttgtttcaccatctccatcagcaaatttcatcacccaactgaactaaacaggtgactccaaatcaacacagaaatgcttcatgtcagctttcacatgaagaaccaaaatcatctaatcaaatcagagaatacgcacaaacatgttcgttcacagagaagcagggagaggcgttagttacataccttgcgagccaagcgggcggtggaaggaggcgacggtgatgtcctcgaagcaggagttgagcttctcggacggtgacagctgcggctccgccacctcccacaggtcctccaccctgtgcccgatctccgcctccgggctccgcgggctctccatctccattgatcccccccccacccccaccaacctcctcctcctcctcctcctcttcttgccatcttggcctgcccacccttcccttccctgcacctggattctctctcctccacaacaactctctctctctctctctctctctctctctctctttccctcctgctcccaacgatggcctccgaattgtcactgcttcttgctactaacacttgctctgcttgctccgcggtgctgcgtcttgttcttgtctgtgcgtcaatgcaaatgaattaactgattacaagagaacttagatatggatattacaactgtatatataaatggcaatctaataaatttcattttcaatacaagcaacgtatccatagcatggccagataaaaaatagattaccccaactatatggatcaaccaaaatatttagtcagatattcaaagcatataagaattgcatttatgaat

SEQ ID NO: 7805 - DNA, 1501 bp, Oryza sativa
ctacgtaataaacagagtgtatttataatagtccttaactcataccagatagagatatttggtcaaataagttcaatctgaaatgatggggttgctttgctcactactctcagcaagattgtgattccactagacgccaccatgatacacgttgagaagcatgttgtcctgatacaaaaaatatgacctacaagttgtatgttaaaaatgttctggggattattttgtatattattgtaaaactggtagtatagaaaaagtaagcaatattatgcttactttttctaaactacccattttataatactaaaataaatccccgacccattttttcaagtcatttgttcgtgtatggggcaattatgctttgtgtcatataacaaggtggtgtctagaagagtcacaatgttgctgcctagcagctacatttgtgagagttggcagcatggcctgtaacccatacactattttcaattgaacttctttgaatgcgatatctctattttggcaagggtaagaattattatggattcatccatgtttattaagtaggggcagtatctattttggcgaggataagggttattatggacttaccctgtttattgagtaggggaagtaaaatctagtttaagttctttgaaatgagcttttagacttagtgattcattaaagcaaatatagcatggagaaacgtcaaactttcccttattgcgcatcatcaaggcgatggacacaccttggtttcacccttttttacctttcatatataacccctgaatatttccggtattttagtttcctatatgtcaattttgattctctgatcaattttttttattttaaagcagtggtaattgtatgatgactccctatatttgtatgatctccggtttatatatgatttaatcttcaatttgtctgatgttttttaatacttgtactgttattttgatttttgtaattaataattttatttgagaaaaaccgtactctaaaaaattatctctttaattttgtccatgtaggtaactggctgtgatgaaaatggaaaccacaggtggttaatggctatcaaaatcgtatagccattggtacactaataataacctaaatgacggatgctaacatcctatttctatccagcataaatggtatccattattttatttagatattgaatgccaaatgtgcaagacagggacatgttcttacttcattaataaggagatcaggagaatccattttaaggtcttccaccatcggatggcatttgacacagaaaagattaagacagagaaatctgagctgaagaacctcattttcgcatcattcagaccattttatctgatgatccccgttggtgatggatatcatgaatccccctgctaggacagccgtgatacatagcaactaagcaagtgataaaagggatcatttaagctgtttagtgttaacaaaacgaagtgctaaagcctaaaaggtgccctgctgctgcttg

SEQ ID NO: 7806 - DNA, 1501 bp, Oryza sativa
tatgaataaatattgttgttaaaatttaagaaaataaatcaaatgtttattatatttgaaaatggagggagtggtacggttgctaagataaaaaaaaaagagagacaaatatacagaacacatttaaagtggataactgatgaggtgtcctgccataatattagaaactattaagagcggcgggctgggcgagcgctgggcgatgccacgtcggataggaacagtgcgctgggtggaattttttccaaaaaagccctccgattttctataattacgtatatgccccacacgaacagtatttatggaggagaattcccggatagggacttatatgtaaaaagttaaagcgtagggactttttcgcaaaataacgcccactacttaactccccaaacccgtcgccgcacccttctccctctcgtctctccctccccctctctctctctcttccgccgcctccgccttgcgccgtctccgcctcccgctcacgccgccgcatccgccttccgctcgcgccgccgctgccgccgtcgtcgcatcggcgtccccgaacgcctcccccaaccctagccgcctccgccgctcacgccctctcctccctgtccctctcccaccgccaccgctccgcgccgccgtccccgcctccgcctcgcgccgccgccgtcgtcatctccgcctccgccgtgcgccgacgtctccgcctccatgtcgcgccgtcgccgtcgtcatctccgtctgcgcgtcgcgccgccgtcgtcgtcatctccacctccgccgtcacatccattgcgtccccgtcgccgcctccacctccgttgcgctccggttcggtcaccgccatcgccgcattgccggatctggcggggggtggtcaaatccgtgtcccccgaccatggaaggggcggcctcgggtggagcaggtcgacgctggccacgaaggtgcaaagcttggatggagcagttcgtgcagccgtcgccatcctcctcctcatccctcgaagccaaggtaataaaatcgttggatccggcaatgtagtggcccgagaaggaaggagatggcgcctaggtggcccattgttttgtgtcagatagttttatgtttgccggtttagtgaaaattgagatgattcaccattggctatgtcatgaaaagagtgtttgtctgtaccaagccatcatttttactaccataatttgtaataattccgttcatatgatcagggaccatatcggttatgttgatgtccataaataaatttcaaattgatcaaattttaggttagacattaggttgaatagaaactattccgcctaaataagctattacgtgcgtgtcgttgatttgatttgttttgtctggtgtttttggctgattggtttgtgattgttgttttttaagatcggcattattggtgagtgttcgtgagcatacgattggatctggttttgttcttgttatgtggattgggcgtggatttgtgatacggcttttggtttggat

SEQ ID NO: 7807 - DNA, 618 bp, Oryza sativa
accgccgccaccgcccatgcttttgcacggagtagagggtggagaggggggtttggagtcagctataacttaaaagagtgaattttatggtccatatagaaaaatgaaagctcggtgttgtgaaaaaatcattttaatattattcttctccaaataaatttataattgacttataattatgattatccttgctctgtgggagaacctatggactcggtctctaccctctctgtttatattatataagtcgctttgaatttttttaagtcagacttatttatgtttaactatatttatagaattttttaaatatatactgatctgcgataacaaattagtttcattaatattgaacatattttgatgatattttgtttgaaatgttacaataattttctataaacttgattaaacttaaaatagaaaaacaaataacttataatatgaaatggagacggagggagcaccacaaaattaacagctagtagctagcaaaatacaactcggtcgacagcttcggactcggtaattcatacgtatatataatcaatgtatacgatcgagccagctatagagatcccaagcacgtacgtacgcacagatcttagacgtacgcga

SEQ ID NO: 7808 - DNA, 1501 bp, Oryza sativa
ttgttgttcaacctgcaaaactcactagtatcagtcactaagaaaaatccccacgcagcaaacttcacatggaattttgcacaactttttgctcatgacaacaatgtgtagagtaatgttgctggtgtactggaatcaaattacattttctccagaagaactgaatcatcaaattcagaaatgtacaccatagcataggccacaaaattaatttgctaacaccttaaaagatggcacaatgtaattaccttcttctgacgctctgaaaaagacttgaactccagatatcaatgtcaacatgaagtgcttgatcaaggccaaaaacccaccaccaatcaggaagctttaaggctaaataattcatgatcttctgaggtagaaatcactcacccagccaacttttatgacatatatacctcatgaatgtgtgcagtgaaccaatctgctcaaaacaattatgattttatcagtcctattttttgatagatcaacccgcagtagtgtctttgaaatatcgtgggaaattccatgccaaaacatcattagcataacaaataaaacatgtcagcaaatggcaaggaatacatggtaagaaaacgttgtaaaccatgatgggactgcacaaaattagcaatgagtaacacttatcatggtttccaagaacaataagacactgtcgtccatgatatttcctgagctcagaaactcgggtttcaccaatgctacatgttcaagtttataccaagcaggtggctggaaggcatactagaaagggaagaaaagatgccgttcatatgaaaacgaggacggatttggatgtctgcgggaaaaggaaaaaaatcaccatctttgtggagtacactaatatcaatacggaaactccaaaaccgtataagtacattgcatcaagtgcgatagcaaaaggtagagtttcatcagcatacccagagtaccctcaaaatctggtttcagctgtttcttcattttttcatacccaccgttagagcccatctataagcaactcaaatgaaacaaaagatacgaaaactgagtttaaaaaaaatctgaacaaaccaaggagacttttagtttctactattttttggatgtaatacaattacaccatgtgaacatgggatttccttttagttcgtatatatagtgcccagttagataaacaaatggtgaatttagttcccttttccaatatcaggtgttgctttctcattatgacagaacccatatctttgacttctgaattctcataacacacaccaatagagaattatcaggtggatgtgttcagatggttggcacacccgatggaccgctccacaactggctatgtaaagaccaatgcatgtagcccataatgagtagacacgtgaaatatcattggaacatcaggatccattagaagctaactggatcaaacataaaagataggaattaactttaaaaaaaacagcaatagaaacgcaaaaggtgaagcgtactaact

SEQ ID NO: 7809 - DNA, 1501 bp, Oryza sativa
aacctctttcaactggaggattaaccgaacaaggcctaagtgaacaacgcctaatatttatacaaccaagtgtaattaattgcagtgtacaatatagacctctgagtatagtaagagatttactctatttatatatgatgtacactgccgtgtaggctcatgtcaaggtggtcttatactattgcacatgccttgactgggtgtccatattttcgcagcgttaggatgcaacccacttgtaaaaagagggaggtgggggggggggcacaacttggacatgacgatcggtaatagaggctcaatgatctgatagtgatcgatggtagtggctttcactgtgataggcagacataatcgatggtagtaggctcacttataaatggatttgtgggttagccactctatatccctaaacgactaaacatggagtcgttgtcccagtatagtggctcatgttcttggttatgtggcattagttaatgatcttaccggacgagcgtggaaagtgataatatggcttagagaggtttgagctaaaggcgcccccatccctaccgatgaggcaggctgatcaagggcatgaagtaaaagacgaagtgtagctccgtcacccttctataaggatcctggaatggagggttgggtcactaaagatctttccctccatgttgctctaacggaagagactcaaacccctctgatgtgaatttgggggttccgattcatttaggagttagcctccatattcatgtggtatatcttaacatcttttcttttgggtggccttgcatgttttggttcttctatcaggaatacactatgactctctttagggaattaagattttgttaaacatttggttggtagccaacttccgagaatttagaaaagttaagtctttcgatttctagcttctagttttattttaagattttatagctataaattcttagaatctggatgagaatctaaactgttaggaagcggagatttggaaaaagctatggctagaaactccttcaaacaagacctaaagctctgtccatcgaggtgatgccggagggagtttcctcttatcgcaaatcacacctttcaattccaaatcatgcctttgtacgatgggtaaagggcttaagaaaaaagccaaaaaatttattacataaataaatattgatagaaaatgtatactcttcccattgtactatttcacatattgtggtgtgtactcctatctttaattctcctgtgcaatgcactactaccacattttcaaggagtaatgtgatggaaaaattgaaaatttgaagaaaaaatttagaactaaacttggaatttagataaatacattttcaggtagcccctacctagctatagtactactcatatactagctcgtccaatgcactactaccaccttggttggctctattaaaggccaagcccactagacgcattctgtcacgtctctctagtgttactgcgtaacgtaggtggccgctgc

SEQ ID NO: 7810 - DNA, 1501 bp, Oryza sativa
tccaaattaacctgttaatcgataccagtcccagaaaacagtgctggtatcacaggaagacagaatatcacagcaacagaggtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactggggggggttatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaacgacacggatgagacagtgcgtctcgtccggtcggagtatgtgcaatgtttcagtcttttgaattgatcaagattggcacccggccaacagctttcaaacagccagccgggcctggctgatcccatcagccgcagattttccaaacatcaaacccattccacaacagcaaatttcacaaggcagtagtcaaacaaaactacgctaggaattacctcacatccgcccatgaccgtgggcacggctgttcgaacagttttaataacctctgcagagggggtacactttacccacacgacattactaacccggatcatccagcccgtgcagaacggccacgactagagaccttaaggcttttatgacaaggcatttcgaaagccgacacaggttcaccatatgccaacgagaggggtcccagtccaacaccagattaggtcccagaccatactatgcccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggc

SEQ ID NO: 7811 - DNA, 1501 bp, Oryza sativa
gaacggagaactcactcccgcgccgtcggccactcgtcaccgtgccgtcccgactcggtagtgactccctccgttctccttcctcgttctccctcgccctctctagcttgcgtggtagctctactagcccatcgaacgcgcgtagacactgccccgagcttcgccgccgctcggcatggcctcgccgccattgccgcccgcttccggaggccgccgccgtcgctagccctcctcggtgctcctccgccccatccgatgccggaaacggatttcttgaaccccggacacgctcccaccgccttgaattgaatccctgtcacccctccgccatttcccccttttctcgccgccggcgtgcgccgccgcgattcgtcgtcgtcagcccctcttcgaaggatccgagccgttggctcaacccctctcgtgctcccctttgtaccggtgaactccctctcgatcaaatcgccgcgtcgtgctccggtgaaaccccgccgtcggccaccgttggttggagctcctgttcttcttcctcctctcgcccggcccgcgtggctgccacgtaggcgccacgtcggcgccacctcgacgcgaccgggtcaaagctgacctcggtcagccgcctccctccgtcccccaccctcgcgcgcggtccacggagagccgacaggctgcgcgtgggcccgctgcacaccgcgtccacccgcgcgccgcgcgtggaccgctttccccccgaaccctagcgctgcccttgcgtgcgcccatcccaccgtgggccgtatcaccgacaagagggccccacctgggaccccgcgtggtggaatcggtccaccgagccgtctctctctcccccgcgccccctctgttgggccgcctccccgtggcagcgcccggcccaatggctcggccgagcctccttcaaccctttgggccgcaccaatgccacccgagataagtccaaatcacatccctcatccctttaattttccaagggatttaataaatctttttcctttgttccataaataaaattctttattccaaaattccatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccagtaattccgtaaaattgagatctatttaatggcactattatttactctaaatagggtctttttcttggtcttttgtttaggtttttgtttgtttgcgtatagttgcggttaccggattttcgccgatcgcgggttttctcgaagattcatgaagctccgtgaagaccttaagcaaggcaagtcaccctttgaccaattgctcctataattggaaaaccattattattttgtttgcaacttgcattattatagtcacacacttaacttgcttggcctcagtttgcg

SEQ ID NO: 7812 - DNA, 1501 bp, Oryza sativa
gaggcttgatcgattctatctgttattaaaaaagaagagttgatccaattatgcagatcgagtactttcgatcctgtcgcggattatttgcttgatgattcttaaaaatatgttttctaataatataaaattaatcttctaacgcattgattatactactttgtatataagctctttgtttaatttattatataaaatatttaatttaccactataattaaacagatcatccatcagctttcatctccacgaattatcaaaaagagcaatacctagttgcaaacctagctctctaccatatatggcccttatttatctgggaaaatatgtggtttgcactatatattttccgtatttatctgtctaagcaatatcgatcgtcgttgttctatcccacggccaagatcgatcgaatgtgttcatcagcttctatcctaaataattactccctctgtactataatataagaagctttaaagttgaacacagttattaagaaagtagatagaagtgaatggtggaatgttgtgattggatgagcagtgaaggtaagtggaaaaggtgaatggtggaggattatgattagttgggaaaagaatgttgatagagaaattatattttacgacggagggagtaagaatttaagaaagatatactgatcaatataatcaccattaagaagccggcagtcacattaaaccatgtagtgatattattaattaatcttctgcaagatgactcagtaaactttggcggcacgtctctcccgggacgtggctgaacgggcctgggagcatgtcttgtcatgtctaaatttcaaccgtaacaacaacatactgtagttaataaagccaacagacatgaataaattaaattaaaactctactcaacaacttttaccaaacacgcaccgtactaccaggcactgttaatctacgtcattgcatatattaatttttgccattcaattggccgtaccacgggcaaataatctatataaatgacgagatatgcatttatttcaaatgaaaagaattgtcaaaaaaaaattaggatatacacacacatgcatccaatgctgatatatttcgatatggacatggttgctagagagaagagaagtcaaagcaagtgacttggaccaagcaaccatgaaacttcatgactccatcctcttgcagctttcacaaaccaacagacagcttagtttagctcactatacacatccatcagagccatataaatatacatggctccatggccatctcctctcaacaacttcatcgatctcccctatatctttacagggatattaattccaagaacaacacaagaacaattttcgttctctagctcctagattgtttgagaagaggaggcgatcgatcgaatcgacgattcgatcgaacggccggcgaacactgatcatcaaagataaaattaatggtgccatctgcagagatgaagaggggttgtgaagatgaacttggagctggtgatg

SEQ ID NO: 7813 - DNA, 1501 bp, Oryza sativa
gagaaccataatattaaataagtcaaacattttttggatggagggggtattgtctaacacaccctaataataatacttcctaacccagtcaactttgcgaccctacctacaactagctcctatcaccgtagctctagctagcaggggctcatccagtatgggtgttgggaaactcaagtcccatctacctcattggatcactattgagagaaaaggagagaggaggacgcaggaagaagagagagaagaaagtgtaggggagggaagggggagggggctggagaaggaagaaggaaataagcccctctctattctttttctagatccgcccctgctagctagtggtgtcagcaccccttgcgtcgcgctcctttcttcactataccaatatctatatctcttctaactatccttgtgtttctattgtccctactcctttttcccgcctagagtacccgccagtttgccatttctcgcccgctccattaccaaattttacctacatttgcgctaatgaagtggtcacattcacagagggagaagtagcatgggctgttggatttttatccaactacctggatcatgctaatgcttgcaaattcatgatgccaattaatatgatcaagctagacgttgtcggacgtttgattattctcccaaaagcgggcgttatttcatcagtttgagaaaattgttttagtacttggtccaatatttctaagagatgcaaagtccaagaaagattggttgtgacaccaacaacccgctatataaaacattgagtctcaatgactgcaatatcaaaaaaagaaattataaaatcaaacttaaaatgtgcaacgtagttggaattctagttgaaacattctcttcttatgtatgaaacatcaaattttacgactaaaacatgtgtatattttttcatcgtaatataataaaatgatcttgttgtaaacatttaattgtaacaaattcaacagtgtaaccggatcgacaattggataagtaatttagaagaaaaaatttttaatattagttgatagtcttcgtgcatgcatgtattcatagtttgagtacagagcatggcacatagagaaaagaaagagaggtgaatttgagggtgcccaaccatttgggttgtatctggcgtacgtccgaggctaggcatttttgttaaattaatatgtacttacaattataacactcaatcactcataatcccctataagatacacattgacaattattactgcctacaagaaaaataacaaaaaaaaatcaacaaagggcctctcggccatcaacatctatcctaatttcaccttcttcactcttcagaacttccctcatgtgggccctacatgccagtctcctgatttgtcgacagatttttttttgggtgctcattaattgtctctgctgcaaagcttaattctctgtaacaaattaaaaactgagctacaaactgtaaaaaaaaaatcaacctaattaagcatatata

SEQ ID NO: 7814 - DNA, 1501 bp, Oryza sativa
attgcatgcaaatgaaactacccaatcttagctgataggaacatcatgctccaagcgcatgagcttgtagatcaccatgaactataagcatatatatatgcatgcatgctgtgattttttttctttaataagtatttggtgatcatgaacttttaattagttgaatgaacttactgaggaagtcggagggatcatgcttgtagatgtccatctccttgatgatctcgatgctcagccgcttctcggcgatcttccggcgaaggtagaacgtcactagctcctcgtcggtaggatggaaccggaatccggggagaaccaggtcatcatcatcttcctcttctacctcctccacccctcgtagaatcacatcaccagctccaagttcatcttcacaacccctcttcatctctgcagatggcaccattaattttatctttgatgatcagtgttcgccggccgttcgatcgaatcgtcgattcgatcgatcgcctcctcttctcaaacaatctaggagctagagaacgaaaattgttcttgtgttgttcttggaattaatatccctgtaaagatataggggagatcgatgaagttgttgagaggagatggccatggagccatgtatatttatatggctctgatggatgtgtatagtgagctaaactaagctgtctgttggtttgtgaaagctgcaagaggatggagtcatgaagtttcatggttgcttggtccaagtcacttgctttgacttctcttctctctagcaaccatgtccatatcgaaatatatcagcattggatgcatgtgtgtgtatatcctaatttttttttgacaattcttttcatttgaaataaatgcatatctcgtcatttatatagattatttgcccgtggtacggccaattgaatggcaaaaattaatatatgcaatgacgtagattaacagtgcctggtagtacggtgcgtgtttggtaaaagttgttgagtagagttttaatttaatttattcatgtctgttggctttattaactacagtatgttgttgttacggttgaaatttagacatgacaagacatgctcccaggcccgttcagccacgtcccgggagagacgtgccgccaaagtttactgagtcatcttgcagaagattaattaataatatcactacatggtttaatgtgactgccggcttcttaatggtgattatattgatcagtatatctttcttaaattcttactccctccgtcgtaaaatataatttctctatcaacattcttttcccaactaatcataatcctccaccattcaccttttccacttaccttcactgctcatccaatcacaacattccaccattcacttctatctactttcttaataactgtgttcaactttaaagcttcttatattatagtacagagggagtaattatttaggatagaagctgatgaacacattcgatcgatcttggccgtgggatagaacaacgacgatcgatattgct

SEQ ID NO: 7815 - DNA, 1501 bp, Oryza sativa
tttaacaaacacagcagtacactctactcgtgatccactctcggtaaaaatgctactagtaccaatcgagaccgaatttcccataagaaaaagaaaaagaaaattgaacctcgaagatgcaaatatgtagtagtacgtaggtccgttcgaactaggtactatattcagattttatgatagattttgaagggcgtaaataaatagttcaaattttaaaaattttaaaaattaaattctagcgatataagacaattatatatagaaagtttttcaaataagcacacggattagaaatactccatccttttaaaataagtttatttttcacccatcccacacatataccaataaaaaaaagactagaatattccaacttaatttattaaatccaatataattattcctcactttatctattcctattacatttatctttgccttttataaacttctatataataattacgaacaacaaatttattttagcataaataaaagaagctctaaaaataaactcctcaggacaaatacagtggaagcgtgtcggcgatatatacatagtgcagcagtatttttcttccccagttattattattattattattattaaaacaaaaaaaaagagcgaaagacacggaatattttgaacctcctcgtagtgctcccagacgtgttccgaccgatgaggttgtggggcccagcaaatacgcgacgacgtcaccccctctcgcatacgctacgtgtccccttcctccgcgtgggccccactcccccctcgaccggacagagcagcagcagcagccagcgccgcctcctcccttcaaagcctcttcttcttctcacttcatcaacaacctcacctcgcctcgcctcttctcgcggccaacgagagagggagagggagagctaggaccaccgccactgcctcgggaagtaggtggctcccctgctttccctcctctcctccgccgtcgccgaggcagccagccaagtcgtcccagcaggtggtaggctactagtccgggtaagtgttaaagctcacctttcttttcctctgatctgcttcgccgccattgctatcctgaacgagttctggtaagctaggtgcgaagctaccttcctcttcttcttgctgtttcttttctttctttttcttttcttttccctttttcttggcggcttaatttacgcgtgttcgctgcaatttcatcgctccatccatccatccatgccagcgccgatgctgctttcttttcgctggtgaattagctgtaattaaatcagattgaagttgcgtgtgtgtggttgttggatctgctgctcctgcgacccgtggccgcgtcgtgtgtgctgtcctctcgctgattctgacgagattttcttcctcgatgccgctgtaggtggccggcagtgagcaggaggaatcatctctggcgttcttgtctccgaggaactttgattctttctgggaggggatttggtgtgctgctgctgctccaga

SEQ ID NO: 7816 - DNA, 1115 bp, Oryza sativa
gcgccccctccctccacgtgactacttgggcccacctatttctgctcctcttttttctataaaagatgtttcacctagtatatttacaatgtttcattatttatagatctaatgttgctgtgaattaaaatacttttttgtaaaaaaaaaaacccacatattttggaaactctctattaagggaatttggtttattttttgttccacccaaaatgtttcacatagtgtactcacaatgtttcactatgtatagatctaatgttgcactgaacgaaacattccattgcaaaaaaaacccacatattttggaaaccccctattaatggaatttggtttattttttgttccaccgaaaaatgtttcatctagtgtagtcataatgtttcactatgtatagatctaatgtgtagtgaactgaaacattctttcgctatttgctgaaacattgtttttatataaggtgaaataacacccgatttaaatgagtgaaacattttcgatctacttagtgaaacaattccgatatatctggtggaacatcgtgcaatgtttaaaaataattcaataataagctaaaaaaaatttcgtcaaaatatatccatgtgtggtcttgttttgaagatttaattgcaacgaatttaatggtgcaattggatcatgatttggataagtaatttaagagataaatcagtttaaagtaattttgcacgtaaaatcgaacgctgacgtcagcgcccgatttttcccccgaagcatcgggcgcccgacgtgtagggccttccttatagtaggtaaagataaagatatccagtcaatatatctataacgtatcatcagtatgtgcactgtccagggcaagaaacgacctcacattaattttgccggaaactacttcattgatgagatagttgtagaggttactcaatccagtacgaacttaaggttgaggcttcatttgttattttcttcttggtttgatcagtcgattaactaaccaaatattggaagcctctttttttagaagaaataaaaaaattgatgaaggtttggaagcctcttgattgcttcaaatgaatttcactcttgtacataagcctcctgattggtaccttagg

SEQ ID NO: 7817 - DNA, 1501 bp, Oryza sativa
tcgatgtaattcagaaccatgtattttacattataaaagatgacatgatagcttttgaaagtacctttgcttcttgttgctcaatgtcatctgaatcgaagcgagaggcatgctttttcctaaagctaaacatgacttcttctgctcttgacaaagctcaatcctgaaacagaaattacatgctattgattcaaatataatgtggtcctttgctcaacatcctcatggatcagagagtactattttctagatgagtaatctaaacgaggatcaacttcaaagttaccccaaaaggggaagaaatggggtaaatatcatggtgtaagacagaccaatgctagtggtcaaataactacttgaatcaataaatgtagaggagaacttaaggacgctaatactaggatatagggcttcatcacacaaacataattagtaattaacctcatcgctcttgtgtaaaaccactttgatcattcatttgaaataagattttgaatattgcatgtgtgattataatatatttgaagaataatgaaatatgaaatgcaagtgttcaactaaatgaacagctgaataacatacatatatagactgcaaacaagatcactatgcccaatagtggctaacagcattttcttgataaatccaacttctagagaagtttacaagacttttgagagaagtaaacctatactagacaaataataataaaaaagattgtatggatattcaatgatttttttagaaagtaggtcatacaacctggcatttatagaaagccaacacggcatcatttgctggggaaaccagcttacaagacagcacaagtccgaagaacagaacaaaaaaattttcatcagcagaaatttgcctagaagctcttattgtgagatacttcatacttttttcctgtatacttatagtcttgttgtttgtaatattttagtgtaacaataagtttgcccatgtttgtaacatcttcagttctctgtgcaccaatattgatatttcacagaatacttatgcgcatccagccaatcagccatgcacagatgcaaccattaatgcattaccataactagatgggaataaataaaataaaatatataatactaaaaggatttggacccatatttgtgcatcaaacttcatactttttgtctgtgacaggtgcctctcctcaattgactatcacatatttattcagtaagccagcgacttgacatgaagtaagtcctaactaattgacatcacactacaagtctagaacatgtaagaggcaagcaattcactgaagccagaaatcagattgaatctatactccatctaaaggaagtagtggtgatcgtgagtggtgaatttgctaccaaccaaccaccaactcaaattctgacatacgggatcattgtctatcctcccactaaaccaaaataacggtagaacagtagaagtcacgaatagaatagatcctggagctctcaatcatgataatccttgtacg

SEQ ID NO: 7818 - DNA, 1251 bp, Oryza sativa
aatggaatatttttagaaaaactattttattatatataaagtatcattgtgaataaaaaaaagttttcataatacttatcgttttttgacaaactgataaaaagagtgggcatgggagtagaaatcatgtgggctctgcccgcgcaggttctcgaatcctgccgaccacgcctttcttataaaaataaattgcataatttatttttagtttttattcaattttgcacaagatttgtatttatataagagaaaattcgattcatagcacaggaaagaaatcggtaccaaaaaatagcacacaaatttttcgctttcggcgagaagcacaggccaccgtttttccttcgtcccgtagcacttccatcgcattcatccatccagtgaagtgttttgctgttagtcaacagatagaaagaccaaattgcccttcttctatctgtatagcaaggcccactcaatttgtcctacgctgatatcactgcttgaggggaagagaaaggggaaaggcgacggcgacggcggcgagcagaggggagacggcgactgctagcagctggcggctatatcgcggctgcatgctcaaggctctctcacggtatgtgcaatgatgaatttgtggttgggtttttgactggggcaacctagatctgaagaaatgttctttgtttgtttgttgtggtttctgaagcaggaatgtgattttgttagactctttttgatagactgtttagatggttgctccagacgacatccctctttggtaagattgttctacaaccaaatcacaaatcacattgttctttgaaataggggttaggaatgtgtgtgctaactataggaatcaatcttgctatggcagggttgatcccttttcggcatatcgggtatgcattactatgcgatcatatactcgaaagggtgatgtcgaagtgatttgtgatgggaaggaatgggacatagttgttgatagagataaattcaacttgattgcgcttactgatgagattaaagaacattttgaatggggaaccaatcaaaaagctagcatgttatatcttgatagtacaggacaataccttccactgactagtgatgctgcactgagaagtctggtagattcaaattttctatttcgcgaaattagtgttttggttagggtggaggatattgttgaggttgctgatgccgatggcaatggcaatgccaattgcaatggtggtgatggccctggtggtgatggcagtggtggtg

SEQ ID NO: 7819 - DNA, 1501 bp, Oryza sativa
ataacatatcattttaaattaatataaacataatcatatccattcaaagacatttactgataaattcttatgagacattgtacaattttacatctcacaaatcaacccacaaaactcaaaatattgataaaaaatgagtcgtgaattgaagacttataaacaaatcttgtcagaggttgtaacttctaaaccaccatcccaactaaagcatagttgccactggatagagaaagactcttacgattctactcgcaaattagcaaagctccttgtaaatcatccactcctcactacccaattttggaagtccaaggctaagtcaatgacccattaattgtgacagaaccactcagcataaaatttatgcacttcactgcgcccaaccgaaattagccacccaattgccaacccagtactaacctaggggaggagggatatttccaacataaaaacttcctgactgtatcaaaattcaatgcaaactcactactccctccgtccctaaatataataacttttagctctcaagatttatcccaaaatataataacttctacatcaacattctcttcccaaacaatcacaacctccaccattcacttttcccacctaccttcactactcaaccaatcacaatcctccatcattcacttcaacctactttgttaataaccgtgcccaactctaaaaatacttatattctgggacgaagatagtacttgttactgtaattttattaaacatttgatcaaagaaaaagagaaaacataggctatatttaggcgttggcagtgacaggctggactaagcagcttcactataggctgccgaggaatgcagaacatatgtaacattggttaggctgtgtttagtttctgaaattggaaaaaaatttagggaaagttggtaatttgaaaaaaaaagttaggagtttatgtgagtagaaaagttttggatgtaatgtgatgtgatagaaagttgggagtttggggaagtttggtgtgaactaaacaggtcttagtttcctccgacaaattacaaggcaactacaagatgaatcccagaattaccttatcccaaatcttgccttgattttttcccttcctcttggtaagccccaaatcttgatttgaactttttctaggctctccctcaaaagatacggagctattcacgtctaactataaagtaaaagtagagtaaatgactcgtctcaggaagaatacagcaaagcaacgttcgaaaaaaaaaagcaatagcaattaaagctactatgttctgctcttggtaagatcatgcaaaatcgatgccaaagaacagcacagctcgagtaatttcagccacaattaaagctttattcagagtgaaagcatgatttagtatgttgggccattgggctgaagagggcttggttggcatgggagtaggcgaggtggctgaggtcaccaagctgcacggacaaggcctgctcggcgccaccaggaagcagctgagcgctgac

SEQ ID NO: 7820 - DNA, 1501 bp, Oryza sativa
taggagtgagcgcaaggcgaaccaatcagcgagagtacaagtgccatcggtagcgaaacgagcgaagctaacgcgatgacagtgcatgcgagctcgtggttaccctgaaagaggaggcaatgcccatgaagcacggattggcgcacaccatagccgtcgtgtagacaatgctcgagctcaagcaccacatctcttctccagtgacgtcagaggacggcgagatggtggtgagctccacctcctttcctcgtcgggcctcttcccgccgccgcgttagatctacccttcccgcgtccatgctactccaccacaccgaccaccgaggatgggagccatgggaggggctttggtggcaatggagttaaccttcctcttccctaccagaagacatgtcagcctctacgcaaccattacctactatttgaatcgttttcctcaatccctctagctccagtatgaaatgaagtggcggctctgcatccgctaacgacgcctcgaggatagaaggccgcggcaatcgctaagatggatgccctccgcgcccaagctcattgctgcggtgccagtggaaggaagagaggaaaagggaaaggaagaagaaagggacatgcattttggtcaaaaaaattgataatacttcaaagaggtaaacagtggtatatttggaatacctgtaaaatcatgatggcatgcttttagtttcatgaatagtaactgtgtattttaaaatgagtaaatttataatgaatattaactgtgtatttcaaaacgagtaaatttataatgatatggatccaattaactctaaagattatggcacacctccatagtttcatatcatgtgatcgtgctaacaatagtcaataataatggggaaggtgctcaagcacagaggttagttaattactccaattaattgacgcgtccgtgcgtgcgtgtgtgcgtgtggcggttaaaacgggtgggagagggggccaggggggtgtggctcctttggcgcggaaagagggggagctcccgccattccccaccattaacctcttctcccggggaacaaaacaccgctgttcttccctttgccccccctcgatcgatcgccatcgatcgatctcgtgcgggaagcgatcgatctcgtgcgggaatctttgggggaggtaagaatttctaccgttttctgcatgccgatccagatcgcatatggagcatgcatgcatcctctgttttcttgatccacgatcccctcattgcttccgatgattgcttgatcatctggaaattgtgcgttgattttaatttcttttcagttaattttctgttcctcggaaagagattgatccgtttcgtgaattgattcttcagggatttaatctgttggtgtgcacgcgaggaattaatcgaaaatggtttgcaggtcgtgcgcgatgatccgctgagcggggggcggccaccagatcagcccgcgcatccaactccggcgagaggaggaggaggaagaagaaga

SEQ ID NO: 7821 - DNA, 1501 bp, Oryza sativa
cgccgccgcccggccgccacggtgagacgcatcggcgcttggcctcctcggcctcgaccatgcggtgggatgcctcggcgagtcggtcgagcgcctgttgcacggcgtcgcggccgccgataaggagccgcgtccccgaaggatgtcccgatacagcccgagcgcctcccgccgcgagctcgtcagccggcggcacacctcggcctccgccgcgtctctgtcgagcgccctggaggaggaggatgagggggacttcttggcgacggggagagcggcgcctccgtcgcccccatcgtcaatggggaggcgcgggtgtgtgcgggcgtcgacgggcggccggaaggcgcgggcgtcgacggggcgaggcgggagaggaggaggacgacgccgcggcttcctccaccgcgcgcagctggggggaggggagaggaagaggtccggcggccgtcgtccccgcagaacgacgacgacgaggaacgggccgctgctggcctccccgcctcctccctcttcacgtgctcgctgtgggagttgtggggaaaggcggcgctctagctgcaagtcgactccatccttgtcgccgtcgcacaaagttgccgctgccattgtgtagctcgtcaccggcgaccagacctcttccgctcccgccgaccggctcgccaaaacgaggaagagagagaggaagaagggagagaagagggggggacccgccaaaacgaggcactgcctccctcctttgcgcccccggccaaagcagtcgccacagcgccgcccatcgccggctgccccgccagcctcctccgcagtccgcacctgccggtcagcctgagaaaagtgagagactgagagagaaggggagaggaggggaaataagagagaggtgatgagttggcattctgagatgtgaggcccaccgtgggtcccatgctgactcagcagccacgtaggataaaactgggtcaaaaccacctaagaacctcgggtgactggttttatatagttaagggacctcgcatatctggttttgcggttcgaggacgttttttattccgatgacaagttgagggaccttcggtgtactttttccgctcacatccaaatacttctgtcactgaggcccatctagcaaacaatattccggcccatgaaaactcccgtgcggcaacgcacacagcttcgcaatctccccaccttatcgtcgtcgtcgccactgtcccccgtgcccgatggccgcgcccgcgcccacagcttcgccgccgccgccgcccgccatgtccggcctcctctccttcgcctcgtcccgcccctaccctcccctccccgcgcccagacccgccgccgccgcccccaggccgcgcctccgcatagcgggttccgccgccgcggcccccaacgccgtgtcccaccgggcatcctcctccttctcctccggagaccgcctccgctcgctcgtccgccgcggggagctcgacgaggcgctccgcctcgtcgggtccgcgcg

SEQ ID NO: 7822 - DNA, 1501 bp, Oryza sativa
attttgccgccgtgaagccaagtccaagaacaaacgctttgaagcgctcgaaccaggcccggggagcctgtttgaggccgtagagagaacgattcaggcaacatacgacgtcggggtgcttggcgtcgacgaagccggtaggttggcgacagtagaccgtttctgagagatggccatggagaaaggcatttttaacgtccagttggtgtattggccatttggatgtaagggctagagagaggacggcccgaatagtggcaggtttgatgacggggctaaaagtttctccaaaatcaacaccggccttttgggagaaaccacgaagaactcatcgtgctttgtagcgttcaaggaaaccatcaggatggaatttgtgtttgaaaacccatttcccagtgattatattccctcggggtggtggagagacaagttcctaggtattgttggaggtgagagcctgaaattcctcaaccatggctgcataccaattgggatcattcaacattgaacgaacagacttgggaataagagacaaagcagtgaccgaagtgtggaggttgagccgctcgcgcgggctgcggtgaatgccagagtgagaccgggtttgcatgcgaggtgctgcggcagctgtaggagtagatggtgcagcagtggtgttgggtgcgatcagcgcagatggtgcagcggtaggggtgaaaacagtacggaatttttccggattccggtcatgttttcggaaacggaatcggccggtcggaattttttcggaatttctcggaatcggaatcgaaaacggaaatattttctcggaaacggaatcgaatatgataaaagcagtttccgtcggaacccggaaacgatcggaaacattccggaaaaattgtcggaatttccgaagttaaaaatcccatagattcaatagtccataattctccctagcttcccagcccaacccaaatcgcggcggcatctaccctaaccggctaaccctataggagagagaccgtcagactcagaactcagacgcgactcgcgagttggaggcggagcggcggctgcggcgtccagatcgcggcatcgcggcgccggcgtgccctcacgcccaccgcccgtggcgccggcgccccaccgcccactgctggtcgcctggccggctggcccccgccgtcctcgcccccaccatctcgcgccgcccttgctcttcgtcgtttcgccgccggccgccgccaccatctcgcacctccgccggtctgctcggtccccgccatctcaaggcgccgtcccaccgcgtctcgccgtttcaccgtcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaat

SEQ ID NO: 7823 - DNA, 259 bp, Oryza sativa
catctcccccgctccccccctctctccctccgctccgccccgcgccgcgcgcgcgagcgcgcgtcgccgcgccgagcgccccaccctcgcgcgccgcgcgcgagcgcgagagccgcgccctgcgcccctccgctctgcccgcgcgcgtgcgcgtaagccgcccgcgccgagccaagtcctccctctccggtccctcgttgccgcttcccgcgcgccgtgttcgcatgagcgcgcccgcgcggacgccgcccgttgcagg

SEQ ID NO: 7824 - DNA, 1501 bp, Oryza sativa
atacgggcggccggcgacgcggcagagggcggcgggaaggtggaatagcggccgatgcgtctcgcggcgaccgtagacaaccgccgcccccacgcccagctcttctttgccccgctccctaaccccacgcggctgcccggcggcatcatggcgcttcctcactcgtcgcgccaccacacttctacgtggacgtccagcacgcagacgtcgctggtcaggcatggcgcggccggcacacagccccgacgacgacgacgtgtcgtccgtcctaggcagccgcgcaccgagcgaagaacggcatgcccccgccccgcgcctcctcctcctccccctccccctcccacgagacctccacgcgccgccactcacctgtggtgaggtccgccgcagccagtgcgcactccgtcgctgtcggccccttcccgtctcccccacgcgcgggtgtggcctggatgaggagcacgacctccttgcccgccccggtcgagctgcgccacccgcggtgcatcgcctaaaagcaaggatggattgagtcgaccattggggcattttggtccagacgcgtcaaaatgtgggtccgctcaatcctagtcagtgcaaatatactaaataaatgggtgcggtgtccgctggcaaaaagtgttttccccaaaagcgactttgtgcggtgtcttagagctaaaaccacgaagtcgcgatgtcctgcaacaaaatttaccctaaactaatgtagtcaagcaaaaatgtggaatgttaaaagaaacaatttaacctggaatattattagaaggcgattacatgtcaatttaataattgaacctaggccaacgcaaactattttgtatctctctgtcgaccgagctatgctccatttttaaccataataaaagaatattgggaaatgaaaatttcaagctcgatcggtttcacacaaagtcaacagatgttaccatgatttatcacaccactctcttttcaccatgggactatcacatctaaagtttcgctaccacaaagcgccacgtcatcagaaatttaggaccgttggatgcagcagggaattaaaccgatgccattgtatctaaaataaacatgagtgaaaaatcatggtcaatggtagaatccttgggagttttcacatagccaacggtccatgttccacgcagcagacaaagggtctgtttgggggagctttcagctgcagcagcttctctcagaatcagaagctatctcaaatagtacagtttttggtccagatgttgagaagttgtaattgtcgaatccaaaaattatactagaagctagaagctagaaaacccaatttttccagattctcagaagttggctatcaaccagctgcttctcagaatctcagtctccctcaaacatgcccaaaaggtcacgaaaaaggagaagcccacgttcatggtagaatatatatacaagaatcactaagcaggtataaaaaaacgcagaacccatctactcccagcagccagaa

SEQ ID NO: 7825 - DNA, 1501 bp, Oryza sativa
tggctatgaacattgcccaggaacaaaaaaaaagagggagaataatgtaaaaaaagatgattgtgaagctaaaggaaatcaagtaaataagatggcataccttcgttgtcgatggcgtatgctattggattagtttcacacttgcagattagatcaaaacatgaagtcaggtttagagtttggagtagtgaacgtaaagtcagatttagaggtgaactggcctttagggtccataattacgcttagactgccgcgtgcgccgtgcgctcacgttaggttcccctgccgtccatgccgttgtgttttatcgtaacaagatcatacaaaaaaaatcgtatgtgttgcattttccgttaaattatagcaattttggctcaaatttgccctccaatagactggccaaccggatggtcagccttcccctcatcggtgatcttctcgagcacaacatcgcctactcagtcttgatctccttgcagcgctccctaaacaatgagggaaaacaagtagcagcatgcagactgagccctcctctcaactccctctggttttattttaattgacgttttggataatgacacggtctacaaaatatatctttgaccttatttttctattataatatatacaataaataaatgtatgtttaattttattatagtgttttgaaagacaaatatatatatatgttgttatagttcctttaaactaaatatttttaaagttattgatagttaaagttatgaaagtttgaccttaatccatcaattattatagaagcggagggagtagctcactctcgtcgcctgcttccgtgcaaccaaaatgatagcatgagttgtggctctagcaaggtcatgcatgctagtttaggaggagaagagggttaattacctcttaggtcttattcggttcgtatctccaccaaatagattgaggggcggggttagaggtgaaattgcaaccaatcctatcagatctcttctcatgattaactgaacaaatccttcttgttttgttaatgtactttgctaaaagttgctcacaatgctgtgaattgatggatgtgttatagcgtgcccttcttatagtaaaataaccactgcaactcctctccttaaatctacccgaatcatcttgctgttactctaacaaaggaccatggcatattctctctcctatgaagacgggtcatttgtctagcatatgatactatccctccgtctaaaaaaaataaatctaggactgtatatgacatatgtctagattcgttatactaggatatgtcatattcaatactagatttattttttatgggacggttggtaaagatatatggttgtaaatgaaaatctttgactggtgaaatcacctctaaaaaatatatgtaatccatccatggtgaaatcacctctaaaaaattgtttgtagtgctgggcagctgccactgcagccctgcttggctcgcttctcagctgacccagcaaagagcagactgacg

SEQ ID NO: 7826 - DNA, 1501 bp, Oryza sativa
ctgcaaacaatttgtctgcttcggcttaaaattacattaagaaatgaaggtttacctgaaagagctaaaacatgacgattctaaaattgtactactgatcaaatttctttggaagtagtagaaagaatgaaaccagtcgtgcacaacatacattgtatcacattacccagttatctcaaattgcgttacaaaacaaaacattttttttttacttttgctaagtcgttttttttcctctcatgtcacactcttcacaagatcacactagcaggcaaaatttcaggccctcccggttaccagtttgcatcacattgttggagatatcacagtcacacaatggcaatcgaagaaagaactgaccatgcatcagcttgtccaccatggctagaagatccatctcctccttccccatcttcggcatccgcgatcctttcctgaaaattgcgaaactcgtacaaaaaccaaaacctaaatcaacccctttcgggaaaaaaaaaagcgagattcacggaggcgaagaaccaacccaaattcgcaaaccaaatcccgattcccaatttgtgatcgcagaaattggacaaagccccccaagatcattcatcagtgtggaaggggggggaagagaggggaggtgggcgcccgaaccgaacctgtccttgcgcgcggaggagagtgacatccgggccatcctggaccgcagcacggcgtccacctcgaggtcaccgtcggcggcggggtcgaaggtggggtcgtcgtaggagcccgcgtcggggtcgcagatgccggcgaggctcgcggcctcggggtcgtcctcctccgaccagtcatatccttccccctcctcctcctcctcgtcgtcgctctccacctcctcctccgatccctcctcctcctccccgtcgtcctcctcacggggcagggcggcgcggtggtcgtcgtcgtcggcggcgggggcggccatggatggcgtggcgggttcgggggttcctcctcgggtcgtcgaccgttggtcgcgggattcttgggattggtttgaagttttgaaaatttggtagatttttggcgtgttgcgtggttggggatttttataggcgtcagtctgctctttgctgggtcagctgagaagcgagccaagcagggctgcagtggcagctgcccagcactacaaacaattttttagaggtgatttcaccatggatggattacatatattttttagaggtgatttcaccagtcaaagattttcatttacaaccatatatctttaccaaccgtcccataaaaaataaatctagtattgaatatgacatatcctagtataacgaatctagacatatgtcatatacagtcctagatttattttttttagacggagggatagtatcatatgctagacaaatgacccgtcttcataggagagagaatatgccatggtcctttgttagagtaacagcaagatgattcgggtagatttaaggagaggagttgcagtggttatttt

SEQ ID NO: 7827 - DNA, 982 bp, Oryza sativa
agtgcagtaggttattttctgaaatgtttcagatcttgtagaaacaagttatgcttgtttgtgtgtatatagagtatgtagatcgatctccattgctgctgctttctctggaataaggattatgctgtgtttaggtaggattaggaggagacaaagaggggcgtgatgctgatctagctggtcagctcctggcttccaattgataaagagatcatgtaatatattctgcttggatgatcgttcagcttaatgttagttccaacttccaagttgatcagattcctggtgtcgtgtcgaaccaagctgctgggagttcgtttgcctgtcaatttgttgcttgataagaaattctctgaaagttaattaaagagttgcttcataggaattgaagtttctttttctaggtaagaaagatcagaagagttgataattaagaacttgagatggatggattccgtccgaatcagagctgcttgtcctggattgtgattggttgatttctggtgacaaggaatcctcgtggaattgggttcaaataccatggttgaattccaaaaatttccaaacagcatttgaacagctaccgccttatctcaattcatcgattttgagcgtaattcagagaacaagtggtgttactgaaaattagcttggactcaaaattcgattggttttgctgagctcaacaaggtttaagcaaatactaataacaatctacgccaactgtggcaaacgagtccttagctatgcttgtctcatcgacaagcattgggcgctttctagagaaaacttggaagattcgatcccggacaatgatgaactgaagctgtgatacggaagagtgagatgataattaaggcctcgaggtcatttgcatttcaagagtaaattacatctatggcacatgatcatggtacgccatagctgtataaatagatacaacaaaatttacaaattgtatgattcgatataagttagtcca

SEQ ID NO: 7828 - DNA, 1501 bp, Oryza sativa
gtagtggttatcccgaccaaatgtattgttcacatttgtgtggtgggagggctaggtgggcgaatttttccatttttaaaaaaaaaattagaaaatttagaaaaaggctatctaggtaggggtggattttgagctggcttggcccggctcagctcggtctggctgattgggataacgagctggctcggcttgttatcctaacgagctaaagtcctggcttagctcggcttgtttgaaagctcaagctagctcgtttggctcgtgagctagagcgcacaagcagaacaagcaacgaggtggacgacaagcgaaccgatgaagcgagcaggagaaccgcgtggctagtagcatggtagtgctcgctggacctggtcatagcagcaggctccgcgacaccagagcgggaactcatcggagcactggtaccgcgtcagcaccggagctccaagcttgtcgtcaatccgcacctcgcctctcgagctcctggataagatggagaaggatggcaggcagcaacggcacacgcggaacgccccacgaaaaggaggagaatgggggcggggcggatggcggcgcaggatgcaagctgtggcacgcgcacgtgcaataggttaaagcatgcatcggctggagatccgatattgttaaatccaaatgattagataatcagtaaaacatttgttgcaatcggctagaaccaacttatatgtaatccttataagccgatgcaacgtccagataactcataggctgaaaccctgatgaaacccttattggcaatcaaaggcaagttagcttttatgattctaaacacgacttagtaggtcaaaactaattgatgcaacactaaatgtgaaaagaagcataaagtctaaacaatcaagcctttgattgatttttagggtggtggacacattatattatctaagccaacaaagtaatctagccaatatcgacaaaaccctagatagagatcggtcgatgcaagtagaaaacactatcaatctagattatataatgtatatgataactcgatgtcatacatggacaagattagagtgtcgaagcgatggaagcactaatcccgacaatgcaagcagccataacaagccttacccctcgtcggagatcgaagctaattaatgcaaccccaacttaaaacaagaactagctcatcgagaaagacgaaaacaaaaagggtggtgatttatacccatggatagatactagttcttattggacaagacataaactttcctaaagataaagtaaaagatacaagtcctgattgaactctaaacacacttccctaaaaataaaaggaaactacccgactatgcctaattaatagataattcccaagttgtgtcttccttgaacttggtctcttctagataaacttcatttaattgattaatttccttaatcgaatccatcaagaatccaactattggcagctgacaatttccatcagcaaattccaagactctgaagtcgatac

SEQ ID NO: 7829 - DNA, 1501 bp, Oryza sativa
tttgatgaataaatttattagattttttaaaacaacttatgtataaaaagttttcatgtaaaatgtaccgtttaatagttactgctagagagctgatctttgtttggatggcaaaaatcatatttgtcccaattcgaatgggaaccgagactaaaaatcacggttcaaaatagctgtcaggccatgtcaaacccccaactatctttagtcccacattccacatatttttttagtcccatcaacccagactaaagatgtctccagggttagtttaaaaaagaaaacatctctatttaagtcatatgtgtgtagtaggtgggatgataacatgcgtgagagctgaggtgagagattgagttcgaatcccacatcccacacattttttttttgacttggtatgcatctttagtccggttatttcaaccgggaccggattgtgcatcctggttacacaaccgggactataaacggttgcgaaccagggctaaagtccctttctccagcagcgagtttgaaaagcgtactaatgaaaatcgagaagtagctaagctgaaatagctgaaaagtatgaaacctagggcatgcactagggtaactctattcactgcttacatgttttgcaaacgtagtaccattgtgttgccttgtagctactctctgacactctatctctccatatcgtcactagattatcgtggtgacccaatgtttgttgtttatagaaaaataattaggaaaaagtatatataaccattattggggttggtatacttaaccccatgagtatggaaaccggatcaaataacctcctagagtggttttataggtagttttagtatgtaggtggtgacgtggtatttattttgctttcatggcacaaatattagtcaattaaatttaagttggcccaccaacttcttctcattgattgacatggataaaagtttcatagtagtaccaataatgtatattattatcaagccactttcacttgtgaaaaataattacttaagcgattctctatggttatatccattaccctccgtttcacgtggccaaaaccatcgccacatcatcgcgtacatagggaaaaccacattatgggttatttaaaccggtttttatattttaagggtaaaacatatggtttcatttaaataaaagaaagtattggttccataattagcgaggttaagtaaaccaatctgaatacttaaggagactttttttttcaaaatgattaacatataaaaaacaaactgttttaatttaatattatagacgttaattatattattgtaagagcaattccaaagaaaaacatgttttgaaatgagaggaggaaagaagaagaagaagaagaaagactagtgcaatctagaagccttccaacggggaggagagagagggtaatccggggagtaggactagactactactagtacatgagatcgatcgatcgatcggcatctgcatctccgcccccgcccccgtggatctg

SEQ ID NO: 7830 - DNA, 1501 bp, Oryza sativa
ccaataataacatatttcttaattatgtgcttgctgctgtaattgtttccttcatttcataaataaatatgatatattaccacgtgctgttactgtactagtgttgatttagcatgacaaattgaatatccattctcagttattgtatcatgtaggcgcgcacacttaattaaacagaggagaacaaattaaagcggagtacaatagctagctagtttgccaataaagcagagtacgagatctggctagctcctttgcacattcgcaactatattttttatttttcttacagcttgtacaaattaaatttaaacttgtatatttgtgaagtgatatatttcatattaatctatattactaattttttttcatatttttaattgattatttagatggcatatacaaaacgagtgtatatcttctcgagagatgaaatcattttcccggtgttggctaagacttttctgtaccgttgtgcttgcacatgaattggatggttttgcctgatgatgagctgggggtttgtcttgtgccactggtatgagtgctgttgggtgccgtttccttaaataaagcgaatgtcatgtaatattccgaagagaatatacaaatatggtttatgagtaatgtcgttatcccgataaatcaatttttggaagaaagggaaattaaatctgcccaaagtgaagtgttgaattactacatggagtgtgatgaaatgattaatttgtagctcccggggatcagctggcgtgacggattttattgatgttcaggtaatgggttggagtgccgtctctgaatctctgatagtttgagaatgctgaagaaatacaatacagaactgaaacttgggacttgggaggacatttttgggtaacgtcggagaagtctataattagtgcagggagttggtagtacattacattgatcgatcaggtagaaagcaaaatggtgcagcatgcatgatggattgcaaatggcagagtgagtgagtgagtgagcagttagaaagaaaggaggcacaaacaggcagctaatgcaatgaaacaactgctccaatgtatagtggattgaatgtaatggagctagcaaacttcatccgcaacagcaactctcaacttcttttcttcactcacatatatgaattgaaactcatcatttaggctgagtccttacatatatatacaaccagcaaagatctcaggtcaatgataatatttgattattaagcagttagtagtatgatttgatgacccaaacaactactacaactcctctgcaaatagagtaatatgtatatatagcagagggcactctatatataccttcatacatagggggatagattgccaacaccaagataatatagatcgatcaaatagtagcagtagtaaattaagaaagcagaagagattattgattaagcaggcagcatgagcgggagcgacacctcgggcagcgtccacgtcgacgagcacgggcacgggcacggcaaggc

SEQ ID NO: 7831 - DNA, 1501 bp, Oryza sativa
  unsure (1)..(1501): unsure at all n locations
ccttcagtgtttttcgcacttaggaacattcaaattggggggcctccttgcattcttagccatcacaacttgctttgagactaaactcatgttaataaacttgataaacacgttagtcctctttaaccaccttgtcattaatcaccaaaacccactagggggtttaagtgcaccttcatagctgacatgtggggtcactctttttattaatttccaaatcaaattgccacgtcaatgccacatctatgccacgtcagatgaaaataggtcaatttagacacgtaggtgccacgtaagccaaaaccgccttccaaaccgccatgggacctatattgcaccggttttgatagttgagggacccgttgtatctggttttgtggttaagggatgaaaattggattcgttgacaagttaagggaccttggatgaacttattccttgtttaggctagtgaattgggccaggaaagcagggaggaggcaggcaggcccaagcagtgaagaagatgaactgaatatggcatttttttcattttcttcatacacatatacatagtacatactatatatacatattcttttgtcaaaaatcttgggtattcatctgaatacccttgaattgaagtgggcccgcccctgcctgtcagtgtgtgtgagacgggtaaagaagcacgatgtaattctcgcatcacgactttactttcccagtggaaaacaatgtctttataaataaatatgcggaaggcaaaagtgcatgttttcatatgcttacacacaataataacttgctgctgttggtcgtcaaaccccccatgccttcagttgcatatatattaccgtacgtacttgtgtaatatatatgtgcaagatgtttgatctgtagcaattttaccattgtattgctgggtgtttgtttcccttggtaaggtgtgagatggtaaaatatgacgtgcagtgaagtaagctattgttggcaaggtttgctcaatacggtatttgcagttgaggcatcaacaatcttcctaccgatcccgtttccgattaatatttccttccaattaataccgatgatcttcgattgtttccaattaatactcgtccaaaatattaggcccaaaatcttcttatatactatccaacaagaggatattatattactccaccattttgaaacccaattgagaataaatttgcagtagggactacacttactatgaaaacggatggggtgtcttttggtccaaattggagcnnnnnnnnnnnnnnnnnnnnnnnnnnnnnnnnnnncaatttttcacagcgctccgcactatcctcctcagttttggttgaatcgatctgagctgtttggttgggtttcagtttatccaagacactgggtcagttttgttctagccacactttgtcaccatttgccaataaatgttgttacacttgccaaagttgaggcgcctaagagaatcttgctacatttttatgagccaatgatgcgtgggacctaa

SEQ ID NO: 7832 - DNA, 1501 bp, Oryza sativa
taccactgccagccttgcgatgcccctggaaaggcgccggcgccggcgccggggcaccagcaccgtcgtatgacgatgaagccttgccgtgcccgtgcccgtgctcgtcgacgtggacgctgcccgaggtgtcgctcccgctcatgctgcctgcttaatcaataatctcttctgctttcttaatttactactgctactatttgatcgatctatattatcttggtgttggcaatctatccccctatgtatgaaggtatatatagagtgccctctgctatatatacatattactctatttgcagaggagttgtagtagttgtttgggtcatcaaatcatactactaactgcttaataatcaaatattatcattgacctgagatctttgctggttgtatatatatgtaaggactcagcctaaatgatgagtttcaattcatatatgtgagtgaagaaaagaagttgagagttgctgttgcggatgaagtttgctagctccattacattcaatccactatacattggagcagttgtttcattgcattagctgcctgtttgtgcctcctttctttctaactgctcactcactcactcactctgccatttgcaatccatcatgcatgctgcaccattttgctttctacctgatcgatcaatgtaatgtactaccaactccctgcactaattatagacttctccgacgttacccaaaaatgtcctcccaagtcccaagtttcagttctgtattgtatttcttcagcattctcaaactatcagagattcagagacggcactccaacccattacctgaacatcaataaaatccgtcacgccagctgatccccgggagctacaaattaatcatttcatcacactccatgtagtaattcaacacttcactttgggcagatttaatttccctttcttccaaaaattgatttatcgggataacgacattactcataaaccatatttgtatattctcttcggaatattacatgacattcgctttatttaaggaaacggcacccaacagcactcataccagtggcacaagacaaacccccagctcatcatcaggcaaaaccatccaattcatgtgcaagcacaacggtacagaaaagtcttagccaacaccgggaaaatgatttcatctctcgagaagatatacactcgttttgtatatgccatctaaataatcaattaaaaatatgaaaaaaaattagtaatatagattaatatgaaatatatcacttcacaaatatacaagtttaaatttaatttgtacaagctgtaagaaaaataaaaaatatagttgcgaatgtgcaaaggagctagccagatctcgtactctgctttattggcaaactagctagctattgtactccgctttaatttgttctcctctgtttaattaagtgtgcgcgcctacatgatacaataactgagaatggatattcaatttgtcatgctaaatcaacactagtacagtaacagcacgtg

SEQ ID NO: 7833 - DNA, 1501 bp, Oryza sativa
ttatctattttttaaaaataaattaatttgattttttaagcaacttttatatagaaactttttagaaaacatatattttaacagcttaaaaaagcgtgtgcacggaaaacgaaggaaatggttgggaaaagggtgctgaacacagccgtgacatatgcgtaaccttgccgatcggtcgagtggataattatattattaagcacatgagctaatttgaccctgcagtcaaattgattgccaggccgtcgagccaaatcaaccttcctacatatatacagtactgcatggcggctttggtttagaaaaaaaagaataaaataaaaccacgtactgtatatcatgaacaccagcagctcatcctcgtagaatgtagttatattataattgatataattataatataattatattataatttattgtaattaggatgtaacttatagataacttgtatataacttatcgaaactcacgtgtggacattgtgcctagcgccacaagctaagcttgcaacccacttttccttgcaggccgcacaaattgattgtcgtggcaatcctccgatgttaacaaattctaaagttttgagggtattatttttccttgcatgccacacaaatctcaaggcaatctgacgatgacatatatgtatttaaaagttttacgacagaaactgtcaaacgctttttagcaattccatttatatttcgatcgtacgtgtgtaagtttagcgtagaattatgtatggattgtgtaagtcaatggttttgtatcggaacctgtgaactaaattaagtatcaaacaaattatatttgagatttgttattaaaaaaaatattcactgcatattggtgcaactatatgctaccatgatggacttggattttgactgagatatcaataactaatagttgcgcaagcttaattagttgagtgttatatataagtaaacaattcgccaatttaatttccccttatttatatatttttctaaagataatggataaaccgggcggccactgtgtcaaaattaaaatttcccttctcttgtattgtaatactaatattggattactgcttcacatatatagtacatgtacatatatagtattgttgaaaaagattggggaaaaaataggatttggttttgtctaagggttaggaaacatcctccttatggccagccggtcaatccatcgataaaaggggaatggaataattaattgaagaaagaaaaaaggaaatcgatcatcagaaggtaatttgtctagtactcctaattggtacatcgacgatctgcgcaggcgacgacgacgtacgactgactttattactgagactggagacttgtctatatataccgcgcaagctatagctgactcgctcctagctactccacatataaacatataaataaacagagctaattaagctagctccctcctgattatatatattgatggatggcaagagaagagacgagatagatagctagatgta

SEQ ID NO: 7834 - DNA, 1501 bp, Oryza sativa
gtagggtggttttattatgaggcggttttttagtggggacttcgatggcggggaaggatgacgatgactctacttttaaattagtatactagtgttgtgaccatgctatttcactgtaatcaaaacaatgtagaatacataaagcattgatacatgaatagcagatagtggggtcatagcagattctcctgcgaatattgtatagcaagcgatatggcgaacgttatatattccgatagcgaaataagaaaaccactcaattctgcatatttgtgaggtagagtagtgcttaatttacagaaacaatatcatattatagacgacatatgagttatggagataagtaaaaaaatgcggtactcttccttcatgttgaaaataattatctatttagacaaaactaatatcaaactttaaaaacattgactaccaataacttctaaaatatttgtctttataatcatggagaccatataatacacagattaatcttaaaatatacttaagtaaaagcatatatttattgatatttctacatacattacatacattgtagaagatcgcaaaccaaagtcatctgccacattgtcgggagcatacctctcatcaagttatcacatttcatattgtagcctttaacagaaattaggagttaatgcatttttttcaccgtgtacctatccaaaacaacaattatttttaacaattatttttaacctaaaaggattgtattttctataatatgtaccaaataacacctactatttttcacatagcagacgtaatattcctccaccattttagtagcacagcatcaccatggtaatataaaaaccacgatactgctatttagtaccatcatgcatggttataacataggggtgtatggggatagtcatgctatacatataaaaaacttgcttaatactagttaattttctagtattagtataattttttattttagaaaaatagaattgtgataaagggctggtttggtttgtggcctaacttgaccttaccaatttttgtcaataccaaattttagcaagttttagcatatgcaaagttttgtttggattgaagccaaaatagcctaagttaactattaaaatggcctatttttctaggtttggcagaaattgacttcaaaccaaataaacacttaacactattgaaattaccaaatattggtaaggccaatttaggacacaagccaacagctcaaaactcggctggagtgttgggccggcgtgggcttgttatacgtaaccattgttagaaagcgtattttatgggttaaggaggcgcactcgaagaaaggcccctccccccgttttccccttgtctcaaagcgcattttggagattggagtttggagtttggagagagagaaatgcaaatcggaatttgaagtttggagtcaccgccgccgttgaggtccgtcgtctcgtccgagtccggtccgcgcggaagtaggggcggaagtgcgggcgggaga

SEQ ID NO: 7835 - DNA, 1501 bp, Oryza sativa
aaagcacaggcaaacaaatctacgcaacgggaaccacctcacatctgcccatgaccgtgggcacggctgttcgaacagttagttaacctctgcagaggggtacactttacccacaagacacgaacttactccagacactggtcggtgtcagaggttcgcgacaaagcctttcccaagccgacccagggttacctcatgccacatagaaggatcaaatcctcacgtaagtataggccattttaggcattcacaaatcaactccaaccaccttgatcggtaagtgagcaagcttctcgtcattgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaatcatgcaagttgcaaacaaaataataatgacttttcaattataggggcaattgatcaaagggtgacttgccttgctcaaggccttcacggagcttcacgaatcttcgagataaccacgatcgacgaaaatccgcaaccgtaactatacgcaaacaatagaaaacctaaacaaaagaccaaaagaaggatcctatttagactaattaatagtgccattaaatagatctcaattttatagaaatactggaagtggaacggagtcgatcggagctacggatcgagagatatgaatattggaagtttatctgaattttctggacaaggaaatgatttgtcgaatttttctggaatacgagagatggtttattgaattcgtggaaaagaatattcttggaatattctttaattactcattgacatgtggggcctacaaaaggtgagagaggagtaaattgggagggagcagatatggacttttagctcatgagagatggacactgacttggacggagggaggaaatatggacttttaggccgagcgtgaggcgcggcccaatgggttgaaggaggctcggccaagccattgggccggcgcgggcgcaaggaggcggcccattaggggcgcgcggaagggagagggggcggtccgggtggaccgaacccaccatgcgaggtcccgggtggggcccgcatgtcggcgacacggttcacggaggga

SEQ ID NO: 7836 - DNA, 1501 bp, Oryza sativa
ccttccctttcccttcccatggaggctggcttaaacaaattaaatagccagcaacttacatccattctaaaatatagcaacatagtgttcaggtttgtagtactgacatgtcgtatctgatactagattgttatataatatgacggagggagtagttaatatttttttaggaaaggagtagttaataaggtgttgtattatatttttttttacgaccagagtagagaatgttaatttcattaaatatagcaggagaaaaaaaatataactgtgcaagtaagtacaggttggtatattagtgttgtttagcacagaatatatatgtattgactatggtatgtcacagttaattaattactacctccatattgtaatgtatgatgccgttaacttttcgtccaacgtttgaacattcgtcttattcaaaaattttattgtattatcatttattttattgtgacttaattcatcatcaaatgttctttaagcatgacataaatattttcatattttaaaaaaaaattaaataaaacgaatggttaaacggcgtcatacattaaaatacggatgaattaattggtagcagagaggaaactatatatacaacatatatactcagtaagttgtacgcgcgtgcacaggatatattgatcgactttggcatgaattgatcgatgggtggatataatcatcagctggtccaatatatatgcatgcgaacctgatcacagttaatataatcatgaggcagcgagatcgatcgagcgacgagattattgaggttgaggaagcagtacggcggcgcctgccacttggaggattacaccggcttcgaacacgagcacatgccgcgtattgccgttgaatatccagcggacggggcggccagtggcgacgtcggcgtccacggtgtcacgcccgatcgaggcaggatgccgacggggaactggaaggtgcggcagctggaggcggcggtgtcgaagaggtaggaggtgccattcacccactccacgttgtacagcggtggatcgccggagagctggtccctgacgatgttaaggtcgcggccatgcggccagtcgtagtagatctcgattagctgcagccgcccgccgccgcggtcgtggttggtcaggttgatcgacaccaccaccgcgtggaaccgctccggccactcgtacgccgtcgacaccgggggagtcagcttcttgctgcctctggccgccgcggtggcgccaactccgaggagcaggaggaagagcaaccaccacgacggcagcgttggcgccatctatcgtcgactctcactactcgcgggtttatcttatctctcggagcggcgcgcgggttagctacagctagaggatcacacagtaataattaataattaactagttgtaaataaataaaggtagtactcgctagctatgttaaagccgggtcggacgaggtgatatgcacgtctgtggctgcaatgcacggacctaaggccccgtttagt

SEQ ID NO: 7837 - DNA, 469 bp, Oryza sativa
  unsure (1)..(469): unsure at all n locations
agtatataactatttgattgataattgaccggagaataaacaagagagtcgtgaaaaatcatactatactttactgtatatattcttcttgtcgtactcccgtttcagcagctcagccccatgcaagcaaaacggaagcaaccagcaaccagtctttgattcgtgtcaaatccgataggtgcttcgagagcgacgaccgcgtgcggatcaggcggcctctggcatctgccatgtgaagcccccaccccctcctccaccatcaggggcgcccccggatgccttacggtgaaaaagcggcgaaagcgacggaccgcgttgttgggtttatctgcnnnnnnnnnnnnnnnnnnnnnnnntccggctaaagcgtgattcccctagcgttgtcagcggcgcggcggttggttacacggttacaactggctttgagccgtcgccaagtgtaataggcagggcagattattagtga

SEQ ID NO: 7838 - DNA, 801 bp, Oryza sativa
ttatccctgcataagtcaggctacaatagcacctggactacatgcagggattacaaaataggtggtaaccacatttaccgcgttaaccctatcaaattcaaataaattttaaaagtaatttgatttttttaataaattttgtatggtttctcaagctttattttgggtaccgtgcttactgccggaggcaatgggaaaccctcactagaagttgcacctgttcttgtctgtgcaccatatcatgttgaatcatgtgcgttgtgtcctttcggaagaaccgatttactacatgactcatcaattccactttacgtatcaaaaggtttgttatgggggcaatgcttttgtgaaattaaatttttattttgcgtcacgttgtatctagttaaacactacctacctaccattacaaaacctcattccacaaaacgatgcatctagataaaaaatatgacatgtaaagtgagtaatgactcatgtttattatcaaaaatcgataacaatcaaatgatataggtagtaaagtacctttgaaatggcatgtccaagtatgtgtagctccacctagcacaatatcccaagtgatcatcataaaaggcatacaaatacaagcagccgatgatgcacacaagaaacaacacaaattgcacaaaaccaaaagcaaccgatgccttgagcatagagatcatgctattcccactataaatacaaatgcaccatatcaagatgctcctcacccttactgaaaaatcacaaacatcaaaacgttataagagttctctagcatccatcacatagcca

SEQ ID NO: 7839 - DNA, 261 bp, Oryza sativa
atttttttcttgagatccccctattacatggccctagggggctatttatagccccattacaggttcccactactagggtttaagttatacatgggaatttacatggttacccttatgatagggatattatggagggcacactgtgtcctttacacatacgggcccctactgggcctaaatagctcggcccatctatctggcgaaatcccccgagggcgtagcggcccaccaagcctcccccgtcaacggggtttggtgcta

SEQ ID NO: 7840 - DNA, 298 bp, Oryza sativa
gtggccgcccctccctctgtctccctgaggggtcgggccgctcccgtttcggccccgagggttggggcgccccgaccccctgtgggtttggcgccacgtgtgtgggttaggtgagcacagcggcgctcacctaaccgcgtttattgcgggttggacgagcgccccacgccgcatttaatgcagcgcagcacactcggtccgtgacaggtcacagtgtgtgaccggtcacagaccggtcagatcgcgggttaggtggcaacaggcggcctttcgcacgcctcgccccgtcccgtcggaa

SEQ ID NO: 7841 - DNA, 1501 bp, Oryza sativa
ccccattctgcagccgcagccgcttcgcccgcagccgcagccgccgcttcgcccgccgccgcagccgttgctagcactcgcggccgcgctcgccatccgtccccttcaacttctacaagcgactccccgccaagtccgacgtcctcctctgaacaatccaagtatccaactactacctacccattccgttcccttccgtccttgccaattcacactcatcatctggaccaagtacgtgcagcagcaacaacatacagggagtttttaccggccgccctctactctcaaaattcacaaggcgcgcacacgaggtccagtcccgggcggtagtagacacagacgcagacagtcagctttgcccgctgccgcagccgctgctagcactcgcggccgcgctcgccccgctgctagcactcgcgtcgcgctcgcctccctccgcgcccacgccatgccgtggacgacgacgatggacgccaacgaggatggacaccaacgaggatggacgatgccggcgacggactggcgtcggcgcgggcggtggcggactgacgatggcggtgccgggcggagaagacgacggtgctacggacggaagagacggagtggcacggaacaaaggaaattcgtgctccgatggcgtattttgaaagtagcatgaattggatggcatattctgaaagtagtgcgaattcgatggcatattctgaaaattctctgtgacgagcggccgggagtgggagtgggagtggggacgggattagggtttctccatatatatatggtctctcattggacctagagttgggctattattttctaaaatggactgacacctaaggaatttgctcatgggctgatatggcttgggcccccatggggatacggggcctgggagcagtggagcgctcctacccccgccccacccgatggggcctaaatttggccgttctttaccccgtgggggaggatttcaccccattaactccccctaatagaggaattccccgtcgggtaccggggccccattgccacccctacgcgtgactcgcgtcgtgtcatgccgcccccacccgtcaatcgctgattcgctggcagaggccccccacccgtcggtcactgattcgctggcagggtggtcccgcgtgtcattgggtggggacagtgccgaccgcctcctgggcccacatgtcattgggtcgtctgctactgatgccgccgcctataaagacgaggcgaggcgaggcgcggcgcgcacgttggtggcgttcccgagcccgagatttcaggggagcagatagcaaattcgtacaagttctgaaattctgggcggagaggagacagagagagagagagggggaaaggcgccgcgccgccgccgctgctctcctccggtggtggacggtgtgtccggtccggttcgccgcgccgcccttgcgtgagcgcgagcgtgcgtgcgtgccgcggagaggaggaggaggaagaggaggaggaggagggggaa

SEQ ID NO: 7842 - DNA, 1501 bp, Oryza sativa
ttctccctcaataatagtcttccgctgcgattttagtccacaaactggagtagtaatttgctcgtgttaacggtatcactgctacctgcagtggcatggcacgtgcacaaaacgactggagtatatctgttttcattttctgtgttcatggacagtacttttctactttcaagcagaaatacttgtcatgtgtcatgctcaatttatgatggccttactgtgtagtaaatcaaatggggaataagtacaggcactagtagtacactagcctgctttaccttgggcgtgcaatgttgttaaagtggctttggattgcttactggggttccttaagagattcattaagaatttgagatgttaccgtctaatctttttaatcattttaatattgtttatggttttatgttccctgtacaaataacaattttatttaagcgactaaaggaggaaggcacatcaacacatgtatgctagacttgtttctgaatttctcttctttgttggtttaaattgggttattctctcttttaaaatgaaaaatgtgttagtcttttggatcatttcctatatatacaaaataagctgaaaaatatcaattcaataataatagtataatgtattttcactgaagttcgtatagcgccaactgcacaaagcatctttctttcagagttagtggtcttgtagtagttcctcttagctagtactactacatataaaacagtgcattgaatctatagtactatgttgagcgtttgagctcatatggaaattattagtgaatagatcaactgaatcaatagtcaacacgccctataaattcattttggacttgaaagtaaatgcaagatttttttttattgttcagatagagcattcccgcagtgggttggaaccattggctgttgctgcaattcctacaatgaagtataactgtgaagctttccattcggaagatgacacccagtaagtacaatcgtcaccatctgaagtaaatattattgaacttctttatagtgtggttcaatgcatataatctgcttctaacatgctattgttagaaaaactatggttattgaaaaatattagcacaatgagttaaaaggtttgttagactttgtggaattcatatccttgtggaaatgttggaatttagatgtgcttaatcgaagcatatttaatcaatatgtacaatgggtagagatattatagattatcaatcatacttcttgttgatgagataacataggacaacacacctgtagcttttatcagtttttttgcagtaccttgggccttcgccaccagtccagatttaataggaaccaatttggcagagttgagtcttatctcattacgttgtcaacctgggttcagtttagtcttacttcaagtaaactttctatcattatcatctctgcttgcagccatacctcttaaatttatgatgcatccataattttttttttttgtaatatataggatgttttgttgtaacagg

SEQ ID NO: 7843 - DNA, 905 bp, Oryza sativa
  unsure (1)..(905): unsure at all n locations
actagtggatcccccttcttgacaagtgtggtaattgtgctactgtgcatgtggcctgtcagtccagtatttccttcatatataacctagaataattttacctttttatattgacatataattttatcatttagccaccataactaccaatgtatgtctcataccatgatacatcggaagtaaaatgagtaggttatcggcatcaatatgtaatctttaggttaatactcctactccctccatccataaatataagggattnngagtnnnngctngcnncgnnggnccnnctcgccnncncncgggcggcggggcgncttggggcggggccgcgggcggngcgcccggcggcggcggggccggggcgcgccgggcgcgcgcccgggccggcgggggggggggggggggcggggggcggggggggggggggggggggggggggggggggggggggggggcggggggggggggggggggggcggggggcgggcggggggggggggggggggggggggggggggggggggggggggggggggggggggggggggggggggggggggggggggggggggggggggggngggggggngggggggggggggggggggggggggggggggggggggggggggggggggggggggggggggggggggggggggggggggggggggggggggggggggggggggggggggggggggggggggggggggggggggggggggggggggggggggggggggggggggagggggggggggggggngggggggggggggggggggggggggngggggggggggggggggggggggggggggggggggnggnnngngggnnggagnnnnnngnngnggngnnnnnnnnngnnnnncnncgcggcgcgccgccgccgcagc

SEQ ID NO: 7844 - DNA, 1501 bp, Oryza sativa
cacgtgtagcaaatcaagcaatacaaggatgctgtacgtcacgtctatccacggaaggtctatttgcgcgcgtctcggatcttactaattccgtttcaaaatataaaaacctattattagatactacatatcacaatactataaatctagacatatctctatctagacttatagtattacgatgtatcttatccgatcataagctattatattttaggacgaatgaagtggttgttttgttgtccgcatcacgcatacagcttccacaggcggcacggagaggcaccgcttttaccatcagacttggtctctgctggggaagcttatgtcagccaaaatcagatattctcttatcagtttaattttttattctacaaagttatagttgtgtaatttaagggcctgttcactttgatgacattttcaacattactaaattttggtaaagttgtcaaaaaaaaaggctacatttaatttgctgtcaaaatttgataactatgtaaaaaatcctgccaaaaatttgacaactataccaaaattttggcaatgccaaaatttggtaatgtttttttttgttattaaagtgaacaggccataaattagaagccataaggtagaaaaaaaacccaactttttttttcagattctcgaaagtttacaaccaattagttatttctcagaattttaagctcctcaaatagaccctcggtgccgtaagtgcgaacctgctctggctcaatcgcatagagggacgcgctgcgcacagcccgatgcttttctatagttccatagtccaccggttaccacatggacggatgggatgatgggagagttttctgtaatgctcacatttattgtatcttactaaacccacttttataaatacatgacagcattgacttttgaacatatattatcttaatttttaaaaaataaattaattattatttattttgttgtgagttttttttattgaaagtactttaaacatgatttatattttatgcatttcgtaaaaatattctaataagacgaacaatggtatgtattaaaaaacgagagtatttaacattttaatctgtactatcattcgcgacaatttttttttcaaaattgcggagtagtacttcacatattggcatggagtacatcagacgatactagtacagcatacatgtcgtggcgttcaacttgttggagatctgatgcgatataaatcgatcctacgtcacatgacagactggacccttgtcaaaattatggattggatgattaatcactgataggtagtactagtagcaactcaatcacacaagcgaagtgagaagaaaaggaacctcttcctgcattaagacaacggcgacggggtcactgaaagtgaagcctgtggcgcacacgacacgacctcctcaacggatctgtggcttacccgtcgccgttagagcgtttgctccaacgcttctgcagtacaagagtacagctgaaagccatagtacactga

SEQ ID NO: 7845 - DNA, 1501 bp, Oryza sativa
gctataaaaatggtcactaaatcaataatgaaattgaattacaaacagttggatgatataatacaggttttttaccaagcaatcacagcatagcacaatggggctgaaatgcctgaagagttacctagactgtttggagcagttggagcaagatgacgccaccgcagtgttctttccacgaattccagcttgtctttggcatcagagtacttgtagaggtcatctatgttctgtccagatgttccaataaacctacatgcagaacttccatacttcaaactccacagctgctttaattgaggaaagttaaaaaaacaccaacacccaccggacactatcaagctcgaattgatgtggattcgagcacgatgaaaaagtgttataagtggctgctccagcaaaaaggcatctatgcaaaggctgccaaaaaaaaagcaagacataagttagtcatgcatgcataaaaacatgcttgaatgttactagtgcaaattagtcattatttttccatgtcaatagcccacctgttgaggcaaagaaaaatttgctgggtcattagatccaggcatcatgtccacaggcaatgatgccacaagctgcagaagaaatggattacattcatactgacatcataaacctgaataattaattgcgttgataatatttgaggggggagtaaacggttgaaacctgagtgagcattatatccaattctttgattggttcagctatcctggattgatctttcgatgctactgcctgaaatatcagtgttcaccactagtgcaataaactaaagctatggagtttcaccaaaaacatgtaatatgcagtgacattacctgaccattgaagaatcttggagaaatatgtaccgaattcccagccaccacaacacgtactatgttggatgctatggattgctcctaattaaattgcaaagagatcatctaaatttagtgcatatcttcacttgaaaaccttcattttgggaaaaataaaataaaaaggcgcatacattctcatcacccaaatgccctgtgatatggtctataagaagttggaattgcagaggattgaatttttcactcccaatacttaatcccgacacaaataccacatatttgtcctcgtctgtaacagaggtaaatgccaatgtaagagatctaaccatcaaaacttgtgtaggcaaatggggaaaatggagaatgagcaagccaggataggaaaaaatttacttatgctaggtaacgtaatttgaggaggaatcccagcctcaagaatatcttcaacaagaaagttgccagcacttgtttctttcccatgtaaagctattacaactcctgtggacaattggtgggtgagtattccaagcaacatgatatattggataaaattgttcgacaaatgctacaatcataaagaaactagtctagaatttgcaaacttaacttttcagtgaaaaatatcagacataccagtaacatatgctgctggaggt

SEQ ID NO: 7846 - DNA, 1359 bp, Oryza sativa
cgcgccttttatagcacggggacgcctctggttaggtgcgactcggacagtttttttgcggctgggcccccggattcctggagtattacacaccgacagaaaaccacccctggtttcttggttggtggtgtctcgcagcagaagcggtttggggattgagagacgatggatttattcagtcaaaaacgatttgcattggcttggcttctagctggagctgctgtttatatatactccctacgttccaaaatataaacatttttagacttcggctagtctccaaaatactactttgagtaataatatctataaaagtaaaatattttaaataaaaatagttgcatattataatagtttgtttaatgataaatctaataacattaattttatatgattaatcttttttatatttttgctattaatagttaaagttaaaaatatttgatttgtcactatgctaaaaatacttatattttgggacggatgggtacatatactccgagtccgatccaaattcagttcagactaattcactgacagctacagatactagttttgtaatactactagtaaatgatttcggtttgtttatcctgtacaaatcgaagttagactgtctttcctcggcaggggattagttgggttaattttaggtgttgtctgattggtcagagttcagctggttgtgtaatgtgtatgaaattctgtggaacgttttgaaatataaatttcgtaaacatggggagagccaagagctgcaagcatattctcttctgcaaattcgaatatggtacttccagaaaaaaggataaagttcagaaaatttggtaaaagaatcattagctttgaagataatgttccccatttatactaaaaaaatattaatatgtactggaattacagatgtcgtcgaccagaatatcgagtaaggttgcgacgcaattatcatatctcttcaggattagattctaattagcactaaccctaaggtgtaacatggaaacatatcctctcagcttcccagcaatgcaaatacagtagcaaggccttacctaataagaccaagaaacaaaagggaaatggagccccattggaagccagcccagacacagacagggacgccctaccattgcagggggcacacatgtcatgctgaatttctcatgaggctaggtttctgaagaaaccgctgttgcgtcttcagaaatcaacctgcctgctgcggggtcggtgccgttctgtgcttagaaacttggagtgccttcgcctaaaacgcaataagaaaaggcagaaagcctttgacctgaagccttctcagccacatgaaaattagcaacagtttaatctgctttcttgcga

SEQ ID NO: 7847 - DNA, 225 bp, Oryza sativa
tttgatttaggtctttgtcttggtggcttctgaacagaggcgaggtggctgccgcctagacaagcttctgatgatttcttccccttgctgcggttcttggactccatgcttgccaatcggcgctccctatccatgaaggccctgcggcggctacgggagaaggggcgtggtcggcgtggcctggcggctgcggtgggaggagcggcgtcatcggcgtcgtcggca

SEQ ID NO: 7848 - DNA, 1501 bp, Oryza sativa
gtggtatgatctctcatatcaaccacttgcatttttctttaccagtttataattgcattatatcttaagttgaacttgcaattttctttttaggcggaagatgataaggatgatgttgctagcaactagatgatttccagagagtgttgttgctagcaactaggatagtagaggtaagacattttgtaagatttctgtcttctgatgatttgttcaaatgtatggtgtggtgaggtccaagggtgtttatgtttgtaaaaatatgtatacaagtatgtagacttgaagacaagaatactcatgtaagattatctaattttgtagggactgctagatgcttggatggctgtcaagacattttttgaggctgataagatcttttaggtggctttgaagacaaaatagttgcaacttcaaagggcttttgcttttcttaacagcgatgctattatggatcaatggatattatttatcgattatgcttatgcatgattggatctaggatatgtggatcaatgaatataacagactaatactagaacttgctattatgctatttgctaagtacttgctgctactatgctatttgctgagtatgttatctgtgagagtgtgactgtgaatctgtgatgctattttaattaatattcatagagttctctgaattctaacaatctgtgaatctatgagactgtgatcttattctgtagttttgttttcttattacgtgactgtgatgcactcatgcacacgcacagatggactgatggtggaagcctggttcattgagttaacgagctaatcaagctcaacgagccagctcgccgagtcagcgtttgagctcgttagtcttaacgatccaaaccgagctagctcgttaaggtaacgaggcaaagcgagctgagccgagccgagtggctcgatatccacccctacctggttgtactactagcaagcagagtggatgcgggcggcatgcggctgctacagagccaagccagcgcctccccctgcctccctcgctgttgcatttgccgccacaaatcaagtggcagttagaaaagctaaaatggatgaaaaaaacagagaaaaagaaatcctaccctccatagcgagcagtggtggtctgcactctgcaggcaggcaggcacccaggcctgcagctcgatggcgccgccgccgccgtcgccgccgcgatctctcacctccgtctccctccggactcctctgagccctctcctcttcctacggccagcttcttgcaatccatcggcggtctccggctcctgcagcagcggagcatgccgcggcgtgcgctgctcggcggcgaacaagccttctccttccaccgctccgggcaccgaggtaaggtagccggctagccgccccccatattcttgtttctgtgttgatcggagctcgatggctggggtgctctgggctcgtcgtcgtcggtcgatcgtcatggcttgcttcgtttcttgcagctcgacctccatgg

SEQ ID NO: 7849 - DNA, 1501 bp, Oryza sativa
tgggttctgtcgcaagtcccagcagctgaaggagcagtcgtctgatccgctgtataacaagtgtggatttgcacgatcaaaatagcaagtccacacttcatactgatgagcagtccactgttctgatacctccaagcggtcctccctcatggaaaccacagacagggaaccatccgataatccaacggaaagtgccttggcagtttggttccagtccacaaacaagcacatcgaagaagaaatgtctccagaacagacatccctgagaacagcacctgcataattcggtcacataaagcacttgaattcagcctcaacatataagaaatacatggtggactacaaatatgacaaatactgaggtgtttacaaatagctacacaagctcccctgcttccagtacagaatcaactagactatcgtggcaatttaactaaaaaatcaagaccaaatttgatccagaaatgcaagaatacgaattgacttagaacatcattcagcagcatattgccttattctcaaaagaagatgacagacacggatcacctccagaagggcagaatattgcatagttgaagcaacttcttgttaatccagattaaccactgggaacacatccactcaatccatgagagtaagaaacccatttcaccaaccccccccccaaaaaaaaaaaaaagcataacccctgaacccctaaatacttctgcaagcatcaggcaacattcacatggatgatagaacgctttcagaatcctaagaacttgaatttgcctttggcatcagtagcagtgcatcactatgttcagtaaataattcatggaagcttagtaagtggatagtgatccaattttgacacagcagacaacttatttgattctatggtaatgcaaatgcaggaacaaacagcacctttgtccgatccgtcctcctgctccaggcgccagagcgcgaggcggccgtgggcgtcggcctgcgcgagcagaggcgccacggggctccacttcatgtcgaacaccccggcggtctccaccgtgtggagcagccggagcctccggggcgcgtcctcctcgccggcgtcgacggcgaagagcgacacgctgcccgcgcggtcctgccgctccccgccctgctcctgcagcgtgtaggtggcggcggcaacgacctggcggaaggggccgtgcaggcataactccaccgattcagttttgccgccgaagtagcacgaccccaaatccatcgccctggaaaaaccctcgcgttccgcacgacgcggttcgcggcggcggcggcggcggcgagagtcgagagcgctttcacttccgcggcgaggcggcggcggcgggggcaaaatagtcaaacacttagtccataccggtcactatatacctatcctgactggggacgtggcggacacccatggccaccctagccgccgcgatttcggcgggccccgcggcgcccgcccccgccgctcgccgccgccgccgccgcgggttcg

SEQ ID NO: 7850 - DNA, 1043 bp, Oryza sativa
ctgcagcccccttgaagcatcggtaagctaccttaattcagattaggacaatgcagtgtaaatgtgtaattaactgaattttcaatactgtttttagtagcttactgaactgagaccgctgactttgcatcagtgcaacacaaaatttatttagtactggatgtttcagactttcaggtttggatacgtggaattaatttcagggtctcccatttgtttcggcctttctgggaagcgaagtgatcgaaatgaatgcagcgtgcgtgtcctactgcttagcttagagatcaggataagattagctgggatgtaacatctcgccgtagctgttgcttgccagtactgtaggcgggctcgtctgctgaaatagctgcatttttcgacctgatttggtgatacgtagtacgtgcttccagctcctgttgaattcaaccaagaattcgcgttaggtgattggtagtaatagtagtactttggtgacggattaaaccaaaccagggattggcgacgaggcaacatcatcacggcaatacgaaacgattttggcactgtttgattgcgacactctgtcatgtcttgtactcttgtatgcttaagaacggccagttcggacagtagtaccagtactcctgtatcgacgctttagccataacaaaactacactttcaaataggggacacaaattttgtccgctgctcaaattatggccaaaattcgtatctgccgcggatatttgaggcaagctcgtagcggggcccactgctcatggagtccagttcacacctcaaaaggctttgcaaccaagaggggcctaaaagcgagaggttacgaaaaaccaggggtgtaaatgcacaaaagccacctaaagcccccccaaccaccctggcattcgtgtctcgctgcgcttacactccccttctccttcctccagatccggccactcccctcccctccccctcctcgactcgcctcgccgctcgcctccgggctcgaaaccctaggtttggtcgctcggggtgtagtgggtgggggcgggggggaaa

SEQ ID NO: 7851 - DNA, 1501 bp, Oryza sativa
aggagcagtccgctcctagaaaggacgtaaagaagaagcacaaccggatatacaagaaagagcttgcactctcattgctcctcctaaccgctgcagctcgcagtttgctctcgaaacagggtatacatttctacttcctcctgttccagggcatatctttcttgttagtaggccttgatctcataggcgagcagattgagtaaactgtgaaaagcatgatagatgttaaaaaaacagtgacaatggagggtgctccagggatgttgtgtcgaagctctttggcgatattgaaatgttgcatgacgcaattgtgtcgtccaattgatttatgtcacgacttcacacaacatgatccacaatgtacacgcccaaataggcccctcccccctcggttgtgtagatatagttgttcttggactgtaaatttgcctagttattccaagactatccgattcttttgtaaaccaattttggtgttcatgtggggattttatgttaggaggcaattactgcctgtacgagtgattcggaatccacaatgcccttaattagaagccattccttccttatgtgtctacttctgaattctgatgaccatctttgcccaacctgctatgttggtcaatctacctttgctgatgccattctgcatgactccagcaaaactgatactgtccattacaatgtcacatgactggaagctttattttttcctcttaaatgtacgcgtccagattccagcaggtagtcaataaagaagctgcccttctgataatcgccgagagtataaatgttgacaaacttttcaaaaaagtgtcaaaaccggaagagaacttgtgaaacggcatgctttttccaagtgatacaactacactacatggtgtaacgtacaagaccagaaaacatcatcctacatacagctggacaccaccaccacacacctgctgctgatgtagtatcccaattccatcccagttgcccaagaaaattccaatccggctcaattcaggcggcagcagcacacacgtctccagctgaatgtcaattacctgaatctataaaaaataggagtcccatctccatttcaaggggccagaaatgaattccagatagtgaagtgagatggaaacaaaaactaataaacccggatgttgtctcaattggagatgagctgtgagtagccgagaacggtggcggcagcatcagctgcagatagtgagagaccagtgccgagtccatcgccttatctgcacgggcatgtggccgggagacagctgtgtcgcgccaaggcgtccgtccgtccggcccttctgctggtccagcggctgccgtaagcgagcgtttcacatgacgacgctttctgtcgtgctgaactggagatacaaatcattactgtacaatatacaatacaccaaatgtcctccttttttttctttttttttctttcggtagaacaacaattgtactaggagtgagtattaggtgcgagtgctcgagtgca

SEQ ID NO: 7852 - DNA, 1501 bp, Oryza sativa
acatcatgtgattaaattataaaaaaatcatgtgagatctttttataaaaatttaattataatgaataaaaagatataatcggatcgcggatcagataaacagtttaaaacataaaatagttaaacgtatgcaaataaagttaacaacctagaacctaggcatgatgcacggtcaatatgtaagctaagcacagtaggagggctatccgatctttagaatattatcggacatccgatggttagttggctcctaactttttttccaaactaccaactttctctaaacttctccccaatttcaggaactaaacacagcctgtataacacatgtaatgcccatatatgcatctcaccgttgagacgataaacacaattaagatgtttgagaagaaaattggttctgttagctaagctgatgaatcaaaacattctaccacaatttgcatgcaaggaggcaacaaaatgtgccaatctcgtaatcaccttaggtagaaggaagcttttttaagtttcactccaccaattcataatatgaacatacatgataatgtgcacggtcacagctgttcttgctaagtaaatgagaaaagaaccacataaagacatggtttactgaagtccataagtcagtaacattcaatccacatgaatccggcaagcattttacactttacatattctaatccgtcaatttgcactcagaagatggctggacgtatctcacaaaggatggctgtgcggagggaatgagttcccaagtcagagagtagtgtaggaaaacacatgagagggcgacgtcctctgtgacgcgcggcgaggcggcgaccgatgacacacctaactgatcaataagaccacacgtctgagtacttaatataagtttcgagggagcgtatcctatgcacataggccctcgcgtgtacacaccgtgtacaccaactaaaaattatcacaaaaaattttagaaaaattcatacatgcactttcaatagtattacatctacatgcaaagtcgcatcttcaaattcattctacatagagaataacaaaaaagataaaattctgacaaaattgtaaccttaaaactgtcagttttttttgttacggctaaaatataatgaatttgacgttaagattttaaccctaggtgtaatacaactgaaagtatgtgtatgattttttctagattttttggtgacattttttagttggtatgcacgtgtgtacacgtgagggcctgtgtgcataggatatgttgccaagtttcgaaccctaagtagactatataaatagagaacaaaatcaaaataggggtacttacaactgagtagtaatgtactccccgtcaaaaaaaactaacctatgatagaatttgatataatctaatataacgaatttgtatatctaatcatatattagttttttataagataggggaggatgcacaagcagttagcacagactgactgcacagggcacgacgtggcatgcttcgtgtagt

SEQ ID NO: 7853 - DNA, 1167 bp, Oryza sativa
ctagatacgtgttcctcgacttgcaaaaccaaagcaccttagggtccttaggtcctaaaacagtattgtgttcggttttcgctgacatgaagaatctattatattattaaagaaatagaaaaaagagcctccacgttcgctctcatggcctagaaattctcacattaatcggagaaaaagaaaaggcagagtgcatatagaaatacaatttagaaatagttgaaattcgtaattaaaaaataaggaatattagaagaggagactagagtccatatagaaatacaatttagaaatagttgaaattcggaattaaaaaaaaggaatactagaagtagagtatatagtccatatagaaatacaattagaaaataactgaaatttgaaattaaaaataagggatattagaagtagagtatagagtccatatataaatacaattaggaaataatagaaatttaaaattaaaaataaggaatatttgaagtagattatagattccatatagaaatacaattaagaaaaaaaattcgaaattaaaaaataaggaatattggaagtagagtatagagtccatattggaatttaaaactaactaaaatttggaataaacataataaaattaaaagtagagtttagagtccgtataaaaatataatttacaaataactaaaattcaaaattaagaaaaacatgggaataagagtttaaagtcaatatagaatacaatttagaagtaactgaaattcgaaattaaaaattaaagaatattgaaagatgagtagagcccacgttgaaatacaattagaaataataaaaattcaaaaataaaaataaataatattggaagaagagcatagagtctatatagaaatacaatttacagaaaattcggaattaaaaaaatatattaaaagacgagtctagagtccatataggaatatatataatttaaaaataactaaaatttgatattaaaaataattaataactaacacgtatataaaatataatatgaatattgcacattagtagttttgtaaagttattgcaaaatttaaaattatattgtcattttaatatatttgaataatataatgagaaaacatatatgctattatatgagataaaatataatgatgctagccgcgcaatctgcgcgggtcacca

SEQ ID NO: 7854 - DNA, 1272 bp, Oryza sativa
tggtaaggttgaaaagggagtacctatacatctttcgaaagatttttatgatcgtatcacacagatttttaatctttggattaaaatccgatagatataataaaaagcaaaaagcaattaagaaacaccataatggacactaaattaccataacctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgggttgaaaatgacatcaaagtgaaaagcccttaaaaaattcgtctcgtaattttctagcgacctgtataattgtttttttctacatttaatactttatatatgtgttcagacatttgacagctaaaaaattccatcgcgtgcatgtgtgtgcatcgtgattcgtgcccgccgcggatacgacaataacatatgccgtgcatgccaggtggcggcatccgccaccaccaacggcgacacgtaggacggctggagggtcccgcgcgtcagatccgggctgggcttgtggcgcacgcgcctgacacgtgcgcagcgtccgcgagccatcgatccggtgcatcgcgcggcggccatttacttcgcgattaagctaaagacgaacgacgacgaggtggggcccacgcccacgtcgcaccaaccggggcacccacaaaagcagcgcgaccgcgacgtcgtcatctaacgcggacgcccatctccaccgtccgatctcgccactaggagtgtttccaaccgtcggatcgtttgcgcgcgtagatacggatatacttgtaagcgaggggtagaatctctctctcggtgccacagctttaaagttagtttttaaaagttacggggggaaattttaactctcacgaagaagaagaaaccccacgtaaccgttgggcccgcgaagtgggtggggcccactgctcgagtgtcggggtatggtctcgggtggtctgcctataaataccagccatttcctcatcgttcctcccttttccccgattctctacttcccccctctagttttctgaaattgcggataggtccttcttttttgtgtgttgggacttgggagagtgagaaaaatgctgtcagtgcaggaggcgcttgactttgacctggacgcgatgacgtccgggttcgggttcacgcc

SEQ ID NO: 7855 - DNA, 1202 bp, Oryza sativa
aataatctacggtacaaactatctccctacttttcttcttctataaagtcataccaccttactttttacgtttgaatcaccattctacatactatttaaatttaaattatcataaaccatattgatttacttaatctgatattatctagctatcttacacattatttttttattgttatcatactaaattttcgcagcaatgtgcggggtttcagctagtatcatatataacgtgtccctagccttccccttcaccgattgactagcagccagctaggcatggaactcttccgacaactgcgccatggagaccgtttcgttcctccgcgcttccattcgttccactgaacaaggcgcgcgcattttaatattcaacgctttaaacatttggccaataattattttattataaattaaattttatttgatgcaattaatattattgggttgacattttaatttaatttcctatgattacgatttttcttataaacattataatatatgagaaatttattttatatatgtgagagatttatggttaaagattagttttggagccatttctaaatttgacagcaccttattcggtgggtagggcattttttttctaaagaaaaaactatatatacagatttcttggaatactttatatgttcaatgttaattcactcatttgtgcccttaaataattgtaacaaaaccagaataatctaccatccgtcctccacagtttaaaacgaatgggggctatttttttttcgaggaacaatgggggctaaattccatgctgtgaatttcatcgtctttgatttcttgaaaattttgtgattattatattttatttgttgtttcgagcagaagacgtacacttctggggtgtggcaattcgaggcatacgggtacgtgccatcgggcacgacggggtgtccatcctgcaggtgttcggcgcgtcgggtcgtaacacgacgctgataccttgaaagattagggataagttatatatggtattatagttgagagacgattttgaaactcaccgacaagatgacaagatgagggacctcaatttaaccttttcctactgtgacgagtgtgcgtgcagcccataatgcatcagctggatgtacggcccgacccgtgtttatggtttggatcagatcaggccatggttaatttgtataatgcaggaatagatacca

SEQ ID NO: 7856 - DNA, 1501 bp, Oryza sativa
gaggaagaaactgggtctcatataggacacagcttcaacacgagaatatatgcactatacactatcaagttttacattgagagataatagtgtctttataatagatgaagaataaatatgattggtagagaagagagatgatgtatttattaatggcccattttaagaaaccatgggttgtagagtgtagtttctattgtaatgtcttattaacatggcaccatagacacggtttatgtatactatgggttgtgactgcctttatatactacactattaatacttgatcctatttatcatacacacattgcgtcttgaaattcgtgctacagctggctataaatttatagccctctgctcatctctcttctctattatcttcttaaaatatatttatagctggcttatagcctgctattatacctgctcttactcgctgcagcattgctcactactgtactctcttcgttaaaaaaaaaattaaattctggccgtaaacctgaaccagcgtaagccacctatacgtataccaggtttactaaggcctgcttagttccaaaaactttttttaaaaaatatcacctcaaatctttagatatatgtatgaattattaaatatagataaattaaaaaactaattgcacagttggaggagaaatcacgagacgaatcttttaaggctaattagtccatgattagccataagtgctacagtaacccacatgtactaatgacggattaattaggctcaaaagattcgtctcgcggtttccaggcgagttataaaattagttttttaattcgtgtccaaaaaccccttccgacatccggtcaaacgtccggtgtgacacccaaaaattttcttttcatgaactaaacaggccctaaaccttgaggtgaggtcattgccacctacggagtatgaggtatgatttaacggttaccacgaaatatatcggttttaaaaactaagaagattatcgcacgtgatgtcgtgataattgtacggttttataaaccttgtatatgactctgtagtacaacttatgtacaattaaagacatgtaattatagattaattaaaaaataacatgttcatatgtctgtatagttgtttataatcgttaatcaaatttagtgataacgtgagtcaaacagttagaccgtatgcataatattttttttttgaccgaggatgtactcccaacccagacgagccaccaccatgctagctgctgctgctgctagcgttgcccagtgaccttgcagctcgccatgctagctccgctgctgcttttgcccaaagctgcaccccctgcattgcccctcccctgaccaccttgcctcatctgtatctccgcccccccccccccctctcctcaacctctcttgtgcttgcttctccattgcagctcacctccatctcctattctcctcctccttgttgaaggagttcgtgtgcctctaccaagaacaataagaagccttgcattggtagcca

SEQ ID NO: 7857 - DNA, 1501 bp, Oryza sativa; identical to SEQ ID NO: 3311

SEQ ID NO: 7858 - DNA, 1501 bp, Oryza sativa
agatcccattgagattaacgtagtaccatgaggtagaggaatgggaacaacgaggatattggtaaagctgaaaaggaaaacaatacaaccaatcatcagaaaataagattatcaacatatggattgcaagctagttgtatcatcaaaacaagtataccatgcatgtatgggctcatagtaaaaatttcaagacatcataaccgtagttagttcattagttaattaagaagaacatacaagaggcaatggtggtgatcccaacaaagaagaactccttgtaggggatgccttggctgctctccagcttccgttccatggcgcagccggggcagccatcatagaacaccgccctcatcaccggcgatgatggcggcgcctcctcactcattgactatttgcagtagctagctgacctgaaaagtcaagcagattagttgtgatagtcaggttaagtatacagctatgcactacactcagagcacacaataaagttcagataccgattgaaactaaaacgacagtggtcaactcgatcgatgttcagagaccggatgggtaggcaagacacacatccagtgatattatatagccatggatccatgaagttgcttctttgtgcatccatgctggttgctagctagtcagcaccatagcagcatgcatcaagcttgccggccgcttcagtatgtgcgcgtgtgagatattttaggcacctcatgccacatgaggctgatatatgtttctctttttgcaatcggcgaataatgaagccatgattattgatgagttaaattctagctagatggcaatgtacgtacatacataatgacaacaagccaagtattcatagtgatcaattaaagccgtgaaattaattaactcatcttctagcacattcagtgattcaggttttcgttgcataaatcataatctgtcattgttcatcggcgctacagcggcagagacagagggattcaggtagcatgcatgcgcaagagcaaatgagcaatcatgaaggggttaattaatgaaattaagaaacgagaggatcctatcattatcatatattcggggagaagaaaataatatgtaagcgctgatgcacgcatatatgcgacggctgtctgtattacttgaagtcaaatcagaagctacgcatgcatctgacctctctctgcatcgatcgatcaatactaggactacacgcatggccatgacagttgctagctgcaccaagctgtgcctgcctacctgctgattgttaagataagagttgttatctcatgtatattcatctgtagtttgttaagatagatagataaggttggtttgttgtaaactcacaggataaacttctgtgattcaatctcttgtaacagccacggtagaggctctttctacctatataaatacatgcgaacccgagacaaaggtatcgcttctcccattcattttacatggtatcagagccgtctccctccaccaaactcatctcaatttg

SEQ ID NO: 7859 - DNA, 1501 bp, Oryza sativa
ctagtgaggtgaggtttggccattggaactgattaatcaaaactaccaaccatccaatcaaatcaagcacaagaaaacatgtaggactaaaaatcagttgagtgctattcgcgacacagaaaatgggatgaatagctcgtaccaggcagagggcaggatgaattcgggtgcagaggcgatggggagtagctgctaatcggatctctcagcagagatcaatctctatctccgtaacgccgccgcctccgccatcgccaagggcaccacgaatcggggcgcggagcactgaggagccactggcctccgccctcctcgagcggctgccctcgttcgctcgatgagccgtatgtatccgtacaccacctccgtcgtctcccggcgcggcacggcagccacggccccgtttcatttggggaagacgagcggccaaccgccgtcatatttactagtaggtcgagaaaacggacgatatgccggatgaaatgccacttaataccatgcacaggataaaatactactcaatatattatctaccggatgaaaattgaaatgccactttgaagatttttatgcccaaaatatccatggagagagagggagaggggagtgccggccgggcgacgccggaggccttcccgggtggcagcgatggaggcggccagcattgacgacggggagaggaggacggggcggcgacgacgggggaggaggataggccttgccgagcggtggccggcgtggacgacaggggagggaggagaggcgatgacgtgtggaaggaggacgggcagcgagcacgcctacccgcacgttcgtcgggaggtggcagcagcggggagcagggggaggaggaggcgacgcggagggaggaggatggcgaggcgagcagcatcgcccgagcgacaacggggacgacggtctgaggctccagggccggccctggccctatgcagccgaggcgaccaccgggggcccatgatggtggggggccaactctgaaaatttaaaatccttcgatgaagtagatctttggtcgcactgcaagatttttgcgaaaacatttagggcccctttgaatcaaaggattcatgtaggaatttcatagaattcaaatcctatagaaaaatatcctatttggccctttgattcaaatgattgaagctctccaaatcctatgaaattcctatggaatggcacattacatgtgaattttggaggaaatttagcaagagctccaacctcttggaaaatttcctttgagtctatctctctcatccgattcctatgtttttcctgcgctccaatcaaacgaccattcctgttttttttcatgtgttttgcaatcctctgttttacacttcaattcctgccagaatcctgtgtttttcctattcctctgttttttctaccttgcaattcaaaggggcccttactcatgagaactcatccaatgtttagatcaatgatttttattcagaatcttcgatgtccgcgcctgaga

SEQ ID NO: 7860 - DNA, 1501 bp, Oryza sativa
cgactgagaggcatagatcccctcgatggcagaccagacctccgatgctcggggtgagcgtcgccacctgcgtgagtacctcccgtgacagagacatcaggagataactcagcacttgttgctcctgcgccacccattgggtgtacgccgcattgacaaccttttcaccagtgttgccgtccttgtcctgcagcaccaccatcttggaaggaggcttgatggagttgtctaggaagcccgccagttgggctcccctcaacgccgcaaggacttgagctttccagaggacgaagtttgtcttcgtcagcttctcggtgaccacctgccctaggatagcaggtgccgcagcagtggaagatgacgccatctaatctagatcaaattgagatgagtttggtggagggagacggctctgataccatgtaaaatgaatgggagaagcgatacctttgtctcgggttcgcatgtatttatataggtagaaagagcctctaccgtggctgttacaagagattgaatcacagaagtttatcctgtgagtttacaacaaaccaaccttatctatctatcttaacaaactacagatgaatatacatgagataacaactcttatcttaacaatcagcaggtaggcaggcacagcttggtgcagctagcaactgtcatggccatgcgtgtagtcctagtattgatcgatcgatgcagagagaggtcagatgcatgcgtagcttctgatttgacttcaagtaatacagacagccgtcgcatatatgcgtgcatcagcgcttacatattattttcttctccccgaatatatgataatgataggatcctctcgtttcttaatttcattaattaaccccttcatgattgctcatttgctcttgcgcatgcatgctacctgaatccctctgtctctgccgctgtagcgccgatgaacaatgacagattatgatttatgcaacgaaaacctgaatcactgaatgtgctagaagatgagttaattaatttcacggctttaattgatcactatgaatacttggcttgttgtcattatgtatgtacgtacattgccatctagctagaatttaactcatcaataatcatggcttcattattcgccgattgcaaaaagagaaacatatatcagcctcatgtggcatgaggtgcctaaaatatctcacacgcgcacatactgaagcggccggcaagcttgatgcatgctgctatggtgctgactagctagcaaccagcatggatgcacaaagaagcaacttcatggatccatggctatataatatcactggatgtgtgtcttgcctacccatccggtctctgaacatcgatcgagttgaccactgtcgttttagtttcaatcggtatctgaactttattgtgtgctctgagtgtagtgcatagctgtatacttaacctgactatcacaactaatctgcttgacttttcaggtcagctagctactgcaaatagtcaatgagtgagg

SEQ ID NO: 7861 - DNA, 1501 bp, Oryza sativa
cgattcgcgcgctactcaagtaatgtagccgtcttgaagaaagccgctcattattgtcggtcgtttttcccttgccgatgcgcgcgatttgcgaccattggattcctgcccgcctgtagagaccggccccacttgtcaccaggcctaaggagtggcgtcacgcccgagcgttttcctcaaggagggcgatcgccctggcataacgccgggggtatcttgactagaggtttggggcagccgcggtctcccacgtggcctgaccccctcgggggggtcgggcccgagggtgatgtggccgcccctccctctgtctccccgaggggtcgggccgctcccgtttcggccccgagggctgggacgccccgaccccctgtggttttggtgccacgtgtattggttaggtgagcacagcggggctcacctaaccgcatttatagcgggttggacaagcgcaccacgccgcattcaatgcggcgcagcgctcgcttatccggtccgtaaccggtcacagtgtgtgaccggtcacagaccggtcagatcgtgggttaggtggcaacaggcggcctgtcacacgcctcgccccatcccgtcggaatgatgagagcctctaggcactcgtccctaaccggagccggcgtgctaactcctggagttaacacgtcagtcccggctagattcataccaggcttcatcgcaaccattacaaggaagtcattttatgaagaagggctgacgtgtgacatgctaaactgacgtgtggcatgctaaactgacgcgtggtagacaagaatgaccggtttgtgactggtctgacgccggtcacgtcatcagcaaacaaccgtgctcccacgttgcacctgcttccggtggagtggaggttggtatgacctatcccatcggagggtcattcggacagcagccattgcaaatctccgcccattaatgaaggaaggacagggatatcccggtgtcaggcgaaggtacgagccaagttttggtcaaaataggatgggtccccacccaaaagaagggtaggtagaaatggtgtatgtggtatccccttgagatataaaaggaggaccatgcctaccaggacggggggaacgggaggaagagaaaagggagaagaaaaggggagctcgtgaaaggaagagcggagctcatagaggagagagagagggagagggtctctagagtttgaactctcttgctctccagctctttgtaactccttcatacacagatccaccagaacataggagtagggtattacgcttctcagcggcccgaacctgtctacatcgcccgtgtcttgtgcatttgctctctcgcgaaacattccacagatcgagggcttagaatctcacctagcgtccccggccgaaccggcaaaggggggcccgcgcggtctcccggtgaggagccccacgctccgtcaaagtgcgttgcttcattgttatagctagtgtggcacttgatcatactcggcaagcatcctaga

SEQ ID NO: 7862 - DNA, 1501 bp, Oryza sativa
ggattcatttggaaacctctctcctaacctcgccggcgccatcaatggcgaccggatcttccgcgcccgtttccccctcgtccggccgctctctccccctcccaaccctatataaaccttccccgtgcctccctccaccgtttccgccactcgccgccctctctccccgtcggaatcgagctcgcgccgtcgctctctctctccgccgtcaccgccgagctccggtccgccgccgtcgtcgccccggaccacctcccgcctcggcgtcgccaccttcggcttcaccgcatccccggcgacctcgtccacccctccgtttcgcacgccgaccgccggagcaccgtcgaccccgtccacccgagccgcgccgccgccttcctccgctccggtcgccgttcccgtcgtcgccgtcgacccggggtgagccgtggaccgctgattcgtttcccccttccctcccctctctcggccgccgctccgccgtacctatggccgccgccggcgaccatagggacgcgggcgcgccgcctcccgtcggctgtgccggcgtggccgccttcgggcgcgccccgcggctgccgtgtggggcccggctgtcagccgcccgcgcccttaggtgcggctgacgcgtgggacccacggcgccggccggtgcgagcccgggtgcgcccggtccaccgtggaccgtggggctgccgcgtgggccccaccccccgtggacccggtccgcgcgcccctcccctcggctgacgcaataaatctattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattattattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 7863 - DNA, 1501 bp, Oryza sativa
tagtggcatatttcaaatatatgtaaaattataatggcaatgttactaaatcgttaatactagtagcatatttcaaaaccgacatatttctaatggcatgaattcaattaaccctaaaagttagagaccaacgagaatccctacccttactagtgtatagtggcggaaacaggggtagggtagctagggctgctgccctactcctaagcctaaatatccattaaaatttacatgtcaaaacctcaaaacatggaagataaagataaattatgtacattatactggttaagccctaggcttgagaaaattctggctatgccactgctagtatatacaacaactaagcatattatcgcctctcatgcctcatgggtcgacgcccgaaactttggatcaccacgctacctggtccccttcctcctccatttctttgcattaatgtcagcaacgaggggaagggctgaaggggatcggggatccgtatgatccctagggccccaaaaacgatatttggcgaacttattcagttggaccacacctatattgtaatacccttgcgcttttgtcctcacttaatgcaaaaaggttcgaatcgatattactaatgatcaagcaactcaccttatcaattaatgtgcatcaagcttgatagcggagatatgcactaaattggacataatacttcattattgacttctattttcttaacaaatccattccttctatgttcttagctcatgccactcctatctagtagccaattgtccaaaaaatctagattttaactcaataaacataaggatatgacatttgtaattgtcgagtaaatgctcgttcaaaaaaaaatgttgagtgaatacccatcctttaaagctacggccgccactattgggcatggtcaccggtatctggcagttatggctattgtgtctgggtctgacaaagaaatattgcatatcagatcgatgttatttttgctctatatgtgtccaaaccgacccattgtaatcctacccacccatagatctaaggtgcgaaatagtccaacaaactaatatatttacatttgttttgacgccatatgaaatttgcagtcaaaacttaaacttgtaaattatttatagatgagaaaaatcaagatgtaaaatgtgaaatagtaccttcttcataaaaactctttcataaggagtagtatttcatatggcgaatatacattccttattatatgttgggtagacaaggggtaggggcaagtcaactcgtgacggcacgcctcgccacgacacgacacgacacgacacgagagagatctcggcgccggcgggcggcgccggcgaggcgtacggcaatgcctccttccgccgtgcccttctcccgtcgcccatccgacggtccacgcggcgcccgccccatcctggttgtgatcctcatcgccgccgccgccaccctactcgccctcgcctactcgtccttcccctccgcttcgcgggctaccaccgca

SEQ ID NO: 7864 - DNA, 442 bp, Oryza sativa
taattattaattctttttttatcatttgtttcattgttaaatatattttgatgtaggcatataattttacatatttcacaaaagcttttaaataagacgaacggtcaaacatgtgctaaaaagtcaacggtgtcaaacatttcgaaacggagggagttcattataacccaaaactaatgcccgcatgttaatccactcaactcaactccactccacagagatggaatcgatcactagataattaaattaaataggagaataatatcctattttattatattataaaggggaaagaagaaggaggaggtagatgagcaaccaggtcgacggtctccttggtgatggcatccatggcattggcaacctccattagcattcatctataaacggggcggggaggggcggcggaggaggagagaggtggaggcagcggggagcgcgg

SEQ ID NO: 7865 - DNA, 603 bp, Oryza sativa
ttgcgatgaagcctggtatgaatctagccgggactgacgtgttaacttcaggagttagcacgccggctccggctagggacgagtgcctagaggctctcatcattccgacgggacggggcgaggcgtgtgacaggccgcctgttgccacctaacccgcgatctgaccggtctgtgaccggtcacacactgtgaccggttacggaccggataagcgagcgctgcgccgcattgaatgcggcgtggtgcgcttgtccaacccgctataaatgcggttaggtgagccccgctgtgctcacctaaccaatacacgtggcatcaaaaccacagggggtcggggcgtcccagcccttggggccgaaacgggagcggcccgacccctcggggagacagagggaggggcggccacatcaccctcgggcccgacccccccgagggggtcaggccacgtgggtgaccgcggctgccccaaacctctagtcaagatacccccggtcccatgtcaccgacacacttggattggcttaactcactctctaacacctcactagataaactaagtgcacaagggtgtgagagctcttggaagggttcaagataatgcaa

SEQ ID NO: 7866 - DNA, 1501 bp, Oryza sativa
agtatagtgaaaaaggacataagagaactatgatataattgtacttctatattcctaatgtctaagtatacacttaacacatacaagcttacaaggctaggacttagttataggcacccatgtactaccgagagaatactccctgctgatctgccagcgtgtttatagaatttacgcactcttacgtcatacccgaattggaggagtacaaaggacggattggcctcacttttcatgggacatatctgcatccaatggcatttatctaagcaccatacttatgctagtaaataatgacattaattcccctagaactcccactatatggatggacaagttaaagctagaacagcccatcaaggtcattggatcgttatcgtaccatagatgactagtctaatcaagtgaaacatgtaaataaagtatattatatttataaagcatataactactaaagtagtatatgaattataaacacaggaaggtaaaaaaaaagataattctattaattcaactatagtcttacaaggagagaatggagagggtagaagaggaagagtaacaaggttaaggaggaagaagaagatgagcccattcagttgtattgcaatcgcccctgaaggaaattaccaactaacgtacgcgcgacaagaaaagaagggaaatgagggagaaagaacctaccaagggtaaaacagtcatttcgtatcaccaatccatgctgacacgtagatgtgtcatgccacatagacaagagtggcaaaaaatatattaagaactcttatttgtccaacgataaaaacgtaaaggaataagtccaaatacccaaccccctcccccctcacaaaaaaacattaattcgaagtccatttagcacctaaactttaaaccggatatttaacttccaaactttgcactaccattcatataaactcctaagacgggtttgcaaagtgttttttttatcaaatttatatgtacgttggataagtttgatgacgtgacatacacattgtgcatatatggtaaaatctttatttaaatatttcttttcacttccttgctcactgacttatagaagagtaccaatataataaaagtgtgacatcgctatgatataaatggatgagatacgtaaaatatattaatatgcaaaatcatcctacgggtaatacgaatggtatagcaaggattggcgtccaattttaaattttaaggtggtaaacggatttttatcgaaagtttttattcggagggtatttggacctttttacaaatttaaaagtggcatttagagagttgatactttttatgtcgcaaagtaataatttaaatgatgtatggtttttgtgcttgttgaattcgtttgagaagaaaacaaaattagtagtgcctaaattggcgggagtgcccttgggcgggctgccgcatgcgaccacacacttgttggcgcccgcgtggatctctccatctatacatgggtgttcgtccacacatgtct

SEQ ID NO: 7867 - DNA, 1501 bp, Oryza sativa
cacagctgacaatttttgatgatccttaggtaggtatgtacttgtacgtagaagatagaaagattaagtcaacatgtacatagacagtatatttgttgtatatcctcagtataagtgtgtatacacagtagcaatatttctacacttatgcaactaaaatgggtgagcatttctccgcgcagttgcacgaatagtgactagtactttcccttttggagtgctgagtcctttctgggttcactgaatcctggtatacgcggaagagagatggctgagttcttttcgttgcatcagtaatatgttcttgttttcttttgttagaagcgcagctggaaagcaagtgttgtttgtgcatttccttatgcggttcatgtatatatatagcggctgtctatattcatcagcccgctgatttattttctaagaaaatatcattcacttttgaacggtcgagattgttccaagattcgtgcagctcccgaatctcgtcccatgcgactgtcgcatgcctccctatccgatactccgtcacaccttggcgccatactatcactcttcctcaaatccggcgcggatatcctgccctgcccttcttcgtctccagtggcgtgacacgccaccggccccatctcctaaccattacaacaagaagcgacgatgtttggccatcttaatttttttcctcccaaatgcaaatgagtttggacttgtgatttgttagaaatgtagttcattcctatatatacttgtctcttgtactttttttaatgaatttaggaaaattttagtctagtcttcatctattcgatggttttcatgggataatccctgtatatgtggctaggaaaggaaatgctaatgcatatatcgtactacctccgtcccataataattatatttttaggattcaaatttttcccaacaatagagtactaattaactatcccattaatcacttttgatttgaatttcttcctattctaccttcaacagatatagaagccggtttaatccattattaaaaaaaaattctaccttcaaccattttattacctatacacatttaattagggacaccttagtctttcttcttaaaccttaatatatgctaaacaatctagaattgcaattattttgggaaagaatgtagtagatttggaggaaagtcattttacatatgggtgccatcaaacagcatatttgcaaacgaaaaataatatgtgaatagaatttttatatgcgtgtttttagtgatctaaaagcaaatgctgaaaaataaacttcaataaaaaaccttcaaaatcaactctaaatttaaagttgaaattcaaggctgataagtataagcataagcaaaaaaatgatagtgacaaaaggtgcgtgtctcgtttcatgcgtgataacaaaatagttatgagtttctcttttttctaaaagaaaaatgacaaaagatcaatatatgcgaggcagaagcttggtgggccggcctcaagcgcagtgg

SEQ ID NO: 7868 - DNA, 1501 bp, Oryza sativa
tgccccggcctctagctcctttatgtcatcggcggcgaggtccgccttgtccacgcccaccagggttgccgccttcgcaagcccccacgcgtccgcgtcgcggtggtgccccagctgcgacaggcacatcgccaagtggacgcgcttgtcgctggcggccgcgtcactgcaggtgctctccaccgtcgcgtccacgcccatagcggccgcgctcaggctcacggagatggccaccacggcggcgagggccttgctcattctcattcttgctctcctcctttttctttctatctgtgagcatctatttttttgtttttttttgggttttaaacaagacatgtgtggacgaacacccatgtatagatggagagatccacgcgggcgccaacaagtgtgtggtcgcatgcggcagcccgcccaagggcactcccgccaatttaggcactactaattttgttttcttctcaaacgaattcaacaagcacaaaaaccatacatcatttaaattattactttgcgacataaaaagtatcaactctctaaatgccacttttaaatttgtaaaaaggtccaaataccctccgaataaaaactttcgataaaaatccgtttaccaccttaaaatttaaaattggacgccaatccttgctataccattcgtattacccgtaggatgattttgcatattaatatattttacgtatctcatccatttatatcatagcgatgtcacacttttattatattggtactcttctataagtcagtgagcaaggaagtgaaaagaaatatttaaataaagattttaccatatatgcacaatgtgtatgtcacgtcatcaaacttatccaacgtacatataaatttgataaaaaaaacactttgcaaacccgtcttaggagtttatatgaatggtagtgcaaagtttggaagttaaatatccggtttaaagtttaggtgctaaatggacttcgaattaatgtttttttgtgaggggggagggggttgggtatttggacttattcctttacgtttttatcgttggacaaataagagttcttaatatattttttgccactcttgtctatgtggcatgacacatctacgtgtcagcatggattggtgatacgaaatgactgttttacccttggtaggttctttctccctcatttcccttcttttcttgtcgcgcgtacgttagttggtaatttccttcaggggcgattgcaatacaactgaatgggctcatcttcttcttcctccttaaccttgttactcttcctcttctaccctctccattctctccttgtaagactatagttgaattaatagaattatctttttttttaccttcctgtgtttataattcatatactactttagtagttatatgctttataaatataatatactttatttacatgtttcacttgattagactagtcatctatggtacgataacgatccaatgaccttgatgggctgttctagctttaacttg

SEQ ID NO: 7869 - DNA, 1501 bp, Oryza sativa
tattgcaaaatttaaaattatgttgtcatttcaatatatttgaataatataatgagaaaacatatatactattatatgagagaaaatataatgatgctagccgcgcaatctgcgcgggccaccatgctagttaacataaagacgatgagaacatccactgcgcttgaggccggcccaccaagcttctgcctcgcatatattgatcttttgtcatttttcttttagaaaaaagagaaactcataactattttgttatcacgcatgaaacgagacacgcaccttttgtcactatcatttttttgcttatgcttatacttatcagccttgaatttcaactttaaatttagagttgattttgaaggttttttattgaagtttatttttcagcatttgcttttagatcactaaaaacacgcatataaaaattctattcacatattatttttcgtttgcaaatatgctgtttgatggcacccatatgtaaaatgactttcctccaaatctactacattctttcccaaaataattgcaattctagattgtttagcatatattaaggtttaagaagaaagactaaggtgtccctaattaaatgtgtataggtaataaaatggttgaaggtagaatttttttttaataatggattaaaccggcttctatatctgttgaaggtagaataggaagaaattcaaatcaaaagtgattaatgggatagttaattagtactctattgttgggaaaaatttgaatcctaaaaatataattattatgggacggaggtagtacgatatatgcattagcatttcctttcctagccacatatacagggattatcccatgaaaaccatcgaatagatgaagactagactaaaattttcctaaattcattaaaaaaagtacaagagacaagtatatataggaatgaactacatttctaacaaatcacaagtccaaactcatttgcatttgggaggaaaaaaattaagatggccaaacatcgtcgcttcttgttgtaatggttaggagatggggccggtggcgtgtcacgccactggagacgaagaagggcagggcaggatatccgcgccggatttgaggaagagtgatagtatggcgccaaggtgtgacggagtatcggatagggaggcatgcgacagtcgcatgggacgagattcgggagctgcacgaatcttggaacaatctcgaccgttcaaaagtgaatgatattttcttagaaaataaatcagcgggctgatgaatatagacagccgctatatatatacatgaaccgcataaggaaatgcacaaacaacacttgctttccagctgcgcttctaacaaaagaaaacaagaacatattactgatgcaacgaaaagaactcagccatctctcttccgcgtataccaggattcagtgaacccagaaaggactcagcactccaaaagggaaagtactagtcactattcgtgcaactgcgcggagaaatgctcacccatttta

SEQ ID NO: 7870 - DNA, 1501 bp, Oryza sativa
gccacggcctcgtcgtcgagcggtgggcgccgcaggcggacgtgctccgccacaggtccacgggcgcgttcgtgacgcactgcgggtggaactcggcgtcggaggggatcacggcgcgcgtgccgatgctctgctggccgctctacgccgagcagaggatgaacaaggtgttcatggtggaggagatgggggtcggcgtcgaggtggccggatggcattggcagcgcggggagctggtcatggcggaggagatcgaggggaagatcaggctggtgatggagtccgaggaaggggagcggctcaggtcgtcggtggcggctcacggcgaggccgccgccgtggcctggaggaaggacggcggcgccggcgccggctcgtcgcgcgcggcgctgcggcgattcttgtcggacgtgggcggccgcgagcttcgatccgttgagactttactactttgggccttccacgagattgtcgtggcacgcattgggctaccactggactaatatgggcccaatatggcccagtttatttttggcattctcccgctcgagcgccccgttgggcgggaaaccaattttgatgggggaccactttgcgtgtataatttgtatactgtattattattaaccgataatttggataagctagattgcattgcggagtaatgtaatttgtaaagaacactatggtaggctgcagatataactcttttcctcttaaaaaaatatacgtttatacgattgcacttctggtacatgcattctaatctttactcccccataaaaaaaccaatactaaatgtgacatatcctaatataatgaatctgtatatgctatcacctagaggataatgattcttttgggtttaaattctatcctacaattaaaatgcataggcgctttttactattacttcctatgtttcataatgtaagactttctagcattgtccatattcgttcaatgctagaaagtcttacattgtgaaacggagagagtaccttataagcacattttgtgtaggtgtttattcactactacttttatatccacattgttcctgtagagcaaagacatcttagacatgggctaggatgtatttatacatctgtgcacgtataaatttccgtatttagaacgaagaaaaataacgtgcacaactttatacttgagtacgttgatcgagaggaccaatttaccctcggcaaaacccaccgtcactgctacccaactccgttccatggcctccgcctccgcctccgccctcgctttcgcctccgccgcctagcctccctagggtttcgggttccgagatccgtgccgccgcaatgcccgcctcgccggagcaagccgtgcgcgaggtcggcaagcgcctcgcgcagccacgcctcggcaaggacgccctcgtcaagcttctaaaggcgagcagcgtcgcatccttggtttcgtcttgcttaaatcggtctaaatcaaccgcgcttccatttccggtggaacgttg

SEQ ID NO: 7871 - DNA, 1501 bp, Oryza sativa
acaacggtgacgagaatgtcgccccggagcacggcaccaccgtggtaggagatctcgtcgccgacgtggctcttcagcagcgcgggcaccctccatgcggccatggacacccctgcctgcaagctcatgacgagcagcgcggacgggcgaggacaggacggacgcgagttctgggcagagcgtcgttgtcgttgtcgttatcttcggagacgccgcagtggtcgtcgtcgtgctccacccgccgcccctccgctccacctgccgcttgccgcccctctgcgccgcccgccgccgctcaccattgtcaggggagagagagggggatagagataagaggaaggagagatgatggagagagaggggatagagagatggtagtgatgatgacatgtggggtccatgtgggccccaccatttttttattattgtgtgtgtgaaattgacatgtgggtcccataggttttattatttttgggttcaatttgccatgtaagcgccacatcaatgccacgtgagatgaaggccaagtcaaattagccacgtaggggccacctcagccaaaaccaggttaaatactgctgatggattctatttaaacggtttcgtaagttgagggacctatcgtatccggttttgcgatcaagtgacgaaaatcagactgagcgacaaatagagggacccaaagtgaacttattcctatacggaggcctctcgattggatcggtgggtgcgccagaaagaacctggatagcgggtgctgggcttgggccttgcccatgcgatcggtaggccatggccgacggatcaacagactactgaggtttagaaactattactgctagttcagctctagaagtctagtagtactactccgtacaaagcaaaagctaccagccaaattgcctttcttttcacatgagccacagccacgtcctcttctccgacgacaaaacctgcttttgcacataccgctcaattctaaaattctatcatccgtcagcgagtataatagagggctccaagaagactgacgtggtgtttggatacaggactaaactttagtccctatcatatcgggtgaatttagagcattaaacataggctacttataaaactaattacataaatgagagctaattcgcgtgataaattttttaagcctaattaattcataattagcgcatgtttactatagcatcacataggctaatcatggattaattaggctcaatagattcgtctcgcgaattagtacagggttatagaatggtttttattaatagtctacgcttaatatttataattagtgtccaaacatctgatatgatagggactaaaaagttttagtcccatctaaacagggtctgaatgctgaggtggatgagaaaggagaggagatagatgagaagccggctgtaagtttacagccggtttagacactgtaaccaagaaaatctatgagacagacatgtggaccatatatttatagtgaaaaattaac

SEQ ID NO: 7872 - DNA, 422 bp, Oryza sativa
ccacaactccactccagactcaaatcttggagttaaatttaggagttgaagctataccaaacaggctctaataattttcagcgttcttccttaaaaaacaaataaaaaaatgagagaattttgggcgttctggacttccggtctccccagtctccatacttcccacgaacaataaaaaaagtcctcttttgtaccctactctcgctcacagtagccgctttcattcaccatcgattcctctctcggctgcttgccttctctctctctcttcttcgcgtcgatttcgtgcacttcagtttcttgcgtgcgagcatcgatttcttcctcgccggctcgcgcggattcgatgggttgttgattggaggagagcctcgggagggcctggagtccgctgcccatggcgcagccgcagccgcagtcgc

SEQ ID NO: 7873 - DNA, 822 bp, Oryza sativa
gactttttaaaatatatttgaccgttcgtcttattcaaaaagtttaagtaattattaatttttttcctatcatttaattcattgttaaatatacttttatgtatatatatacatacacatatatgtatatatatatacatatatgtgtatgtatatatatacatattttacaaaagtttttgaataagacgaacagtcaaacatgttttaaaaagtcaacggcgtcaaatatttaggaaaggagggagtacttatctcgatgacattgacaagtagtgtatgaaattaactaggaccaactaattcggcacgtaaggataactacagtttcagctactacttacccgtcagtaacgtacacgtagataacgctctatctagatctttagaaattgcaaagatctcttaaaaatacgaaaattttacaggttctgaacaacatgatttcccctctaaagaaaatatgaatatatacacacaagcacacttaccctacaaacatacccaatattttatcacaataaactctttcaagagactagtcggtaatatcgtagttggcaagtacatcatgtctactcttaattaatataaatacgaataattgtgctaagtcaaggacataattttggttggtaaagtaacgaactcatcgttcgcgaagtgaaccagaacagaacacttttaggtgaaccgtgctaaaattttctttcaagaaaaatcacacaaaactacaaaattactagtaccaagttgagttgctttcactgttctgtcatgtggtctccttgtccgctctgtgtattttctgccccctccagc

SEQ ID NO: 7874 - DNA, 1501 bp, Oryza sativa
catttactttgaacagattgagtttttccaagataatcttattaaatggaacagactggatcactgaacagagaggaggggtcacattctcagcgatcattaaccactggttacataatcagaaattaatattacttgttttgttttttttctctctctgtctctgtcctgtttttgttgtgtgattcccaaaccaatgactagaatggtatccatagcattaaataagttgtcacctatgacaaaaaatgatgtagcaagtgaataaatgaggaaagagaagaaaatcatgtcttgcatgagacatggttcctacacaacatctaagatataatgtgagataagtagcattaaattaaagtatggaataatgatgtttgtattggaagactagtgtctagtactaattttttttttgatgatgtggagtttatggaaaccatgtctagtgttatgggttaggactgccctaagggcattcccaacccaatgactaggatggtgtccatagcattaaataagttgccacctatgataaaaaatgatgtggcaagtgaataaacgatgaaagagaagaaaaccatgtcttgcatgagacatggtttctacacaatatccaagacatcatgtgagataagtagcattaaattgaagtaatgaatagtggtgtttgcattagaagagtagtgtatagtacaaaccatgtctagtgttatgggttgggactgtcctaaggattggattccccgcaggacgttggttgtttccatttccgtttttgctatggcagacgctgtccttccatcaaaaaacatggcaatttcgttattgctgagagattaacttaccttaatcaaagttgatagttgctaccatttgtcagtcaacactaaatactttattagaaggtgggcatgtacactgttcattgagtacacaaggctttgagcgtttaccgatcttactataatccacaaaatcaaacatgacctggctgtttaactagaagagagtattctaaagatcaattgctgcaaaaatatgagtgtattaaccgcgtttgacacgatcttgagtcaccatgttaccagctagcattccacatggtgatctacgtaatgagagaggaatttaaactctcgatatggtgtacactcttatttacataaaacttaaatagttataaaaaagtgaaaaaaaataaaaagatgtattaacatataatatatcacttcacaaccatgcaagttaaaatttaaccttcataagtcataataaaaaaaataagttaaattatagctagttaatgtatatttatagtaaaaaaaatcgtcgaaacatgtagaaattaaatttgattttgcatgtttatagaacgatctatcacatattatactattttgtttaatattttattttttataactatttaagtgacatacaaataacgagcggatatccctcaaaagtttactatggtttccctctacgtactgcttct

SEQ ID NO: 7875 - DNA, 1501 bp, Oryza sativa
tcgatacaaaatctaacatgatatgtaagaaatgagtagatatccactcaagcgatgaaaatccatctccctatcccgtgtctcttgtggacttattttgatttttagaatttgtgaaatggagtgaatcgcagtcacaggtctactggcaattactatattatatttcttttgttattgtgtacaatagatgcatgtttgaggtgtaggaattaatagatgcgctaaggcctattcgaagattaattctttggaaaatcacaaaagcccacctcatggtatggcatgcatgtggagtttagtaccaccttgcttattctaggagagggggacctccttaaaagggaggatgccctcctagccacttgaagcatgtgtggtggagaaaagagggggaacacacacgcgcgctcgctcgcctggcaggcggcgtacgcttcgaatagtccgcaaaattggctcctcaccacagttttgttttgctgcaggaaaattcggatttgttttgttttggaaacattccgaaaaatccagtgtccggataagttacgcgcgacttatccggttcggttacgtggagtggagatcgtgcgggcgccctgatcaagtgacctatctctatataaaccgagccgccgccttcacgcaaaacacacgaaatcaatctagggtttgcctcctcttctgtgctgcggcgtcgctcgtagactactccatcccgctcaccggcgtgcacctgcgatcgggagagcaggtctccttaacctctgccttcgacgtcttgcaccgggagaaggcggcaataaggtttttgggaagcgcttcgcgcgactgctccctgttcgtccgcgacggctcgccttcctctccgctcgcgtgttgcgcgccttcgtcgaagctcgtaaccgcgagtagttcctgtcgagcaaccggtttttccgccacctcggtacgtgttcgacatgttgcgcatatttgatctgttcatattttactgtttagtttacatgtgtagatctaatgatgcgttaatactagtataaatctgtaatgtcatgatttatttatggaatatattaaattattatatttctatattctcgaacatgaggtgctgtttggtttggccaaatttagcccgtatctgatcgcagcgtaaacagatgaaacaaaagttggtaactgtgcagaagcaatacaggtcgctcccatgcaccattttttgtctgtgataactcataacagtaacatgcaaagaagtactcccatctaccagctgaaatcaagagattaaccttgttgttgcagccgtaaaaacacactactaatctgtctgactctaataccatccgaagagatcaatgtggtaatctggctaattggcaattgacggtgcaaccgagacgagacacatcgtttataaggattacatagaacacgaaactctaatcccaaatcaacctagcttgcttgcactattactgaccagtggtcagcatgg

SEQ ID NO: 7876 - DNA, 1252 bp, Oryza sativa
gtccgcccacgacacgccgccgctcctcttctcccccttctcccccgccgccggtccggccgctgaccggccgttccgcccacgacacgccgtcgcttcggccggtgacccgccgccgcccgcccctctctgcctccgccccgccgtcgcccgctccggccgcgcccaccccactccgccggctggagacagagaagagggagagaggggtgacagagagaagagggtagtgaagatgacgtgtgggtcccaccatttattattatttgtgtgcaacatgtgggtcccatggattttttttttccgaatcgaattgccacgtaagcgccacgttggacgaagacctagtcagaggagcgccacgtcagccaaaacaagggactataccgccgagggacgttgtttgcacggttttgtaagttgggggatgcgttgtattcggttttgtgctgtagggatgaaaattgaactgggcgacaaataaagggacctaaagtgaacttgttccttcccgtgaaacatccacaaggtttgggcctcgtttctaaatgggcctgaatcccggcgttgttgtgtatgggctgtaatgttagtgggctgacacctaaagaaagaccagcgccggggggggggggggggggcatagattccccgaggccgcgacaaaggaagaacgccaccattcgtccaggtccaaagcagatgccagtatgccaccaaccaattattaacacaacagatgcttgtgctaaatggttctttcctcatgaagactcagattttatttcaatttccgttagcacgtttttcaagctacaaagttgctttaaaatgttaaatttatccatttatcatgtttataataattaaaatttaattaattatgtgttaatagttttctcattttcctttgagccaacctttttttaacggaaaacagcattagagtgctttttcattgaatagagtaggagaaaataaacacctaataataaaagaaaaagatcaccgtaagctgtacatgagcgcggagccaacctaatttttatctccatcagtttcaaacaccggcgttgtggaatttttttttccaagttcacttggcaaacggaagcacctgtcgctgcgtatctgtggaaaacggcccggggccggggaaggcgacgactgaggagggcgtagccgcgcccgcgcgcagaggcgtccatctcacccacgacagcagagcacggcatcgcgcccatcggaaggc

SEQ ID NO: 7877 - DNA, 1501 bp, Oryza sativa
ttagaggatgacaagtttaagagtgaattgcacttcgtaccatgttttatcgtcgaagtttaactcatgatcattctatatccaatcttttcactttgaattatgtaactttatatttgttgcataattaatggaccattctagctctcttcgcaaaccatgtctaacgtctccttgataaaggtatgacatgcatataagtatgaaaattcgccggcatgtcattaatgttttgctcaaagtcattgaagtgctaaagatgtggtttgaggtagtctattgtacaacaaattaagataaagttacctagcctaaagtaaaaaaatggacaaagggtggtccaaactaaaacttttacgataaaacatagcccaaagtgatattaactcaacgactaccgatggaggcctctattaattgtttgctctatatggaaccaaccaaagcaaaaaaaaattaaatttaaaaccaccaccggcatcgtcgcctgatggagaggagaggtcatcgccggatccggccgccgcctcgccctctaccgtcggtcttcttcaccggcggtggatctggaggaggagaaggcgggggaggggggaggcggatgcagcagagaatggccgcccgcgctggtcttctctatcgctgccgctggatgtagccttccgcaggcggccgccgcagtcctccttcgcctccgccaagggagtgggggccggaggggagggcagcagacatggaggcaacaccgcaaccacctccaccgactccggccaccacctcgcaacagaggtgaggaggagggagggaagaatgaaggagtggagtatggccagatggataaggactaagagtggagtataggcgctcggttcagctcggctcgggtgcccgttcccatagtttattataggtgcccttttttaaaaaaaaataagtacaaatactataggtcccgatttaattttatatagatccagcacctgtaatataagtatagatcctagtttttctaaagtataagtgccggttttaaataaaccaacacctataagccggtacctattattctgctaatatcagtggcgaatatagaaaatcgattcgttggtgtcataacgtgtctatcggtgtcatagtatattaattatacttagatcatagtgtaataacatatggataaacagttttgctataggttttgccgaaagtcatcagtgtcgcctgacaccggccctttactgtagctccgcccctggctggctaatatgccgtataatgtattatgcgcacatatgcccaattgatggggccgaaattattgtaaaattatagccctgttataactctcaccttaatgatgcatcgagtccacatgtcatacaatgttctcacttctcagtgtggcaaaatggcgagtcttacaaccactccacatcattgtatataggaaaaagtacgaattacccgcctgaagtattgcggtcgtccgatttacccccct

SEQ ID NO: 7878 - DNA, 1501 bp, Oryza sativa
ccaaatatatggtctccactgcatagttttctctaaaatagggtatatgttgaaagtaggtaaatttttccctagtaatggtactcgatttattcttcctgggtgcagtaaccgcgtcgtgtggtgcaaccggaccgatggcagatgacatggcatttccatgggtccgctttagtatatacaaggaaaaaatatgaattaccccctaaactattgcgacagtacgaattacccctgaaactacaaaaccaaacatattaaacctcaaactattgaaaccggacgaattacccccccccgactcaatccggagcggttttagtcctacgtggcatacacgtggcgccgacgtcgaaatcccatcaacaaaaaataaaataaaataatgtagggcccacatgtcatattaatactttttctgtgtgtgctcttatcgttggaggcgagcggctacgagcccggctgggcgagcaacggcgggcacggttccggccggcagtaggcgcggcggggaaggggaaccggtcggcggatgggagggcgcaccaggcaacggctggagcggcagggagggggcgcggctaggagtgctctccaggtcgcgacgggagcggcggggaggaggaaccggtcggcggtggtcgcaggagaaggtgccaaccggagccgggaagtccggcggcagagacatgttccactggagcgacgctgacgcgccagaggccagggccagccgatgggggatcccacgatgggacgacggccagtgttggcctcctgacaactgggtcggcggagtagatcgaggcgatgaagtggcatctgtcctccgacgacagcgaagcagggcggggtggcggtggtggagacggggccatgccggcggaactcgggcagctgtccttgaccggagtggaggagttggtcggctaccccgggcccgggcatggctagagggcggccgacggccgggcatggcgagagagcaatcgacggccggcgggtgcgacggggagggcgccgtcaccagagccatcggtgtagccaagtcgccgcatccttctcctcactgccatcatcgttgacttgctggtccccttcctgcgaggtcggccggtggcgaggagaactcatagagggcgccgatgggcatggataggcagcgaggttgcccctccctcctgctcctagccccacccccaccctctactacctctctctctctttctctctctggttatggcgggtgtgttgtagagaagaagagaggaaggagaagatagggccatagagggtgtcaggtgggccctactgccaggtaggattaaaacaaaatttcattgccacgttggacgccaagtaggatcaaaaacagatgatattaagataggggggttgtttgtccagtttgaagaattaagggtgttaaatgtccggttttatagtttaggggggtaaatcggacgaccgcaatacttcaggcgggtaattcgtacttttt

SEQ ID NO: 7879 - DNA, 631 bp, Oryza sativa
aaccgttttgtggatggagtttcgcggcgccgtgtgccacccagccacgtacgataggagaagggccggcctagaaaacggcggtgttaccggcccaaatcaggcccggcccggcccataatgatgtacgccacttgcgtgtcgcgtcggtcaccatgacgcaatcacccgtctcggagaagaccagaaataggggacttccatgtgactaataatatatatccatgcttagtagtagtaacatgttaggctcgtataattaaaaattgatatgtatggaatgaaaataaattaataaatattacaggcacatacgaagaagcggatgtcgacctccaatttactgtgagaaggccggcacgaaagaagaacgattgtgcttttaaaaacaaatacttctatacataccagtgaagcactgaagcatacaatccgcatccaactctgccacattcaccgacccaccgtgtttttttttttaattatgctggctcgacaaacaacagctgtgaccgtgcatacttagtcttatgcaggttgtatatttgggtcggatgcatagcaattatttcttttaaatagtagagaaagaaatgaacttctctaacaaagttgtgtaatcattggtagg

SEQ ID NO: 7880 - DNA, 1501 bp, Oryza sativa
ctcctttttttgtgtttaggtggtgtatgttcttttgtgtcccctgctgtatagttgcgtgagtagtaaaacattggctcttgatgttatgtgaggtggcgacgatcgattgatgtatctgatgatgatcatgatgatggtggtgttagaaatctgtgatgttatttatatatcgcattgccattgggcaagcatagtatcacaagcattcgctgtgcttcattttagttacagttactcgtcacagttcattcttgtcagagaaacaatggctatattatggatgagcatatttttatgattatttcaggggaaaaaaaagcataacggtagatgatgaataacacgcttgtagaatgattgctcagggcgcaatcacaaaaacagaagcaaagccaagaattagcaatgcagctccccacactgaacaatcattacgtaaagcagagaactaactaatcaatctatctgctggccttctgaagtctgaacaatcatcctatctgcatttgcaagactggcaggaccagagtacttgcatacaaccgatcattaggccatgttgttccttcttgattggagttcttttttttttaacaactactctacgtgatatgatttccatgcagctgatccttcgtatgtccttcacattctctcattcgtcctcctcctcccctgttcatctccctgtcctaaccctggcttaaaaccctctcgcgtgtacagtactcgtcttgcacagtgaaacataactctcgtctcgccttaatttcgctgtcagtacgcgatacgagcgatccttgtgcgtgcgtccttgcgtactcggtttgtggcgagttggtagctctggtttttaatggagctgcaactgcacgcaacagttggaaaaatcgcgcgagatcagcaaattcgcgacgcagagggggaggacgtcgcacggcgaggcggaagccgtcctctgctcggcttccggtggtttcgagttggagacaagcgggttgttcactttgttgcaaaaatcatattttgatgttatcgaatttcgataacgttgaatgtatctagtttacgattttatcaaagtttgatagtgttttcgtgagtttttttttgtcggaattgtaagatcatgttttgccacgtataccggccgggctgtcggtgtaactcgtacgcgatacgtatcccctcgaggccttgaaggcttggatggtacacgtactggtacgtacgagaaataaaagggctcatcgtgacacgggcgcgatggtaaagtctctctctcttcattagccgtggtgcggcgagcgtgactgcgcgatggccatttaattctctgtttcactttctttttttcctctcttcttttcacatcgtcatgtttcatgttagtgatgctttctttaccttgccacccccacacgcatgtaacgaatgactactcggccggagtactcgctatagactgtaaagaggtgataacaactcaacatgatcc

SEQ ID NO: 7881 - DNA, 1501 bp, Oryza sativa
ctagaccagctgactgtgcggaatatccatctttaccaatgaatccttcagctatccacatggaaacaattttgtcaataccaatgatttcatctttaggaaatagtgagtaatacacaaagcactgtttcaagttatggctcagatcttcatagctcaggtatattgccttgtttagttcttcaggaagtcccatttttgaccatatctgattgcgtaaaacctcttcccaagcattttttgttgcatttttgttgcatttttcttgcataagacaactcctattactttaattgccagtggtaaaccatcacatttttctgcaattttcatcccacattcttgtactatctcgatctctgatacactcaaggcagcctagacaaacaaaaacgtataatatgagcaaaatagaaccataacttgaaacattattgtgtaaaataattgtgcttatttccttgtctacattattgtgtaaaatttgagttacagagagccttaatgtgcttactcacttttctcatgatgagaaacagttatagaagttccttaattaatcaacaattccacattctagagtaaaataaaaggcacaatttgttaaaagaaatataagccagacttgtaacagtgccgtggtgacttttgatttttgataatttgccaaggggaaactactttatttcataggtgctgctgaaatcacatatctgagatgttcaacaagccaccaatcaaggatatatgcatcgaaggcaccattcagtcaactattttggccatccaaaagaacactatatacttatgtaccttgtgtaaccatgccaccacctatcctgccagccatgttggcgatatgcccatagaggcagtcaatctatcacgaatcatatttatgaatctcttccaattatttatactgatctgtgagtatgacttatttgtaaactatttatatatcaagatgctatttctaaatcatctctgatgatcgtgtttcatggaagatagatatggatatatcatatcaatcagacaataatataagcatgcttcgagaacataagttagatcgatccaccatgactccatgagatatttaccgagattaatttagttgtaagtgttattaatttgaatctagtttctatggttaacatttaggataaattccaaattacctccaaactattgtggtagtccgatttattcagtccagccacactacagcagctagatcacaagtaaccccttctcaggatgtgtatggttttggagacatcaggtgcaattttgggctacaacaataattgctattcattcgattctatacccttggcaaaactgactgacatatagaactcaatgttatatcagagctaaaaggtcaatagttcgaatctaacctgcaacagcattacagaaagtgttgaagtgctcataatatgttaagaatttcaatggttactctcattgagaagaggatggcactcgagat

SEQ ID NO: 7882 - DNA, 1501 bp, Oryza sativa
ttcataggtgctgctgaaatcacatatctgagatgttcaacaagccaccaatcaaggatatatgcatcgaaggcaccattcagtcaactattttggccatccaaaagaacactatatacttatgtaccttgtgtaaccatgccaccacctatcctgccagccatgttggcgatatgcccatagaggcagtcaatctatcacgaatcatatttatgaatctcttccaattatttatactgatctgtgagtatgacttatttgtaaactatttatatatcaagatgctatttctaaatcatctctgatgatcgtgtttcatggaagatagatatggatatatcatatcaatcagacaataatataagcatgcttcgagaacataagttagatcgatccaccatgactccatgagatatttaccgagattaatttagttgtaagtgttattaatttgaatctagtttctatggttaacatttaggataaattccaaattacctccaaactattgtggtagtccgatttattcagtccagccacactacagcagctagatcacaagtaaccccttctcaggatgtgtatggttttggagacatcaggtgcaattttgggctacaacaataattgctattcattcgattctatacccttggcaaaactgactgacatatagaactcaatgttatatcagagctaaaaggtcaatagttcgaatctaacctgcaacagcattacagaaagtgttgaagtgctcataatatgttaagaatttcaatggttactctcattgagaagaggatggcactcgagatggggcaattttctggttttcttcattcacaaaacacaaagccatatcctcccaaagaggattgggtacatatttatagctgcttgtagcagccatgctagggcaatagggtgctgtcctagagcatcccaacaaactgtcctagagcatcccaacaaaatgtcctagagcatctcaacaaactgctgtcctagttgtcctagagcatccaaactgaaagtagagatgctgtcctagaaagctaaaaagcaagaaaaagcaccacaagaccaagaccaaccagccaagacttattcctacactctccccctaagtcttgtgcgtcgtcttgtgggaaagttgagccatcccgatccgggagcaaagctcaaggaacttgatccttccaaggggcttggtgagcaaatccgcaagctggtccttggtgttgatatagctcgccttgatgctcccttcctccaagtagcttcggatgaagtggtacctcacccggatgtgcttgctccgttcgtgaaaaacggggttctttgccagggccagagcggacttgccatccaccctaagctccaccgctccagtatctctgccgaggagatcactaagcagtcgagcaagccagagcgcctaggtcgaagcggcggaggccgccatgtactcggcctcgcaactagacagggccaccacctg

SEQ ID NO: 7883 - DNA, 1501 bp, Oryza sativa
tcgatagatgcttagatggaaaagaaaaacacacagtggcccaggtcatgtgattatatttatcccccgtgctattatatataggctttttctctgagcaaatgctggtgattagatccttaatttgtactttggggaaatgtcaaagcgagactttttgatgagctgagcgcgagctagcgtaatttccacacgttttatgttcactttggacaggaggagcaaatggagagatgagtcactgaaaagcctaactggttgcatcaaggacaagtcaggttcatagattcaggacaagcctaatgtgtgccagttaagatgagatgttttctcggtgctggcccatgtttagaataccaccactgggactaggaaaatcttggtttgctatagctgcaaacctacggtcaattcaactactaactcgtactactagtttttagcctctttcagagttggcaaagttttgtttaggactgcatcctcagcatttggttaatcatttaatcttagtaaagagtattttgaaatttctagtagtaggttgagtaggagtacttgagtatgtcctaatcgtcattaggcgaccaactgaagctgaaagtgggtatgtgtctccccaagtcacggtaataaggtaattaaaccaccatgtaggaatttcattcagataatggcttcttaccacaacagaaagcagagcgtgttgagagggatgcccggccaaacaggggtttttatctgggcgcaacatgccactgaaccagccactaaattgatttaagccacatataaaaagttttagtaataaatttctttgaacgttatattgtaatcgccacttaaattgatacatatgggctgtatttagattcaaagtttggatccaaacttcagtcctttttcatcatatcaacctgtcatacacacacaacttttcagtcacatcatctccaatttcaatcaaaatttaaattttacgctgaactaaacacatggttgattcgagaattgttcccctggatatttatttcacggtctatgcgtagctcatcacattcccggcagccaaatcatgaacccaaaacggatagagattacccctcccgatccatgctcatcatcacccgtaccatatgcccacctcctgacagaggcgccaatcaacttgacaacacttatctgttccccttacctcacctgtttagttagtgagcatgatgcagagcagcagacacattgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcaga

SEQ ID NO: 7884 - DNA, 812 bp, Oryza sativa
taccatagttttgacaaaaaaaacattcaatttttgaatcgctggcgagggcgacgcagtcccactcggacatgtggcaaggcaaattacactcacgagggcatcgcaggcccaatcggacatgttgaaaatcacgagagcgagggtgttgcgggtccaatcacagcggcgcacaaaggcgcgtgtggaaaacagactctgtcgcgagcccaatcactgcgtacggcaaggagcgtgtgaaaagatgctggcccaattaatttgcgcgcgtcatagcggcgtaagaaaaaaaggaaatgatttgacagaaacataaaattaaaaccgattcaaacacggatgacgtaccaaaattccgatgaaaatattttcaattttcataatagtagagatacattttaataaaccgtaccaataaacacatttttttcgcgaaggcgcaaaaagattacacgtcaatatatatgttagaaaaagagaacaaaatttgattacacaacgcacactgtcaaaaggccattgccaggggtcaagaaaaaaaaacagataaaaaaagataagataaagaaaaaaaaaactcctatcgtaagggagggtggggtagggtaccactacactccggcctgcctccggagcgaaacgatggaaccatattcaggaagctcgatcagcccttccatcgctatttataggagtgatatcacacgcagcaaagtcgcggcaggacagcagcaaaccagaacggaagctagctagtagcaagcaacgacgacgggccatcgaaattgctcatcgccggccggcgcgcgtga

SEQ ID NO: 7885 - DNA, 1501 bp, Oryza sativa
ctcaagcgtgaggattatatctccaatttggacttgttccggatacattccacgtggattcatagtcatgagtctattttctatgctcaaagactggaccaattattattccccgtaagggctatcaaccgaatacttgcgccagtcgggattcaattattatatttatttttggagtatcccataagggataatcattcagatcagaagctattcatatgagctacacttggtctatattacccggaagatttattactcaggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcattgctttttgccacgtaagtgtgcgtttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagtacatctgttaaagcagtgtgcgcatggcgtatgcccaatactttggaaatttctttattcataatatacaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcaga

SEQ ID NO: 7886 - DNA, 1501 bp, Oryza sativa
cctactatacttttctctgcaaagcggagtaaagccgagtagctctcctctcttcttctcctcttttactctctgctttctttcaccatgggcggctgaagcttaacataagcatacaaacaatttttttgagaaaatgaacacaagcatgaacagttaaacacacatggtgttcatgtgccacaatgttaggagtacaattgaacccacgtcatggcaggtttataggctgccggtgtttcgccttcacagatcgattctaaactcttgaggcatcctcattatttacatattatttaaacagttaaaaaaatatttaaaaaacaataaaatgaattaataataaaatccaataaatcactctacatcaggtcataattaacttatacaagttgcaaaaagaaatttaactgtaactatagatatacgttacctaactatagtttaattggtttttcataacttgtagaagttaaacctctatgtttgtagagtaaggatgtgttcgaatgcccctcttcccaacccctctcattcgttttccatgtgcacgcttttcaaacggctaaatgatgcggtttttgcaaaaagtttctacacgaaatttgcttaaaaaatcaaattaatccattattgaaaaaaaaagctaatacttaattaatcacgcgctaatagaccgctccgttttccgtgcggaggcactatgttcccaacctgaacatgtgaacacagcctaaatctatcttcttttttttaattactatttaaataatatgcaaacaataaggggatatcttttctagagattaaaatcaactcctgattataagtataccgtttattagcgacaaaaataatttatatatacaacttttacttctatatataggagttcttagcaacttaaagacaatgctgaaaaataaacaacaatgataaaaatatcaaaattaactttaaaattatgttttaaaattttaaaactgggttgctgctgataagccgaagaccaaacaatgagaacgtcgatgtattatacaaaaatgccccatacatttctgattgctcccatacgatttgggcgggggccaatctagttgtcaacttctactactgctaggaggagtagtcacatgatccaatctctcctctcctcgcctacaaaaccaaagccacactccttccttccttgggatccccagacccagtgcagggttgcagcgctttgcataggaatgtctcgccttcctcctcctcctcctcttcttcttgcagctcatcgaaagccacatagtataatattcgccacctaaaagcccaccacatccatccatcttgcttgccacacacccaacactccacacaagtcagctcagtgaccgccatggctgctgctgcctgagctgagcgaggagtactatattgcagcgtccagaccagtccaggtctgcttgctcggcagagtgcttgttgcgccaaacaatgaggcaaccacagagca

SEQ ID NO: 7887 - DNA, 1501 bp, Oryza sativa
tactcatatgagaaatggcagcattttgaagcttctcttcccacataatatcagaaagttaactaccacgacacatttgaatttgcatttgtaaatggtgcttttacacatcaatttaactagcagtggccagcgggcattagcacatcgcagggcataccaactaagggagtgacaatctagctagcagtgtagtaataccactcaaagacatgtcgggttccaaacagaacatgtaccattatcatactatgatattagataatagagcacataactcatcactgcaatgcagtaaaacaatcaaaattctcggacatgagcataacagctaagatcagtaaaaaaaattgaggggcacattttagtgtctcacacatcttgctgcatacgtcgaagcaagtccaggataggccctgcagattcagcttctgtggccagctgtttcaccatcatctccgcggccttcaaatcctccttcaactctgcattcagcgctaggtgcgagaagtgctggtcaaacaccaatcctagcgccccagccaccacccgaaatgagggcacaatgtcacacagctccagccctggcattcccacagcctctgggcatgcctgcgcctctgggaacctctggtatttccctatccacttggtgaggtacttcatcagcctgaccacctccccaccatccagctccgatacggctgcgccgaagaccacagagtccacattctcagacgcaaacaggtaatgcaggcacacctccggtgaggtaacccatcgtatcccatcatgagcagcagcgccgcctgcctcgccatggcatcgaccttcttccccgcgcccttctccttgcacctgttgaccgctagcaccgcggcttccttccaccggttcttgacactcatcatggcgtcgtaggcggcatcggaggccggcgagaggaagcagcggagcgtcgcgagcagctcggaggagcggaggtcggcggcctgtcggaccacggcgcagacgagctcggggcggtcggcctcggagagcgaggaaaggaggctcggcggggggtggcggaagatgccgcactcggcgagggcgaggaggacgtcgtactcagcgaggctcgccgctcgggaggcgacgggggaggcgagggcggcggggaagtagggggagacggagcggatggcttgtgggaggttgggggagggggcggggagggagagggagttggagagggtggtgaggaaggaggcgaggagggagcggaagcgcgggagggagacggaggtggaggagagggaggtggagaggaaggaggcggcggtggcgagggcggggtcggcgggggagagggaccagtcggagggcgggatctgggtggggagcgcggaggaggtcggcggtggcggagcggcgccgggagtgaggacgatggggttcgccgcgacggcggcggcggcggcggcggcggagggattggtgatggcggcgaggagcgtca

SEQ ID NO: 7888 - DNA, 1318 bp, Oryza sativa
ctggataagctgtgctcttttagtctctgtgctgaatacttcatttctgttcatattatggtgtttactgaccaaatgtcttctctttggcctaacaaggtaatcagtgacctttttcttgtcagggtaataagcttctgactatgactaccaaatttctgacttcagagtaggcatgctgttggcctaactgtttagtgtttttggactagatattagactgaacattgaacaattacttgcacgtcgtttgtacttgatattggtgtgccatttcttgattttgtcaggctgcaatcaaggccttgacttagccaaaacaaaaaatttcacgctgtcacatcgaatgtttgggcacatgcatgaagtattaaatgtaggaaaaaaaaattacacatattgcgtgtaaattgcgagatgaatctttttagcctattgcgccatgatttgacaatgtggtgctacagtaaacatttgttaataatggattaattaggcttaataaattcgtcttgcagtttctttggcggaatctgtaatttattttgttattggactacgtttaatacttcaaatatatgtccatatatccgatgtgacaacgaaacctaaaaaggcttaacctcactggacattcagaaaattcatcatctactactataaatcactttgaccatctatctggaagattgtttcagacagtacagctttggaagcatccgtgctaatgatgatagatccttttcgttgtgtgtaaaaagccttttgactctcattggccggcctgattaggagttgatgatgactaatctgaccataataaagactgcccaattatggctgcttcctttgcgtctcaaagggagatgtctcccatcatagcttgatcatgcacaacctttgtttgttacgttatccattgcaaaatcgtacaccggaaatatttcttttttgcgttcgattcttctgcacgcctcatttggcatcgcatctgattgccctgtagattttgcaccgacgacgtttttatcggagagagaatatgccagtgtccgacagtaatcagacactcacgcagcttgaagaagacgaatgctaggctgctacctgatgttctcaacaggagaaacagagtttctttcagacattatcaaagcaggataaattagatgatctttaattatgttctgcggtagagatgacaaactttgagcaagatataattaaaactggtagaagtctgaattttgtacttcacagaaaacggagattggactaactgaatgatcaaccgcttatggtttgatgaaacaagaag

SEQ ID NO: 7889 - DNA, 1501 bp, Oryza sativa
agctgtagggcacagctcaattcccttttctcttagtagctagctagaaaagtctatcagaaagaaagcacattttcttgtccaaaaagataaaaaagaatcaaccattgagggcggtgccccatcagtttgagcctttgccttcaacaagttaaactaagagcacccgcaatgttaaagtaaggtgctatctataaaacatgtacatctcagcaatagactagattaatagtaaaccacttcaatggtatgtctacatgggtatctatagctgtctaatccattgcctcgtttttctctatagactatctccaggttagtagatagctttgctctctctcttcatttaatctcttccaagtagaaaaatatgctgatatagatctcttgtagagagcctataaataactattgcggatgtcctaagcatccaaactgagatgaagcaggaaataaaaagggggcagatttagttaatttgcgttaaccaatcccctgatctggttcgatgtgatgtgaagggaagctcagctgaaatgcttaatcagtttcagtacatatgctgagtgctgaatcacatccgaataaacatatatatacagggagatatcgggaatgaaaggcaattgtttggtgcctgaaagcacggcatgtcatgtggtggtgtaggacgtgcagttcgaaaccgattggatctactgaaatctctgatgccgatggaactgaaagagacccatgtagagtacgtatgagatcatcaagctgcatactaatgctactacagctgtaccctgtatatatagttcgtcagaattaagtctggatgttgtgaaggtaattaaaggaatttatcaattgtgttgacgatcgatcaggcaatgaacccattattgtttgcctccaaaacacatttctgtacatccatcaagtctgaaattctttctcctttttacgactcaagaattaagagaaaagagagagagagagagagaatgtgacagcagagggcatatgcatggtgacatagatccgatgaacgcgcgagtgatacgacggatcatatatgcaaccgcataaattgtttcgcacttacagctggaccctatgatgcatgcattgcataccaacaaaagaaacaatctggaacagggcatccatccatgcaacacgccatttctgctaatcatgtcaatcaacgaaagctcaaggcggtttcttctccggtgtttcactaaatcgattagattttgcatgaatgaatcatatcaatgattcagaaaaccaaagtagatcacggcttacttttcttttctcccagtttgatcaatttccacccttcaaattctataattctcttttgtttagtaagatttgcataagatttatgatattcgaataaaccttggtcaaatgatcgatgataaacttgtttattcagtaaagtaaaaaaagtgtagttaacgagacgctcccggccatgtcgacagctgagctgacaaaa

SEQ ID NO: 7890 - DNA, 1501 bp, Oryza sativa
ctaaaatagaaaagtaatatggtgccaaaaaaggaaaccagttggaggggtggagggagggaggcaggaggggatcgatcgctacccccgtctccaggtgatcgatcgcccattaggatcccccgtgtccgcgcgcaaccgggggatctacactaccgaatactgtatgcttacatagtggtgggcctattcaaaccgcacgatggccacacttagtgggccactggcgaccgcaagtcaatacatatgggcctcattatcccaaaattaacaatcgatcgaggcaataacgtggcgtacaatatttctccagtgaaatgggagagctcagctcagtgtggggattccggatcgatcgaggcaaaaatatatcaaattcgtccaaaaggatgatgcgtcatctaattcaattcgatgccaaacatttacaagttccgcaagggaatggatgagtatatatattgacgaaccaataatacacatccagcggtttcctgtaatatgttgagcgccccactgcaatttcgcacagatccgatccgtccggactaaatcggacggtttatttatgagccgcatagttagtgatttcttttttttctttttctttctttacagaaactagctgggtggcccgcgcaattgcgcggctagcacccaaacaaaatcatatattttttagtatgattttacttaaaatttattaaatagctatatcatgtcttaagagtttgaaagattaaaccttatcatccccgtgtttctaattatatacattttttaaaagtcacaccacttgctaccccttatgacatatccttctttatttgcatgctcgatctaccactatttctattcattctccttgaaacctttaaaaattggatcttatagtttttagagtttattgtcacgttgggtttcgtttttataatttctagacgtcccgtcaaacgttgccattatactcctctatggtctgtccactgtctcttttcttttttgtcattgagattttaaaaatcgaacataattatcgtttcggttcatttttactttctctacggctcgcctgctgcgtcccttctttattgtcattgagattttaaaatcgaacatgataatcattgtttttttactttttcaaagttcagaacctttaaaaattgaaccttgtagtttttagagtttattgtcttgttgggtttcattttttataattttttagaagtctcgtcaaacgatgccactatgctatgctcctctatggcccgtccgccgcctactctttctttattatcattgtgattctaaaaattgagcataactatcgttgaaattcattttttattttctagaagtcacgtcaaacatcagcggctctgaaactatactactatacaccccgcccactgcttctactttttattgtcattgagatttttaaaattgaatatgattatcaatggggtttttttttttactttctagtagtcccagc

SEQ ID NO: 7891 - DNA, 437 bp, Oryza sativa
cccccccccccccctctccctgttggttgccttctccgtgccgaacaccacagcgcgcgcgcgggggggcgggttcggctctctcgcgagctccgctctctgtccctctctctctctcgccgcctcctgcctcgcacactcgagattggtggggtggatttgggggaggaggaggtggggtggggtggggtggttgctgaggaggaggtggtggtgagagatcgggcggcgggttgccgccggaggaggtagagggatcctcgggggagggcggttcttgggtcgggggacccccccatggcgtgaggagagggtgccctccgggagatcttgcggggcgggtgtgtggtgttgctagctgaggctgttgggtgggtacccccgagcggccggggaatctcctcccttctcgagcgaccgcccgcgtcgctccgcca

SEQ ID NO: 7892 - DNA, 1501 bp, Oryza sativa
tatcgtcagtaagtatcgtcgattaattgaaagctgaagattgcgcatcgatcgtactgtgttagccttactgacgagtacagtactgatatttcagctagtgttgccctgcccagctgctactaaggcttccatcggatggcctaataagccaaagaaaaggtcaaattttaaatttttaaacttaattttgagattgattttgagatatttttaacgttgtttctttttcaacattggcttttaaatcaccaagaacacatatataaaagttttacctacaaattcatttttattctctaataaaccattttggcttattagggaataagccaaacaatggggacctccatccgtactgttagccatagtagtgctctcgccaactgaaattctgaacatctgtctatatatgtacaccatctgaactctgaatttatcacaacaaattaaagagaagcatggtgggtggatacgcgtgcttagtcagtagtatcatactcatactgctagtaatctgccgttgcactgcaattaattagagaactaatatactagttaactgagatatactatatataagctagcaagactcggagtgcatgcatgctataatcaatgaaatccgatctgcagatgcgtagctgcatgaagccaagaaaggattatccactgatcagcaaggaatagtacagggatgcactagttgttgtttactctaacccagtattatcaacacataactatataattagtgtggtggactggtagttagtatgtcttgatacagaatttgtacatataatatataattaattaagctgtattaataacagcgagatgcacggagaggggccatcggtcgagtgagacttagcttagctatactatgcgggctgaacgactactgcgtcgcacgtccgtcgtcaagactgaattaaactaatgaacatataactaactaattaatttaaggcggttgcagatgatagcatgtgtgctgtgagctagctgagctacttggccatgtgaagctctgaactgaaaagcttcattagcactggctagctaagctatagtagtagatcaatgcatgggtcgcaaaaatgtagtaactgtcgtggaagcacgtcgaagttgcagatcgcacacacacggtaagcacacgggtttaattaattaatttgtacatatgtatgtatatatacctacattaattaatgcaagacgtgcatgtccatcgagtttgtcgaccgatcatcatgcatctacgagtagtacaaattagttgagtattactctgttttagttgtataccgtacgcctactaaacaaaataataaaaataatatgctgcatgtgcactctagctagccttcccaatccagtaacactccaatatatatgtaccgggacacacgcatggcctttctaggattaaattaaccagtagatgtgtagaaaaaaatttgggtcgaattgaaatggcctttctaggatt

SEQ ID NO: 7893 - DNA, 1501 bp, Oryza sativa
aaaataaaagtttgtgttggtaaaatctgtttttctagtagtgattccctccatccaaaagtttaaatatattttgttttctagtttctataaataagatagtcagttttgcaacatgcatgtaatatttaaatgaatattttgttttacgatgctaaattaaattattgatgggaacccgaacaaccagcttaatacttattggttacatgcatgtatatagctcattttttattatatgtggaataagttaatttctccttggttttggtgacagaaaatatgccttagacttttggatggaggaaattctaactaatcctataagataaatattagagctaacatatatagtagattagctataagttttttttaccaagcgtttttgtctggtttatatatactaaaagttatgaacaaatataaataaaaaggaggaggacaaaaatagcactgcaagagttgtaatcaatcaacaactatcttaggggatcattcattctacacatatgcaagagaacctcgttccggaaagtagaccgccagttatcaaaataaggataaatattgtgaaagatcttcccattttgttgtttctagatgtgctagaaggctatgaaaaatatttccaagaaacctttctatttgaattgaagcattgccaagaacaccatttggaagaaatattccagaaaataccaagtatatataattagtgcaattatattggagtatgtgtaaagctagctttgcacttcttatttttcttgatctctcttcaataattcaataccccttcatcctaaaatataagacgtaaccacttttttcatatctcatgatacaagacgtgcaattaactagtatatccccttcctctaaattcatatatatttttctaaaatccttcactatcaagatatctaatcccattaggtacatgcattgtatttattagggtggttcaaatgaagatgtgataataattttttcttcatctttggattagtggtcgttatgtatattttactacctccatatcagaaaaaagttaattaatctaatacagaacgtgatatattataatactacgaatccggatatgtatataaatctcgatatgtacacgtaatagagttctgtaccgtaccaggataacttttttttttttggagtattaaatttgctcctggacctctaggagtggcttcctcgcagatgtgaccgacaaacctaacatgggcgggcgtgaaaatttatagaggacaaatgggtggacatatatagggtatcaccaataagttaataataactttacccttccacggaacacgtctcgaaggaaaatatatcctattggctcatgaacgtgtaccctggcacataaacacatatcgagggaaattatatcctcctggctcgatcatgaacgtcaaatcaaccagagtttcatataaacaacgagagtgagagtgagagtgagagcgagagagcaagg

SEQ ID NO: 7894 - DNA, 1501 bp, Oryza sativa
aaaagaaaatgagcgtcactagtagcgcgacgtcgctcccacttgcacgcgctccgagcctctgatccccttcactgcttagagcaagtataatagtgagctttaaacctactataaatttagtgtagaagagagatagtgaaaaattaaggatactggctttcatgcaagagctagcttatcacaaggtccaagacaaatgcattaaatgtataactgagagatatagagataaaaagaaaattgtagccaattttatagctaatttattatatatattggctttaagataagctaatagtaggaagtgggctctattattacccttctcttatgcgcctacacatcgtgttgcgactccatacctgctactccacttgctcgcagacgccaactcgctgccgtgccgaacaagggctcgccctttttatttttggttcatttgataacacaaaatatgatggaagttcactgaagtgctaaataaggtgaataagcaagttacattagtttttttgataatggaaatagattacatctccggtctctacccgtgagtaagttagatgagttaagataaacaaatttagctagagccaattacactacactagtagactgttaggtttatagtagatttataaaagcgactatactcaggccctgtttagttccaaagtttttttctccaaacttccaactttctatcacatcaaatctttcatacacacacaacttctatcacatcgtaccaatttcaaccaaacttccaaacttcagtatgaactaaacacaacctcattaggccccgtttagttccccaaaagtttttccaaaaaacatcacatcgaatctttggacacatgcatgaagcattaaatatagataaaatgaaaaactaattgcacagttaggggggaaatcacgagacgaatcgtttgagcctaattagtacatgattagccataagtgctacagtaacccacatgtgctaatgacggattaattaggctcaaaaaattcgtctcgtggtttccgagcgagttatgaaattagttttttcattcgtgttcgaaaaccccttccgacatccggtcaaacgtccgatgtgatatccaaaaattttcatttcgcgaactaaacgtgcccttagaatcaaaacaaagcacataaaatcgaaaaggttgattctcaggccccattattcaaaccagaagggacccttcaaacaagtttccttgacccatatgcaatgcaccttgaccagcctttccctttctcgaccacgggcccacccccaccccttccctggtacaaaccatcgggtacgcgtcgcaattcacacccgattttttccgttcgctctccctcctcctcctcctcgtctccgccgatcgaaggaaaacaaaaagctagggtttagctgcctctctcgctcgccatcgctcgcggcgactcgctgctagggtttttgggtctctctctctctctccaccggcga

SEQ ID NO: 7895 - DNA, 179 bp, Oryza sativa
tggtgggaggcggcgtcatcggcggcggccgcggcgcatggtggtggtggtggttgcgctgtcgatgtatcggaaatacgggaggagattttgttgtggaggattggaggggaggcgatcgcagcagtgacgcgacgttgacgacgcccccgccccgcccggacgcgtccgtgcgcagt

SEQ ID NO: 7896 - DNA, 1501 bp, Oryza sativa
tggacatcctcgcgccatcgagacgcccaccgaatacgcctcttgccaaaattttcaaaaaaaaaaaaagttcacacaaatttgttcaaattttgttaggatttgtagtgaaactgccttagttattggtaaaatctgctataagacatccaaagtttacggtttttgccgctgaaggatatcgacatatcgtctgcctccattggttaatgatcagagttaatccacaaccatccactaatgttgcgggtgtccagcgatcaattgcccctttttagcccctccaaagaaaacatccttacggtgttctctaccaaaaagcacacaaattgcgtgtatcctatagaaattttttgcctaattcatacgtaaaaggaggccttgactttgaaattggtaggggagcaaggccgatctgggctgggttccattgggccgaatgcatcgaggacccacctgtcagacgggtccatgtaagagtctccaagaccaggtgcacgcagccacgcagcggagcaccaccagatctcccttggaccggttccatcgtctccgccgtggaccagcgccaaccctcgccaccgcacgtcgccgggctccggcgaggccgccggagtgtcgtcgggaagcggagggcctcctccgtgccgcgcctccctccgcccctcaccccttcctcctcatggctaggtcctgacctgaggtggggctccgcggctactgctccccgcctcgccccgcccccgcccccgccccctgcctctccgccgcggcgccactccgggctccggcacctccctctccgtgcgctcctgcggggtaagccggtgagggacgcttagtggaattgctagtgctcttactcttgcgttagttagaggtagagctgcttggagtgaggaattgatgttgcttttttttttgggaagaaaaaaaaatctactctgaacttctgaagcaagtaggattgcttgatgttgtagatgaaaccagtgctaaggaatgtggtccttttgtttgttctgtattgtatcccagtttcacgatgttgtttagattccagcatttgcatactccatagctttgttaccagtctgattatgagtgaaaccatggagctttccgtagtatatatgaaaattttcctttcttttctcagccaggaatgccaatataattgatagtcaacatcctaggatatgagacatgttgcatggggcttcagtttagtggatgagtgatcactctaacaactagtacggtagtaccaactagtactgccagcataattgaccacgttgcatttgacatcttatataaagtaggggattttattacgacgcatatgctgtagatttctcctttctatcgattttgtgtttatttttgtaccacctgtggattttaagtggaacaattctctccttttgttgcagaagttgtgtggagctatctctgatgctgtttatgcaaagacttatgctcacttcttgattagaaa

SEQ ID NO: 7897 - DNA, 1501 bp, Oryza sativa
agaaaaaaaattatggatctggatctagaggaagaagaacaactgaggaggtctagagactgtcgacatcactcttcccacgcggtcgccgtcgctgtacgttgcccttgctggcgcagtggtcgtcactatctccaccaagccgccgcccttcctcctcgtcgtagagccactgccgccggcgggattggaggggaggggaggagccgatctgccgctagcctccaactcgttggcgttcctcctcgatgagctgtcgccgccgccgccggccctccttctctttaccgctcctcctcaccgagacgagccaccccgccaccggaccttttcctcctcggcgctgctcctccttgcatcgtgagtcgctcccgtcccctaccctcctcctcctcctcctcctcctcctcgctgctccttcttgcttcgccaagccatccccgttgtcggccctcctcctcgctgagccgccaccggcccttctccttgcacgctctgagaagagggagaggtagaaggtccgctggggattgagatcctttgacgttactgttcaccatggcgttactgttcacagtgactgacatgtgggcccaccactctcgggcccacatgtcaggcaaccaagtcagagggaagttacgtcaaaggatctcaatccgtctgctggtttgtgtgtgagagagagaggggggggggctctgggggagatgatatggagtggttgtggattctgtaacctattatgaattagatgtatatgaatgaatacttcattttttttgattaattatgggcatttcgctttttcctgtatcaaaaagtatttgattatttcaaatactcatcccaaatattcctgccctttgaaatggtagcaacagagtctaaggcaaggtcatgcactttgtttctaacgcatgctattgtaaataaatgcatgaatcttaaaaaagaagagtctaatacaagatgtcttatttcttttccttttgcgacataacataagaacatatatctaacaacccacaggaaaagggagcataaagcaactgtgtaaataatttatttcccatcatttcttacgaaattattgcctcaaaaggtcaaagtctataaaattcgacaatgaaacaaagctaaccaaccattttacaagacaatttaaaaacataaacggaaaattgcaaatgtgaatgactgcaacgtcccaagcaatggttcataaggaaacatctattggtttagggctcatcaatctcttctggcgtttcattgaggtcatacccacaaaccccaatgccaaagctcctaggagggctaactggaggagtaggatactccttgtcggctttgatcagcatcttctcttctcctgatatcttcacagcttcagcagctagcttctcttccactggtggctggtcattgagatcaatgtgacagccactgttgccaaacctcataggtgggctcactggagcaggagtcccccatgctt

SEQ ID NO: 7898 - DNA, 1501 bp, Oryza sativa
acacatccggtctcgtgtccaaattcatctcgagtcaacgggaatcgccaaaacaagacagtgttgttgctgaaaccaaacttgggccttgagccttgtaatagaataggcccatctcggaagtgtctccctccacctccacgaattagcacttaaccctagctttattttcctctataaatagctttgtacatcctcaaaaacatttgggttttgtttagttaaattttgccaagtgtcattcatcttgtctctagtcctcgctcgattagtcggcgactattgattcagagcccctaatagttggtgtgttgatttgccgggtcgattagatctatcacttcaatcgcaactattcctttgtgcttaatcacctattcgcaatatttcgattggatcttatcttgttcttgcagtgttctcttgtttgcattgcagggatcatcaaccgcgcgtcacagttggtacgacatggtttgtggtgtagcgattgcatggcgtcctggacttgttctggttggtagccacgtcgcaaacgtcgcactcgatcaaagcgagagttatcccttcaccagaagatcgggccacgagagagagagcgtcatcattgtggggctaagtttctaatttaaatggttgcatatatccggttggatgtagaggccaggtaaaatatacccttatgtgtgctcgactttgttcaatagactgaaaaccataaatttgtgcttccctttggggtggaacaccaagttaatggttctcaatttctttcttctcattggaacccaagatgtgtggaaggaaagttgctttccctaacaaagcacccttctcacatggtttaggctcatcatttcattcacgtcgggtctttcaaaaaaaaaaggaacatttcatttcatttatgttgataaaatttggctgaattaataattatcacatgagccaaattgtattgttacacgcgttttgtgtgcttcaatttttcccaatttaattgaactgatatattaattgactgttaattatttatagaccaattgctatcacagtatttatatgtgcaatcctattttttaatgtttaagacacactactaaaaacgattttcctgtacaaggacatgtttagattacagatagaccgtaattggtcgcgttctgaaaaaatcatcgtcctcccatttttacgtgcagactcttaaaaggactgtacgtgaaaatcgatttttatagatgggccttttaaggatccgctcataaaaataagcctatttctgcagatgtgtttggttgcctggatggaggagcgagcaaggatgggcgggtgcaaaatgcctctccgggccaggctgaggaggaacgcaggaaatgagcttcgctcctcagccaggcccggctcgtgcaggcgcgggcacgagtgcaagtgtgggacgggctggtgcagtgatgggcaaggggttggcggatcccctcaccgccttctctcacatttgctc

SEQ ID NO: 7899 - DNA, 1159 bp, Oryza sativa
cattcacaattgagcaaatgacaagaagaaaccatgcttcacaacttcaaaatacaaacatgaatagtaccaatttatcatcaaatgtgaacgaatacaaaatattgtctgaagagaaagctaagctagttgctaacttaaagcaaatgaggtgtcatggttggaaaagttataaagcatatacgaattttagtgttgtcgcaaagtttttaaaggcatttttatgataaaaccttgtacgcacacaacaaacgtgcatgaattattaaatgaactcttgtgagattttatttttcaactctacactttaagtaccttcatttagttttaatgtataagaacttataagggagtgtgaataatgacatcatttaccatttccatcggggtatagaaatgagtatagatgtcacttatttctattttgctttgaatggcaggaaattatctattcataataatgagctggtttttatctacaaaatgactgggaaagttaaagttttgccaaagataaaataagaaagatattgctgtaaagtgcccattaatactcattattgtttcctaagtataaaaaaattccccctatatattggtcactattctcctttgatagtatgtcagatctaacagatctctcccttgtaaaacagagtgaacatttgaagaacggtttgtgtgtgctgagatcttccaagcttttgttaatttttgttattgattttctttactgtgcttgcaactggtatctagactatcttgtatcctcttgatttgaccgcatatatgttcttctgctataagcatgatttgtatttgttggttttttggatcgtgttctaatataaagtgatctgcatatataagctagacctgcatgttatccatcttttgtaatactttgccacgtactttgcataacatgttattatacgtagtatagtttctgtatgagggaggaacaaagagccggtaagatttttaggtatataccgctgaagtgtaaatatggtatgtgccatatttacttcacttctagttcatcctaagtatgatttgtcaatttatgtattagagaaaatgttgtacatctaacctcaatagatcttgactgatgtatcactgactttgtttttccttccattttctatccagg

SEQ ID NO: 7900 - DNA, 1501 bp, Oryza sativa
cgttcgttcacgttcacgttaggttcacgttcgttcaagttcattcacgttcacgtacgttcgttcgttcacgttctcgttcacgtacgtttcgttcgttcacattctcgttcatgttcgttcgttcgttcacgttcacgttcacgttcacgttcgttcgttcgttcacgttcatgttcacgttcgttcgttcgttctcgttcatgatcgttcgttcgttcacgtggcggcagtggagcggtggagcggcggcgtggtggcgcggcatcggcgtggcgcgcggcgcggcggcggcgttgtgcggcggtggcgtggcggcgcggcggtggcgtgccgcggcggcatcgtggcgtctcggcgtcaagccgccgcggcggcgtggcgcggcccggcgtcgtggcgcggcttcgtcggcacggccggcgcgacgtcgtcgccggtggcggccacatcgaggtcggggtcggcatcatcgtcgcggcggagtcgtgttcggccgcgacgacgtcggcggcggcgtcggcaatgaggcggccagcggtggttaatttgggagagagagagagagagatcgaggtcggagagagagagggaggcggcggcggctctcaccccagagatgcggcggcggcggaggcggcgacgacgacgcgcgcgagacgacgacgagatacgatggcagcgtcggcgtggggatgccctaggcagtggcagcgaaggagaagccgagagagagatcgatcggggaaaaaacttctaagtgttggtggagaagacgagggcgcacatcgggaatatatatacccctagatctttagtcccggttgatgagaacaaccgggagtaaagatatgttctcatcaaccgggactaaagatattttccagctatttccaaattctttttaaaccgggactactgataagcacactgaatattaatttccattatatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaaattaataaaaattctaataatcatatatacttagcatatgaatgatattaagttgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaattaataaaaattcaaataatcatatataattagcatatgaatgatattaaattaattgttaaaaactctaattaacatatgtaaatgccacatgcatgatttaaacttttaaaaattctaattatcgcatataactagcaattacatgatttaaaattgttaaaacttctaataattgtacgtaattaacatatgccata

SEQ ID NO: 7901 - DNA, 1063 bp, Oryza sativa
actgttttgtcctaaattagctagaaatataatttttatgggacggagggagtaagaaaaagaacatatataattactcgtaaatacgattatctatatagagtcagagaattcgaaccaaataagctacatgagtaggtttctactcgcaaatatacatgtccaactaaagaaacctaatcaagtgagctacgcttaaccctcacgacgacgacaattttcatgttctccgagctttgaaagaaaaagggtttgaaaaagaacacaccaagttgctagtttaaggagctttcaggcaatttaagcctaacactttccatggcatgtgctgacaacgagctgaggcgagaggccccctgatttggatgaagactcatccatcaacttaatttttctaatccctttatagctgaaatgttggacttggcctgaactagtccatacacacacacagtgcgcacatatttctgcatgttatactagctgacctgacagcctaatatactgtacctaattttgcttttgtgtttgggtctaattaattaaagtggagcccttttcagagggggggtttggatgcatctccaggagtagtcatcgtctttagctatttggatccacttctacttggaataataacacaataccacattgtgtgtgaatttgtctgctctcatgcatttgaggccactaggcatgtgggatgttgtccatctttgcgtgtcctcgagttcacatatttatttgggtattaattcatttgcaatatgaggctctgggtcctatcaatgtatgtgtacgtatgggcattgctcctgccgtacagtcccagactttggctgtctttgcagcttaattcaatttatttttggatacgtcgaccacaagcaaattaaatcatatgtcatcatatacaagcatgcacggttaatttgtgatcagtagctatatatacaattaagtagtgatgaagaatggctggtcaatttcttgacgatggcttgtttgaaccggataaattagaagcaaattgttcgtaaattggtgctgatttcagtccagt

SEQ ID NO: 7902 - DNA, 821 bp, Oryza sativa
actttatatctaaactcggccatagtatctcgatactgaggccatgtttagttccaaagttttttttccaaactttcaactttccatcacatcaaacctttcatacatatacaacttttctatcacatcataccaatttcaaccaaacttccaaacctcggtgtgaagtaaacacagcctgactacgggtgtatttagttcatgtcaaaattgaaagtttggttaaaattggaatgatgtgacaaaaaagttagaagtttgtatgtgtaggaaagttttgatgtgatggaaaagttagaagtttaaaaaaaaatttggaactaaactcggcctaccttctggtggtaggggctgcagctgcaccatcttggttgctagcatctctcttattaactcctatcaactgatccaccctcactgatcactcttgtagagtcttggtgtacatttactcctactgcactgcactaccaaactctccttcggccctcacctcacaccttctgttactgttagtgggccccacatttgcaaccttctctctctaccactctcttgcgcaactcctcctctatcgatctccttcctatatatacatgctcacttggacacaacacattccatctcccaaagcagcagcagcagcagcagcagcaggccagcagctagcattatcagagagagagagcaaagtgtgctctcttcttcctcttctctgctactaatcaaagctagccagctagagacatctatagcttgggagaaagaagaaagctgagagctctttcttgctagctagctagcaatggcggcttctgctg

SEQ ID NO: 7903 - DNA, 1501 bp, Oryza sativa
tcaacgaattttttttttggaaaatggtatgcatacgatctaactaaacaactcacgtacgtatgtaaagatgttcttctttaattgatctacgagtacatgtatttagttgtacatgagtatttacgtgtagcagtactattttttttctttttcagcatagcattctaatagtattaagaggagggggggagacacaaaagaccatcaagcttggccgtgcatcggagcgcatagttgagaatgatgcaccgaccatacaaacacaagccactgagggggaagtcttagcaccaaactcatcacaactatatgagatcgatcgctcctagaccaacgtttgaatatatctatatttgtgtttagattgaattgagttggaccttcaatttaaatccaaatggaaattgaatttatctttattttagtgtttgtgttgggttgactgagaataggtagtaacttggattaagggtgggggtaggggtgggaaaaaaatatagaaaaccggacaccgagccgaaccgagccgaagtagcagttttttctatgtttggttttttcttcggttttaatttctccgtttgttccatggttggtttttgtttggtttgctattcttaaaaccaacgcagccaaacaaccaaactatgtagggaattttttttatttataattttttgtattaaaagttttacaaaaataattttccattttgaaaattgacggaaggagtcgcctaccgccctcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgagggggggcatggaattttgcaggcggcccccttgccgccctccgctagggcgattttgtactgtggggggggccgcctgcaaatgggcggcgagggggcatggaattttgcaggcggcccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgaagatccagagcatagaatataatagtatgaattgagacatagacagtagtgttaattgtaagatgtagtttagtttgatctggagaatgtaatgtaattttagaaatttagagaacaatattgtagagaatgtaacttagggcgtagtacagaaatgcgaggttaacgcagttattgttttcatcaggcacaa

SEQ ID NO: 7904 - DNA, 1501 bp, Oryza sativa
ccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggccccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgagggcggtaggcgactccttccgtcaattttcaaaatggaaaattatttttgtaaaacttttaatacaaaaaattataaataaaaaaaattccctacatagtttggttgtttggctgcgttggttttaagaatagcaaaccaaacaaaaaccaaccatggaacaaacggagaaattaaaaccgaagaaaaaaccaaacatagaaaaaactgctacttcggctcggttcggctcggtgtccggttttctatatttttttcccacccctacccccacccttaatccaagttactacctattctcagtcaacccaacacaaacactaaaataaagataaattcaatttccatttggatttaaattgaaggtccaactcaattcaatctaaacacaaatatagatatattcaaacgttggtctaggagcgatcgatctcatatagttgtgatgagtttggtgctaagacttccccctcagtggcttgtgtttgtatggtcggtgcatcattctcaactatgcgctccgatgcacggccaagcttgatggtcttttgtgtctccccccctcctcttaatactattagaatgctatgctgaaaaagaaaaaaaatagtactgctacacgtaaatactcatgtacaactaaatacatgtactcgtagatcaattaaagaagaacatctttacatacgtacgtgagttgtttagttagatcgtatgcataccattttccaaaaaaaaaattcgttgaaggccaagtccattgtgcaacgtgtgtcaaaaggtcaaaacgtttgtctgcgcctgctagtgcacttgcacttgcattgcagcaggtaggcaaaacgaagaccacccaaatcttccgttcccatttttcgtgtcccttccatcatcctttccccctctatattttcgaggcgggggctccaccgaccaaacgctgcgctcggtccaccacacacctccgcctgcacggatcacgaccgcgcggtgcacggcgtccacgccccgtggaccatgtccacggaggggaagaagaagccgacccaacctaacccaacccaacacattcttcctcctccgcgtttgctccaatc

SEQ ID NO: 7905 - DNA, 1475 bp, Oryza sativa
ttttttagaaatggtgtatttctttctgatagtttttaatagcattttttttgtttttttcagacgaaggaaaccgtatttttcccgcgcatttttttggaaattatttttttcttgcgcatttttttcctttttaacggatgatggaaacttctctctctaaaaagttagattagattgatagattagattagagttaaagagatatatacggacaacaaggcgactttaagtttggccgggtcgttttttcctccttttctttttacggattttgagttagatgtatttttccttttttttattacggacgagaaaacctctttttcacgagtcggactttttttttctctacgggagtcggtcttttttttctttttttacgacagaaggttttttagagatagatatttatttttaattaggtatttattcgcgcgtgtttcccttcggatagaaactttttttttcgcactattctttccttttgtaggaagatggaaactcttttttcgcttggaattttttttattttggaatcggacagaaactatttttgcacgcacttttttattcgcgcgtatttttcctttctctgtacggacgaaggaaatttctttaccggtttttttatcggacaaactggtttttgtttgtccggtttttttcacccggtttttttgacggacgatggaagcacctcttctttttttaagtaaagtagtagatagatagatcactgtctttttgtgattagtaatttaaattgtttgtttattttttaaaacaataagggcaaaaaagagatcggaagggggagaagcgaagcaagcgcaaggtgtggtgggacatatttttatcttttttattagatcttttgtccttttgtgattaggaataggaccgattattttaatttcgctcttttttcttcaggtccgattttttttgccatgatagaatggacgacaaaatcatttaaattttttttaagtagtagagatttgtaacattagcttttacgtcgctaaaaacacataaatataaaagttttaaatacaattaatttttatcgttgattagtgtgacaggttataatcaacacaaattatatatccatgcgaaatgtctagcttgcacataaacgctacccatataaatacaaggaaaatcactggccttttcttttcttatcttaatcttaactaattaaaagattagtatttttcagatcgtcacttctccccgtttcgtccgggtgcgattaaaatcaggtgagaaaaaaccgggaaaaaaataaatccgatcccgtgtaaaaaacacaaaaaaaaaaataaaaaatcgaatctgtccgatagaaaaaaagaatcgggtaaaaataaagaatctgattccgtggacgcggtaaaaaaagggcgaaaaaataaaaaaaccaggcataaaaaaatcgagtgagaaaaaaccggggaaaaaaa

SEQ ID NO: 7906 - DNA, 1501 bp, Oryza sativa
cagatttaacgtagagccatggcaattctatattgagaccgatgaagcttataaaaaatcaacaattcaacaataataaatatcaaactaataaatctcaaactgtgctttactctgtgaaggcaatcgaagagatcgccagtttctcaagcggcgtgcacgtttgtaaaggcctctcgatagaatcatcgcggcaacgctggtttcgtctattactactgcacgattgtatttggaagattataaccataacccagctatctttacctggatggctttatttatgtctttatgttgtactccctccagtttataacatttgactattcgtcttataaaaaaatattataaaattattatttattttgtttgtgacttgctttattatcaaaagtattttaactatgacttactccttctatttcacaatgtaagattttataatattcccctcatacatatagatattaataaatttaaacacatgcatatgtctagattcattaacatctaaatgaatgtgggcaatgctagaaagtcttacattgtaaaactgaagcggagaaagtatcttttttatattttccctaatttttttaaataaaacgaagggtcaaactttaccagcaaaacatcaaaacgacatataatttgaggtaacataagttaagacaatgtactgtgcatatttatatttccctaaactcttattaataacgtacaaattaagttattttttttagaaaaaagaaccggcaatggggcaatatcacgcggggagaagcaaggtacgtcccaatccggggcagacttcgcgcgtgcgttccgaattttttttatttttagatttttttaaaaaaaatatttacagaaataatctatcggccaaaaaaattgcaaaaatagaccctgccgcccacctctggggcggcaagctgacgtggcaaacgggggagggacgggcggtgacggagggagggtttttttgcagtaaagcccttgccgctctcttttggggcggcaaggggcccgaatgcaaaaaagctagtcgaggccggtcattttgcaggcggccccttgccgccctctggccgggcggaaggcctcgctgcctataaaaggcctgccgcccagcccccagccctcattcctcccctcaaatccagtgaaaaaaaacaagaagaaaggggaggagaagagaagaaggggtgaagccctgccggattcagacgccgatttcaggtaatattcatagatcctatatgtgactattgagttaaatagtgtattttttaaaactttatttgaataaatacattatatttttagggttttagttgtactaatctagaagtgcgtattgtagatattgttaactatgtagatctgctagtttggaatcaatacttttccgttgcattggcatacacaagaagatattacgttgtagatgtttattgcatgaaagagtaatatgatctagttattttgttgacagata

SEQ ID NO: 7907 - DNA, 1501 bp, Oryza sativa
aaattgaccaagtatatatgtaagtagatagatgaattgagagacgtatgcacgtatatggatgaaaattggtatgatcaaattggattatgtgcaacacatgttattcaagatcactaagtgttgagttttgatacaaatttatttgcacttaataaaggccagcttctgccgtagtggagcggaggcccgtcgccgagaggcttgggccggtgcgtagcggaggcccattgggccgtgcacctggggacgcccggggtgcgggggcggagcccccacgaaacggatcgtcatcccttccagggttccaccatatatatacctctggtaagccaccgtgaggcgttgtaatctcaccccagatatagtgaagatattttgctcgctggcgcccgtggttttttctctcctgttttgggagggttttccacgttaaaatctcgtgccttctgtgattgatctattgttttttatcgtttatttgtctatcgtttcctaacactaagtaccaacaactcacctcaccgtattaattaaaacgctcgttttcgagcgcccgatgcgggaggattgtgtgaattcgcttggatattttttttagaaaattaattatgagctgcaattaggagtccgactttcatctcaaattagtacgtgagtttttttaaaaaagttttcttatacgactccttttgtatttctaaaactgaatgaacttaaaggctgattcaaatacggatttgtatttccaaaagataacgaactttaaaacctactcaaacacggatgacgtaccaaaatactggcaaaaacatatttaattttttaatagtagagatagagatactgtggttggccgagtgctacacatgtttttcatatatggttgacctagtgctacgtaattatttcatgtaaagtcgtaaaattgcaacgttttgaggatcctattatcgacactaaattattataaattgatacccaaattttaaaattgataaatatgaccattaattctcgatcgaccgagaatttacttccataaaggactaccgattccgacagttttcatcgtaccccatctatatgaagtgattggcttgcacataaaggatacccttttacaaggaaaatccgttggccttttttttaaaaaaaaagtttttctaaagtaaagtaatcgtgcatcctcctctttcgcaatttttttttggaacaattcaccgttgcaagttaccatacgtacgtgcagtgcaggcgtgcagcagagctaccgtgcgggctcgtggctcccgtacatataattacgttacgtgcggttcccttttttctctctcgcgggctcgatatcgatggatatgggccctgctgcgctgtgctgtgtattcagtattcgacacggatttggcgaggactcccgtgcacatagcattaaactgattggtatttgctcgcaataaccccgcacgcgtcctatatatacataagccggcacgcgacc

SEQ ID NO: 7908 - DNA, 1501 bp, Oryza sativa
tgtggtcctccgtgtccacctcgtcgtcctccgtggtcgcgctactggccgcgtcgttgaggtggctgctcgtcgcggtggtcttgttcacgtggctcccgttgatgtgccctgtccaggactgcagccaaccatcccgctccctcccccacgccgccgcctacgccgctgcggccatggcgctcctcgccgcggcgtactacctcctcccggactaccaggtgctcgcgtccatcgtcgtctggatcgcgtcctccctcctccgccaccagcggcgacatctccgtcggccgcagggatcccctcccggagcaggagcccgtcgaggaacccgtcccggatcccgccccacctcccgccgcggtcgcccgctgcccgccgccgctctcgccggccgtcgctccgcctgtctcgacccgtcgaagaagacaagagaagagaagaaaggggaagaaagaagggatgtggggctcgcatcgttttctctcacttacatgtgggccccatgtactttatttatttatttttctgactaggatgccacgtcagcgaaaccacccacatatactgtcatatgaccttgtgtgcacggtttgtgtaagtttaggggtgcacatttctggttgggactctctaaaaaaaactgtcgacagttttttgggaaaaaaaactttcaaatctaactatagcataattgtaatagttatactgtaactataatataacttttatataaatattaaaataataaatataacttcatatctaacttatatagagattataacgtagttacactacagttacactataataactatagtgtaactactatagttacagtgtaactatagtgtaattacatggtagttacactataactatattatagttacatttgactgttttttgccccaaaaactgtcgattgttttttagcatctctgtttcgggttttgtggttaaaggacctcaaaaaatctcgttgttaagttgagggacctccggtgaacttattccaatagaaattgacgccttgaaatctgcaattaatgcaattttgggccatagaaatcacctaattgggccttcactaaacgagccgtctcaataatccggactcactcacatatgctgccttcgacccccaaacacccccaaatccgactcggtctcctcctcctagaaagaaaccaaccacacggccccaccagcccagcacgacacgtcacggccgacgcggctaaactaaactaaccgaaacccaaaaccgccttcgctaagtaaaggcgcctccagagcagaccggactattccaatccggaccaaactgcccccaaccttcttgccggaaaagaaaggcaaaccgcgtcggaatcggaaacggcaaacccccgcctctataaatccacgctcgtcaacgcgaatcgtttcagagctctcgaggaggaggaggaaggaatcatcaaggcaaccgatcaaatcgtcgatcgattttcca

SEQ ID NO: 7909 - DNA, 1501 bp, Oryza sativa
aagaaaacttttttaaaaaaactcacgtactaatttgagatgaaagtcggactcctaattgcagctcataattaattttctaaaaaaaatatccaagcgaattcacacaatcctcccgcatcgggcgctcgaaaacgagcgttttaattaatacggtgaggtgagttgttggtacttagtgttaggaaacgatagacaaataaacgataaaaaacaatagatcaatcacagaaggcacgagattttaacgtggaaaaccctcccaaaacaggagagaaaaaaccacgggcgccagcgagcaaaatatcttcactatatctggggtgagattacaacgcctcacggtggcttaccagaggtatatatatggtggaaccctggaagggatgacgatccgtttcgtgggggctccgcccccgcaccccgggcgtccccaggtgcacggcccaatgggcctccgctacgcaccggcccaagcctctcggcgacgggcctccgctccactacggcagaagctggcctttattaagtgcaaataaatttgtatcaaaactcaacacttagtgatcttgaataacatgtgttgcacataatccaatttgatcataccaattttcatccatatacgtgcatacgtctctcaattcatctatctacttacatatatacttggtcaatttctatatatcatttacatgttttggtaatataacattctatatcatttaacggttgttaaaattgaacttgcaatcatgatttgcacttccatttacattgcgagcttaattgtttgcaacaataaatttgcacaccttgcaatgcgtggacataatactagttcaaataaaaaatgatatacatatagatatacgtacgatcataagattcgactaatgcagaccctgttttatatcccaccccaaaatttttcaccctgtcacatcgaacgtttgaacacatgcataaagtattaaatataggctaaaaaataactaattgcacaaattgcgactaatttgcgaggtgaatcttttaagtataattgctctatgatttgacaatgttgtgctatagtaaatatttgctaatgatgaattaattaggcttaataaattcgtcttgtggtttattgatggattttgtaattagttttttattagtgctcgagcaccccatacgacactctatataatatccaatgtgatgtgacaaaactttacacccttagatctaaacacccccgtagtatatgactagggctaagccttaggtggtgtttggatccagggacttaactttagtccctgtatttagacactaatttagagaattaaatatagactacttacaaaaataattcaataaatgaaagctaattcgcgagacaaattttttaagcctaattaatctataattagaaaatgtttactgtagcatcacataggctaatcatggattaattaggctcaatagattcatctcgcgaattagtccaaga

SEQ ID NO: 7910 - DNA, 1501 bp, Oryza sativa
tctcataatttacacgtaatctatgtaattagttattattttatatatttaatactaaaaattttgcgaggggataacgagtcattgctcacatgtgtcagattccccgagatgcagacatcgatggagctttgctttgactcggcctatccggttcacacgcggcaccaattcctctcctgtggaattgaggacgatgggatcgtcttcttgtgcgcaggggagttcgccgttgttgcaggggcagcagggcagcgctctctggcggccggacgttgaggcgtttgtccgcggcgtccacgacgccgagcaaattggctcagcgcagcgtctttccgagctcgcagacgagacctgaaaacgatctcacgtttgtggtgtgcgccttggggaagtttggctggcacgaacagtgaaacgagggggcagcagcagcaagccgcatctcacgaggttcggtgggcattctgcaccgtccggaattccgagagaaaaagggaaaatgtttgacgtgtcttccctgagacggtgagaccctcatcggtaagaaatggcagttgatataagatcagatccccatagtaggaaataaaaataaatttataggtaaaacttttataaatgggtttttggtgatttaaaaatcaatgttggaaaagaaagtacgttgaaaatatttcaaaatcaatctcaaaattaaacttaaaaatttaaaatttggctttttcgactgattagaccatccaacgatgggagcctcattctttttctgactcttctttcggttttctgatagagatgtgcacgagtcggagacgcatcgtgtgctacgactcgccgcaaaacgatcttgctaggtcaggtcaaccagcgatttcatattcttctattacaccacattcgtgcgttgcacgagacaccgtgtcagtcaagcggcgcactcgcctgagctcactcgctgaaccaaccaagcaaccggtgtttccggccaaaaaaaaaaacgcccaccccagccgctgaacaaacgcgcggcgcaccacccccgccccgtactcccaccgtgaaacgcagccaaaatcacagcaaatccaccgcaaaaaaccgcgacacggagacccacccgcccgcgcgcgatcccttcctggctaaggtttgtctccgcataaaaccgaggagaagcgcgcacacactgacctcagttccagccaaggcacccacaaaccacccgaaccccaaaagagaaaaataaaaaaacaaacccaaaccccccgagacccaatggccgccacagcaaaagcatcactacctccacctcctagctcctctagctcctcctcccctcgccgccaccgccgccgctgaacaccacccccgcagccgcgcgcgcgtttcatgggtgcgggccgccctcgccgctggaagctgccgttccaccgcagcgcgccgtcgtctccctcctccccgccggaccccgagccccactcgcctgcgcgttcggcgg

SEQ ID NO: 7911 - DNA, 1501 bp, Oryza sativa
gaaaaaatttatgtacaaaaaatttgaattcaaattcaaatttgaatcgggtacgtaaacttttgacttataaactttggatctataaacttgtctataaactttaggcctatagaaatactatatatgaaaaatatttaaatttaaattcaaatttaaatcggaaatttgaattcaaattcaaatttgaatcagatataattcaaattcaaattttaaatcgggtataattcaaattcaaatttgaaatcgggtatataaactttaggtctataaactttaggtgcataaactttagatgtatagaaatactatatatgaaaaatatttgaattcaaattcaaatttgaatcggacataatccaaattcaaatttgaatcggatatataaactttaggtctataaactttaggtgtataaactttagatgtatagaaatactatatataaaaagtatttgaattcaaattcaaatttgaatcagatatataaacttttgacttataaacttttggtctctaaactttagatgtgtaaacttggtgtataaactttaggtatataaatttactaaaataggaaagtaatgcggtgccaaaaaaggaaaccaggtggagagagggagggggagggggagggggagggaaccgatcgctctgggcgggcgagtgatcgctcgcccagtagcatttccggcgggggagcgcccgatccagctccgcccgcgccgggcgactggccaacagcattatcgaatactccgtccatccaaaaaagacaaaccctggtttccgtgcccaacgtttgaccgtccgtcttatttgaaaaaattatgaaaaaaattaaaaagacaagtcacgcataaaatattaatcatgttttatcatctaacaacaatgaaaatacaaattttaaaaaaaattcatataagacggacagtcaaagttggacacgcaaacccagggtttgccttttttttttggacggagggagtacataattgtttagaccaaaagaattcctcacttccggtccaagctctgacttcaggagtgccaacctggttgtgcagaaattgaatccaccaacctggtcgtcttgctggtcagcttctcgccagcctggccacctgcatacaacccttcgcgcaccgtcccgatctcagccatggacgctcgctccgccgtctgtcgccgcttccatgtcctacgcaaatgctccggcgcttccccattgtcctctggcctctgcatagaattcctcctttcctagctcaggccaccgccctcacttccatttgtttcctacgttgtcacgcccagaaattctcgaaccagaatttctaagctgaatgtgcattaaatccctgtccaggaccagccagggtacacaaacgacaattgttgacatacagatccacgtcttataaaaaaaatagaaaagattacaaatgcagcggaaaagataaaagcgagctaaaccgggaagcttgacttcagc

SEQ ID NO: 7912 - DNA, 1501 bp, Oryza sativa
aaaaaagatacattatttaagataacccaaacaaatgtgaacaaaatatcagatacaaaaaatgcagctaaggcctggtttagttacccaaatttttttcccaaaaacatcacatcgaatctttggatacatgcatgaagcattaaatatatattataaaaaaacctaattgcacagttagaggggaaatcgcgagacgaatcttttaagtctaattagtccatgattagccataagtgctacagtaacccacatgtgctaatgacggattaattagtctcaaaagattcgtctcgtggtttccagacgagttatgaaattagttttatcattcttatctgaaaaccccttccgacatccggtcaaacatccgatgtgacactaaaaaattttcttttcgcgaactaaacatgcaccaaggccgagtttagtttcgaactttttcttcaaacttccaatttttccatcatatcaaaactttcctacacacacaaatttccaacttttccatcacatcgttccaatttcaatcaaactttcaattttgacgtgaactaaacacaccctaaagagcgaaaaaagtttctacgtgtctcatcgagcttataaaaagtctttgcattcacacatatttctctccaccaaagtcaatcaaataaatactcatcatccattccgtgtggaaaagaaaacaaaacaaggaacggccaccaatcattccaacgatatcacatcatgcaaccaaacaaaatcaacaaaagcagaaaggacatttctcatgcattcactgtcacaacccataaggccataataacctgcttaaccacaaaagaacagtatagtctttcagcctctcctataagtactccccaactcctcctcctcggttttcatgccacgcttttcaaattgctaaacaatacgtttttttttaaaagtttatatacgaaagttgctttaaaaaatcatattgattcaattttttttaaaaaaattaactaaaacttaattaatgacgtgttaaacgctgcttcgttttgcgtgccggagacactcccgaacagaggctaatagctcatccctgcatcatcatcatcatcatgatcatcatgaatcaatcacccgccgtccgttgcatcggacggcggaggatcgccggacgccaacccggattcaaaacctttccgctacattgactgaccgctccacccccctgcaaaatccccaaactacccctctcctcctcctcctccttcccttgtctgaacggggggagctgtggccacacctctccccccacctcctcctcctctagggtttcctcccaatcccctccatggccaagaccaagcagggcaagaaggacgtcgaatcctacaccatcaagggcaccaccaagatcgtccgaggtacgggccgcttctcgctttcttcatttccggccaagatttgggtctctttagtttcttcatgagggtttgtggtggtggtgtggaagtgg

SEQ ID NO: 7913 - DNA, 1501 bp, Oryza sativa
gttaatcaggtgggtcatgtgcgtgttgctttgtcttcagattaattaattatgtgttggtgcaacgaagtaaaaataaatattttattttgtaatactatgtaaaaatatatataactaaaataataattaaacaggcctcagaacctacgaattattaaaaccgtcacttttgaatccttatatagttatatgtgcaggatttctactacctccgttccaaaataagtgtagttttaacactgttcatgtacaatgtttgaccgttcttcttatttgagaaataattataattagtatttttattgttattagatgataatacatgaatagtactttgtgtgtgactagtattttttatttttttcataaaatttacaaataagacggacggtcaaaacgctggacacggatatctattgctgcacttattttgggacgaagttagcatgtagtatgtattcaaacactgatgctttccaggttcattaattaagaaaatgacgtagtttatgattggtctaaacggttggcacgtagcaacggaatgaacctttttgttcatgtacgtacctccacacatagtgctttttttcataaaaagctgccacgtggtgtatattataggctaattattgttctccatccattcacgtctcacgaaaagaaaaggccggtacactctctggaataattgcgagctttttcctgatttcgtacttccatgactgtaatagtttgaaagtatttttcgttatataaatttactagtgtgatattttgatattatatctttttacaattgtgccctgaattaagttaataaaatttaaccgcacggatatatgtggacatgatcgataaaaaaagagatagtggtatatatatatatatatatatatatatatatatatatatatgtacatttaattaatgatatgtaattgtgcatatatttgtgtaggagtcgaagcaacattattacaaaaattgatacaaggacaactagctgagctgagtgaacattttgctaactagctgggccagtatttcacgggaaaagaagaggaatggttgagcaggccggcctgtgcgcgggagtaagaagaattgggccggaccacgcataagaaaaggaaaaggaataagttcatctgaggtcccttaacttgttgacgaatccgattttcatcgttcaaccatcaaaaccggtgcaaaataagtcccaagtcagtttagacagcggtttttgctgatgtggcccatacatggctaatttgactcggtcttcatcacacgtgacattgacgtggcgcttacgtggcaatttaatttggaaagtaataaaaactatcgggtccacatgtcagttacacaaaataaattaatttaaaaatggtggagcccacgtgggccccacatgttattgtcaccctcccttcttcttcctcctctctccccatctccctctcttcatctctctccctctcctctttccaga

SEQ ID NO: 7914 - DNA, 818 bp, Oryza sativa
actccttcctcgtgagctcttcttgcccacgaaacactagtgctttgtatgtagtaatttttatacaacagataacttgattggtatgatctgtgaaatgatgttggtgtttggtgaacaaagttcatctaacaacacaaatagctacaaggatacaatttactactgatcacatacatagatatgtgtatattataattaattatttgattatgagatacagctagctaatggacaatctattgtactagtagttggctttagttatgggctattagccagtagcgggctatactattagccttgctcttatacttaacttatgccaaagagatacacaacaacttgcttgtacacactcccccaagttcaacccaccctttttgtttttctttctttccttttctttttcgtttcttcctcaccgtgccaaagatgaaaaaaatcactccaaatcgccgtagaaggcagcgccacaattaaaaccatccaaccatccatggtgccgtggtggtcgctgccttgcgccgcagagcaacgcgacagcgcaagtgacagtgacacagcgtcgtctcagctcagctcggctcccgagcttgagtcttcctcacgccactgctcccccctccccgccccgcgtcgaacaccttcctcctcccgctataaatccctctcgtctccctcctccacctctccccccgcctttactccccgcacacccgcgacaagctcagctcggctaggccaagacggtggcgagcggcggcgatctggtgctctgcttgggttgagttcttgattttgccgaggtgtatcga

SEQ ID NO: 7915 - DNA, 1501 bp, Oryza sativa
attagtgatcagcacaatattgcaccacatcttgatgaagcctcctttgatctttgattaggagaagcaccaagtaataagttgatatttatgtgtgttgtgatgagctgatgatagagcaccaagttggtactggcacgcgattagtgatgattatcagatgacgggctagaaacccagcttgttttagataccataatgagagactcttgaaagaccttggacacttcccataattaaattgcatgaaattaatagattaggatgaggatgaatgcatgcattcctagtcgtttactggaccaggttggtgttgggatttcaccggatcaaccaattaggaatgcattatattttaggaagcaaagctcttcaatcagtgagcacacttcaagtaaaatgtaggtcttgttgcagcataggtgtaaaaagacatcatagataacaactaattctcgtaaagttcgttcggttcaagggagagttacttacaagtggagtttggcaaggaactagaaggaagagccttcttgagcaaaagcgagtcaaagacggatcaagcttttctaaaagaaatagctctagcgtgaaccactgatcgctactacacgtaataattattctcgagaagggacagatgcggcaagtgtcaggaagggaaggatttttaatcatttatctgctccatagacttttgagcttagtatggagttggctggattagatcctcgttggtccttgaagaagaaggcaaaagacttaaaccctttattttctaatttttggcttggctctcctaaagaattgacttcctagatccgcatgatatacaatttctttattcagacaacgggtcaacaaaagaatctttttcatgaaatgatatggaaatcattgttttatttctcgataatggtagaacccaggactctatttcccttggctttgtatataacgttgcaaactacctaccttacttccctaaataaataggttcttttcccaatatcctatgttagtaatattagtagaggatagttcaattcaagaatgctcctcttaccccaagggaacttggtcttagagtaaaagtcattctgccaagaagaaattactaccgggttcgtttttccattatagaattggccctatcgcttaaggttccttttaagtacgatcatatcagtgagatgaggcatatcgactcaatcaatacacgcgtgaactagaacgaagcaaagttttgcctcttgtcagaaattttgcttcctattattccatgcttcttcgttctagttctctcgtagtcgtgtttgttgattgagtcgttcgatcccagtgaaatcccaacagttaacggtatggcatgcatttgctggttggatacaggatgatcataaccagtgacgaggttgttctatggtgtggtcttggagctgtggtaactcttctcactggtggagaaagggtttttactcccagatcgtaaccctcctgtagt

SEQ ID NO: 7916 - DNA, 1501 bp, Oryza sativa
gaacccagaaaccctagctcacccatactccatctctgctcaccgccaacaacttccatcgtacatgagcccaacccctcaccccccacaaccaccccacaaggtcaccatggatctgctgccgccaccgctgtctcggatgagctcaagtggatctgctcacatccgctatgagcaaggccgccatggatgcgccgccactggtggatgagcttgcatactgtacacatggacaacctcgcaggctccagatccagatgtgtctattggcaccaaatctgattcgccgtctcggccgtggacaacctagtatgaaacaaacttccagttcattcaagttatactacttgggatgaggaatgctctcgcaccatgacaaaaaaaagtcttaattaatgctcctatacagctttttgtaagcagtggctcttccatttgattacgtagttacaattcgttaatacatcattactagcaaatattgtctctaattcatctatcttatttgcagcaaacactacattttattccttagtatatccaaaggaccacttggccatacctcttgacccgacaaactatcacaagaaaagctacatagagttccttactaatttgtaagtaataagataccacccccagcgccacccccagcccgccccgccgtaccaaagggctgttctgacgtttttaagtaggatgagaaaaagattttatcaggccggtgcgcagaggttttacttgaaatatgaaaggtcaatagaggagcaaatactaagctaaacgccaagacagtttggttggtactgacatatgacatgaacacaaattctttgaataattacttatttataacgaccgatgttcttattatgttcgcagtgtttcaagcaaccccctcggcatcttgtactatgtgaatattacgtgcatgagatgatgaggatgctaggtcccgacaacaaccgacgagatgcaaaactgtgtaagatcaaagtgtgttttgattcttattctgtgatgaataattagcatctgtgattattggttttgatatttggagattatcgtcgaagtggttttggaaataatcaattttcaggtgatgatcggattcactattattttatgtgatcggtccgaccgggtggagcttgccggtcagaccggcgctatgtgtgcggtcagaccggccaggcccgcggtttgaccggccgacactgtgtcggtttcggtttcgggttgtttctttggatatccatgattgtttcatggttatggcttctagatggatactatacgtatgagatactattatttgctactaatgagtcaagtttgggatagcttggtcccggaatattgtttctttgtttgtttcatgtgtaggtgattcgatgtctcgggagagtatctgtggtgatggaccgggagtcggcttggtggtaagacgatgtccgtggtgatcagatatcatgcgggatactaaggctagagttga

SEQ ID NO: 7917 - DNA, 1501 bp, Oryza sativa
agaccctctcactcctcttttctccagtcccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgaccctccgatgggatgggtcataccaacctccactccgccggaagcaagtgcaacgtggaagcacggttgtttgctgatgacgtgaccggcatcagaccagtcacaaaccggtcattcttgtctaccacgtgtcagtttagcatgccacacgtcagcccttcttcataaaatgacttccttgtaatggttgcgatgaagcctggtatgaatctagccgggaccgacgtgctaactccaggagttcccacgccggttccatctagggacgagtgcctagaggctctcatcattccgacaggacggggcaaggcgtgcgaaaggccgcctgttgccacataacccgcggtctgaccggtctgtgaccagtcacacactgtgccctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagggggtcggggcgccccagccctcggggacaaaacgggagcggcccgacccctcggggagatagagggaggggcggtctcatcacccttgggcccgacccccccgagggggtcaggccacgtgggtgaccgcggctgccccaaacctctagtcaagatatccccggtcccatgtcaccgacagtagcccccggggttatgccagggcgatcaccctcctcgaggaaaacgctcgggcgtgacgccactcctcaggcctggtgacaggtggggccggtctctaaaagcggacaggaatccagtggtcgcaaatcgcgcgcatcggcaagggaaaaaccgaccgacaataatgagcggctttcttcaagaccgctacattactcgagtagcgcgcgaattgggacgagccggttcgtttcgcctggagatgtgatgatggtgcatcggtcggcgagcgtagttaacgcgcgcacgatatgtcccatctcgactgccacggccgcacatccgcctcgtgcgccgcaaacgggcgagcgggattagtggaggagttggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgtta

SEQ ID NO: 7918 - DNA, 1297 bp, Oryza sativa
tggataacgagtcggtccccgtcgagctcgacggcgacgggggagatgagacgagatgggccggcggcccaagcgcgccaccgctcaggcccaggaagaggaagcccattaacaagcccaatcatttatttattaaggttttattatatttttctccttactttttgtcgacgacatggaatccgttaattaatcaacaaacaaacggattaaatgggctgtccatcttctcatattgaatagaaatgtcagttactagatcactgatcaatgcaaatatatattatatatacctcctccgctcaaaaataaaccaatcgagtttgtgtagtactattgatttattactccatattggtttatttttacaatggaatgactactctatatatactcctatagtcacaagtcagacatgaaggacaagaccaacttttggaattttgactgattttttattaaataagtttatagaatctaatactccctccgtttcacaatgtatatctatctagattcatgatatcaatatgaatgtgaaaaatgttagaatgacttacattgtgaaacggaggaaataatttataataatattttttaagataaatctacacgtgccatttactttctttttaaactaatcatttgataaactatcgacagtcacatctttaaaattttgaccagatctttgttaacaaacattaaatagcagttgctatatattaatattactttctctattttaaattataagtgttttggttaggttttgaataaatttatatatgggtctatttacaatataccacgtgtccaaattcatacggatgtaaatggatttttatattaagagatcaaaacgtggaacggagggaatatcatccagcatgaaatcgatgcattgatgacgtgcacgcgcatgtacgtatgcattatgcttatgcatgtgtacatgctaaactatatatagacgaacagccgttggatcgtgtgtacacaggaaaaagatttcacacctaccgccataaaaggctgaaactgtcgtcgccagttaaattaattcattcacactgtaattaacttgatcaaatttaactgatccttgtaacaattccacttttacgctgagtttgttactttttttctagcttgttgcttgaactgctgtagtataatattattccagtatataggaataggagtataaagagatttatgatgttgcagctgattgccaccatacatattagggcatacttattatagttgagtgtcaaacttcaccgctcgttgg

SEQ ID NO: 7919 - DNA, 1501 bp, Oryza sativa
gcttcttccttcttctttgtggccagcggcgggcgacgagtctaaggggtgggcaaggcggacggcacgcgtggtagggagtgcgaggcaagcggcgctgaggaccccgaggccgttgcgcctgctcactgtcggtcggagtcactaccgaggaccccgaggcccgaggcgtgcttggcgtctcgaacaccctcggcttcttccttcttctccgtggctggcacgcggtggggagtgtgaggtgggcagcgggcggcgctgaggaccctgaggccgccacatcgatgtcctccgccgcgcctgcgtccgctcgcctccaagtacagagagaaagaggacgaagccacccagccatggtacccgccgccgttcgccgctgactagtcccctctccccgctgcgcttgcttgctgtcgaccggagtcaccgccgcggcccgcactcgcgtccgctcgcctctaggctccaagcacagaaagggtggtttaatatgacatgtgggccttaattttcttttatttctttttgctaattggatttccatgtcagcgccacgcgtacgccacatagcacaaaacctctctagattgagttgagggggtaattcgtccggtattaaaagttcagggtgtacaatgtttgttttttttggtttagggggataattcggttgactgtgatagttcggaggggagaggtaattcgtactttttcctaatatttaagatgtcctagtatagtatcaatcggcttggcggcatggagccctcacacgtagtcaacagctagtgtggtcttctttctcgaatataaacttgacaaaattgaatgtctagaactatattgacttgtcttccgatggtgtgtccctcttctcttagagggtattgtatttatagagaagatcattttcctctcaaagtagaactctgagaaatagaacatgatacgaagtaaggataccttatcttttctgactagaactccaacaccttctattccgggaagataatttctttctttatccaccatattttcttaatcaaaggataccttctcgtataccattaggtctatggtatctccgtgtatcgtaaacccatgtataggcggtatgccttatccttacattgacaatatggatataaagttgtatcatgcttaaactctccattaccgtgctctcataatgcacccctaacaaatttttaaagagacataaaccaatagcatatccctgatcttacaagggtgtgtttgagagaaaataaaagaagagaaaaaaagagaaatacacaaaatgagatgagtcattaacacataattaattgagtaataattattttaaacttgaaaaatatattaatatgattttacatcaacttttctatagattttttttaaaaaaaatacatcgtttagtagttcgggaagtgtgcgcgtgaaaaaaaaacaagacaaatcttctccctagctttcatacgttgtcggatgcttcttt

SEQ ID NO: 7920 - DNA, 1501 bp, Oryza sativa
cacgtttttcaagcctttttgaaatacaaatttgtatgtatattttgttaggaaactataggcaaataaacgataaaaaacaatagattaatcacagaagatgcgagatttaacgtggaaaaccctcccaaagtaggagagaaaaaaccacgaacaccagccagcaaaatatcttctatatatcggggtgaggttacaacgccaaacggcggcttacaagaggtgtatatatatatgaggtggaaccctaaaagggataacaaagttggcctttattaagtgcaaataaatttggatcacaactcaacatatgtttcttaaacaaaactcaaataaatctatttttaaatttataatagttaatactaaattgtggctttctttggtaagcaaacatggaccatgtgtaactgcagtgcagttagtggactgtaatttcttctcagggccgcttatttcctgggctttttttatttgttgtgttatgggctgcttctttgtaggtcattcactttgggagtaagttcactagacgtccctcaactttacgtcgagtttgtttcacatccttccatctcttgccagacagaccgtaagagagggggtgggggtgggttggggggggggggggggaatgacgggggctctggcctctggctcacgatggtcgtcctaagcctcagggtcgcaatctcatcagagcaaaggtaaacggtgatggagcttgttgggcctttgaacaaaattttcggcacagctgtagttgccaaactcgaacgaattatgtagggatatttaactttttatcactttcaagatggcgatagctaagaatttacactccagtatatgatatatggatcattatgtgtctatgatgtttgggttcaataataaatactccatccgtttcagcttataagacgttttgactttagtcaaactcaaattattttaaatttgactaagtttatagataaatataataatattcataatactaaattaggtttatcaaatcaataattgaatatattttcataataaatttattttgggttgaaaatgttactacttttttctataaatttgatcaaattaaagcaaatttgatttttactaagtcaaaacagccttaaagtcaaaaccgctctattgctgcttataagagtagcaaatatagttaaatacctcagttatgtcacgcggttcagcactgggcattggcagcaaccgagggaaatcaaaagttccggcgtcgaagctgcgcggctcacggatctgcttatatctgcggcctctgctgtaaaaatactcagaaaactcggcgaatccacgagcagaagcgcgggcagaacgtgctaaacaatggtcgcctcacctcacctgctccaattgtcaacgccactccccttcttccgcccgagctcaagtcccaatccgagagagtcgatcagcggcagctagagcagagcgatggccgcgctgctgggcatcctcc

SEQ ID NO: 7921 - DNA, 391 bp, Oryza sativa
aattgaaaaagttcaaaaaccctttccctctaggcaccgacatgtggggcccacatgtcaggcccttcttcttcctctagcagccggccggccgagcccaagccgtcgcccgagccgccccttttctccctcaaatccgctccaatccggctctttttcttccgggtttttgaggggattttatcctctcgtcctcctctatctttcccctcaataatcggagcaaatggttgagtatcttgcccgaatcaaactcgttttcgagtttatctccaaaaccgagttttgattttctcggatcgatttcttgcgggaggagtccgatctcttcaatccaaggctataaataggaccccctagttcccctctttcgtttgccccatctcccgtg

SEQ ID NO: 7922 - DNA, 408 bp, Oryza sativa
cgcggttaggtgagcgccgctgtgctcatctaacccacacacgtggcgccaaaccctcagggggtcggggcgccccagccctcggggacgaaacgggagcggcccgacccctcggggagatagagggaggggcggtctcatcaccctcgggcccgacccccccgagggggtcaggccacgtgggtgaccgcggctgccccaaacctctagtcaagatatccccggtcccatgtcaccgacagtagcccccggggttatgccagggcgatcaccctcctcgaggaaaacgctcgggcgtgacgccactcctcaggcctggtgacaggtggggccggtctctaaaagcggacaggaatccagtggtcgcaaatcgcgcgcatcggcaagggaaaaaccgaccgacaataa

SEQ ID NO: 7923 - DNA, 273 bp, Oryza sativa
tttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggag

SEQ ID NO: 7924 - DNA, 1501 bp, Oryza sativa
cagaatcgtatacgaccaccttagcgaaataacgctccctctccaaaagagcgtccacttgctcgcttccctccacttccatgacaccttctacatgtggacggttgtccatttcatgcaagctgttgtagttgacgaactatggagaaaagagatacattatcgcaatataattggaaccaaaaattgttgtcaattttattgatccaatatgtagagccgcaacacaacgagtagtggaggatcactcccgatgcacaatgcgtgatgacggagtaattttgcacaagagccaaaaagggctagggcattggacccgagacgtaatgggtggccaatgcaaatgtaacaatcaatttgtggagatccgtttttttatatatatgacatttaaacttgaacagagaaagtataaaagatggacttggttttactataaaatcaaatttaatctttatacgatttaaaaactaagagacaaaaaagcacaattagagtccaacagaaccgaataggttatccaatggtttcctctgtgcaactatgctagtgaagtctaaattagttcaatatagtttagttgcacatgtctacttgtgatctgttatcttgtccataagtatcaacaaaaacaaccaacaaccaagacaatcttaaagggctaagctataaaaatgcatatttcaatttcacccttactcaaaacacatcaagcgtatggaaaattttacttgaacaaagataaaagagtaagttatttcactagatatgtatgctatgtttaacaacaaaaacaccattttatataacgaagcgagcgtagctcaattggttagctttattacagtgaaacctactcattaaaatatatgtttgtatttatagctatatacccgtccgtccaagtacataagattaattgccacctataaaatgggcttaggttagatgttgtgtttgccgtatttaagtgactaagatggcccaaatatcatttcacgaagttttttttttctctctatggccgtgtttagttcaccccaactaccccaaatttccaattttccatcacatcacatcacatccaaaaattttcctacacatataaacttctaactttttttctaaactcccaactttcttcaaactttcaacttttttcagaaactaaccacaccctgtaaaagctactatctcttcttaaaacaaacaaacgcctgtcatcgggcggttcggacttcttcggacacgaaacagctaaaattctcacaaagaccccctaaactatctgctattctcctgaaaccacttaatttatcacaaacacccctcgtagaccttaaatttagaaaaacaagcccctccccccttcccccaaatcacaagcagagcagagtgctcgcgcagtttggcaccgaagccacgccaccaccaactcctccccccaaatccgccatggaagacggccacgctcccgccggagccgagctcgcggtggccc

SEQ ID NO: 7925 - DNA, 1501 bp, Oryza sativa
aggttctcgtgttgaagctgtgtcttgcatgagacccaatttcttcatctattcactctctctcttaattaatatagtgtcacataagctaaaagtcctacatgacaatgtagttaatgccatagacaccatcctagatagagagttgagactgcccttaactattgtttttttaatggaacagttctaactaatgttagttgtgcaaaattactacttgttcagctagaggagcatgtttgtcagttgtcactatctctattgatatgaatagagtaccgccggctgtgatgcggatggagtaaaaagtattgacgataaataccctgcaatggactgtaaaatgccaagcatcaagtaaaaaaataggtctagctttggtctattatatgcaaatttaatcaatatatatagcatttacattgtttaagttggcttttttaaacaaaaaagcttcattttgtattgtacaccaaaaccccaatttttatggacggactttgatctcccatgatttaaccaataaaaaaaatgcagtgtggaatgtagtgaaatccacctagttgtaggaatctctattgtttatgtattcttttggccaaacaagaaaaaaagtttttccccaagatataatattttagacattaatcgattaacacagagtacaaaatgctcttacatttctgaacacagtgaaggagtagtaatatactttttttttctttgatgtggaagagcagcaagtaactatgatgtttttcacatgttgcctgacactagtatatggatacaatctctaactaacaacataatgctactttattattacttgtcaatatgtgattatatctacagaaattactctactaccttaaaaagctaagtcgtcctatctaatattttatccctaatctgctcatagcccatcgctacttatatgagttactccctccatcctaaaatatagcaacgtagaatgagatattaactagtacaatatgtccagatatattttaaatattatacagtaaggttctatctagtttttatgttgttatattatgtgacggagagagtaaaagttaaaaggataactatctgaaaatgttttttcatgaaaaagaattatgataatataatttttcacatataaataaatcccacaatacactttcaagattttaagtatacgctcagtatcaccaagcaaatatttcgagattcatcagagactttcagatattcagagcaatcagatattcagatccccatccatccaacccacccccacccacctcagctgccgccgccgccgctgcctcactaacgcctataaatacacccacccacatacgtcagcgcgcacgcgacccaagccgatccgcccgcacccgcacacacatcgctcggtcgaaggaggaggttctagaaacttctggaagcggcggaggtgtggggagagagagagagagagagagagagagagagaggcagagagcca

SEQ ID NO: 7926 - DNA, 1501 bp, Oryza sativa
  unsure (1)..(1501): unsure at all n locations
cacctgcataatcaaaagcataaattatgcaacgcaaagacaccccaaggcctaatttatcgaatttagagtcaagttgccaataaaacaggcagctagatcagaacaaccaggatcgaatttggaaccgggtcacatgtaattacgtaaacatacagtgcaactcatacacatccaaccgcaatttcaacccataacttgnnnnnnnnnnnnnnnnnnnnttggcatgcttaaagcaaattcggtgatagtaacaaacaacttttctcctgtcaaacaacctaaatcactcttttctttttgtttttgtcatctggaaactttagttatacacaattcatggccatcatctaccctacccccaaactcactgtcaaatcaagcaacccaaatactacatgttttgaccaccacagctttacgcaacagaaaatcaaccattcataccccgaaaaaaaaaagaaaagaaagcatcgcgaagggataagggggaacacttacatccataggcggactcgagaactcctcctccgtgatcttcagcacggcgcgatctgcagcaaacgggcacaaacaaaaaaaaaatcaaatcgtggaacttagccacccaccaaacagcaacccttctccatccaattcatccccccaactactactaccaattactatacaagccacaaatttcgacgcgaaccaaccctacccgatctactgccccgatccgatcaatccacatcctcagtggcccggatccaagcccgcggcgggaatcactcgaaccgcagggggagggggggggggcgaatcagtcaacatacactggatggtggcgtaggcggcgtgggcgaggagggcgccgccgaggacgccgagcacgtggccgatccccatgcggcgaggttagcaagactggaggagacgcccgcgagctgctgcctgccgccacgccccgctcttctccggctgccgccgtgcgccgccgcgtccgggtcttctctctctctctctctctctctctctctctctctctctcgcccgcgatgcgactcgatctgcagttcgtcccgtccgggggatgttggattcctctgccgtgaagaagaagggctactgcggtatcccttcggatccaccgttgcttgtgtcatctaacggtccggaacgtttggggatcttcgactcggaaaatattgggaatcctatatagttagggcatatgctcgatgtattatgtccacgagtacttggtaataaggtgagacccgtattagttatggtgtttgctacaatgtatatggtaagagaaggcattagcctgggttctacttgtcccacttaattgtatgacatgtgagggagaagagaaagtattgttattttttattcttatgggtaggcattatgcatattgagagcttatcctaaatactaccgtatggactatttttatagtgtataaggactactttagaggcttaagaccccctcctattgctacatt

SEQ ID NO: 7927 - DNA, 1501 bp, Oryza sativa
tgtcctgctaaatcaaaattacttcccttgtgatatgattaataccttaccttgaatattgcagattggatagctgccctagcatgtttattctcaattaaaggattacttcactcctggaagaagtggatgtggtattcattctatgtcagcatactagtagccctcttctggacatactacctcttgaggtatcacattatctactagtaactatttgctttgtgcattgttattaccattttatgataatggtcttttatgcatgaccacataaacagtactaaccaaccatcaacggctagaacttgtaatttgattggttgattggttttactcttgtgctacaggttaccgagaattcgatgggatgtagcatggctcccgtttggccctttgatgtatgctttcttgcttccttctatctgtttttcacagaccaagaggatcatttcttgttaataacattgttcgttttatctatattgttgggcagtgcttctgcattgagcctctatgtggaccactctatgctggagtcaatgcaagatatcaacaccttgaggagctacatgtataactacaaggccttgtagtgtggagaatatggctagttgtatctatacatgtaataggtttgcacttttcattaactcccggtatagcttagagttcatctacttctagtttactgctaaacaatggagattcacaggtttcatctttgaatggaattattttggttaatgtagcatccatcatttgagcaatctcttctctgtgacaggattaaccactctattaccagcagagccccagaaatctttctgccttgagttaagactttttggatatctagaatttttcttcggcttatttcccttaggtcaccttttgccctttgtgttgcttgtcaatgacaccagagtgcttcaggggtgcaattcctatccccatcctcaacggcatccatatggtctgattcatcaactactggcaccgtcagtctcatttgcacatcctgcaccatcaaaacatgatcctacttcaaggagtgtttagatctaggggtgtaaaattttggcgtgtcacatcggatattatatagggtgttgcatgtggtgttcgcgcactaataaaaaaactaattacagtatcggtcagtaaactgcgagatgaatttattaagcctaattaatctgtcattagcacatgattactgtagcaccacattgtcaaattatggagcaattaggtttaaaagatttgtctcacaaaatagtcgcaatctgtgtaattagttattttttaaaactatgtttaatacttgatggtgtaaaaattgaggtaaacaggccctcagcttcatgctcaagttgtgcgaacctgaatttctggcatcctggcagggccctttgcaattactccatccatctcaacatattacgtccagggtttcatttaccgccggggccgcggttaccgcgccccggcggtaagc

SEQ ID NO: 7928 - DNA, 1501 bp, Oryza sativa
cccgcagtggtcagcgagagggcgaaatctcagaatcgtcgtcgccgttggttgtccctctactcactgacccgtggggcccacctaaaccctacatcggctagcacagtactagcactggaccagagagagagagagaggggaggacgcacgcagattaattagggacaaagggaagctggcttagggacaagaaatctaggacggaccaaacggattattagttggagggcaggcaatcagggtggccacggtacagctcatctagtccagggccatcccttcctacctcttccgttgcaacagaaaaattccttggagtagagagagagagagcggtttccaaaatatgaaattggatgcaatggcctttttgtttaccggctaagatatttttgcatctttgctataatatatatacaaccccttaaaagtaggtagcactgtagtagtataggtgtgctgctgactgctgttagaaagagtacgtacatcatcatcatttgtaattaccaagggtttagagttgggtgagatcgaggtgggaaggaagcgtgtatatggctaagctccttgcttacctacttgatgtggttaggagagcatgtacaataaaaacaataagcggttttttatcgatgataatatatatattcgcattggttcgttgatgagttatttgtatagtatgagagagagtgtgtgtgagatggcagctaagatagtggattatacatgcgctacaaggtaagtgaagcggtagaaactatctctccacggttatagggcccacgtgaatgtagcaaggcgcgtgatacatgcatgttgctatatatgtctatggctatggcgtgactatgagctcggtgttgccccactatacgagggtattgtctcatcgaccttattggtgacaatcgcaatgtagcgttgaggctaagcgccagttacatcatggagatagtgtcgaggcatatgctggtggtgagaaatgctaaagtgcgtaccgttgtgtgccagcgtagagaacaactgtaaatgtaagatgaggcgaagaaaggagcgatcaatgtataaatagccaaatctctcaataaatacattgaaaagggtggtagagttaatttgttgtatgagttggctgtacaaacatctttaagataacatcgacaaaaaatacagctggcaatcgactgtactattaaaattacaataacttggtttcaccatgcataaatattacatcaaaatagaagcataccatgaagttggagactcaactctcttttataaaacctaaaagttccaataccactatgaaaaaaaaaatgattgtatgtaccaataatatgcatatacactgcttacttgacatgccttggcctttgcccaacttgtgtgttgttgcaccaaaggtatgctccacaaaagcaccttcacaaattataatataattgatcgataactaaattcgaaaagtcattacttactgcgaaaaata

SEQ ID NO: 7929 - DNA, 1379 bp, Oryza sativa
agtgtgtttgcttcctctcctttcttgctctgtccgtttccacttcatgctgtgttcgttagaagcggttcccatccggaagaacagtgatcacggaaaacagagtggtccattagcgcgtgattaattaagtatttgctgatttttttaaaaaaatagattaatttgattttttaaagcaactttcgtatagaaacttttttgcaaaaaaagtactgtttagcagtttaaaaagcgtgcgcgcggaaaacgagggagaggggttggtaacatgggattgcaaacacactccaaatctcagtatccatagaatgcactccttggagcacaaggacaacgttgttttcttttcaacgatgcaaggcgacatagttactgtgcgagagatgaaaagaggagacagcggggcaatggggcatgcagatgcagggcaggtccggcccagtcaaactcaacaagtccgtccaaactaccggtcagtcggtccaaatgagaagaaaatccatggcacctcatgagcaacaatcatatcaattgagtatcattgttctttgtttactcgctagtttttgtttcttgtttactcttaccactccattttatttttattttttatattactccctccattaaaaaaaaataagagatcactcctcttacatttaggaacgtatcatgcgccaatattgtgaaagcagagcccatattttaaaggcagagcttgtagtgaagcaacagaagtcagcaaattctctacccaaaacattaatggattccattcattctgcagcacaaggtctaatgtctaaatcatcaattggagtttcgactttgccttcagaatttttgcactaatcaaatccctgatcaaatcgatgtgccggcattatatatatagctggtcattggtcagtatcacaccagatgttctatttgaacaagcagaaatggaaacgataaactactagttctagtgttaaattatatattaacctaactaaaatctcctaatcccccacgccaacacgcatgttccaggggtatcactgtccaaatctaacaataatcctgaaagatttgcagtggcaaataaagaattggccccccaaacaacattccacagaaaagaagacgcgcactatcttccagaatgcacttgccgataaaataaaataagcacaatgctaaaaaaacagcgtagatctgacgattcgctcatcacaaatggcggcttcgccaactgcatctcgacgatgagcatctcgtctcactcagagcgcatcagtaaatttcggaaatcgcaacacagattcgtacggagtacttaataaaacgaaaaaaaaaagaagaaaaaaactaattgcagaaaagatagaact

SEQ ID NO: 7930 - DNA, 1501 bp, Oryza sativa
gctgtgacgtcggcgcggccccctccgggcgcctgctgctggcacgcaccgccccgccccctcggggaggagatgggggaggtgttcctccctgtttcctcttcccccgggcggcggcagggcggttgctccccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctgagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgagggggaggaagaagatggaccgccccgggtaatctggtgctgggcgcgcctcgcccagcatcactatctcccggccggtggcggattccggcatgaagcggcgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttcccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcga

SEQ ID NO: 7931 - DNA, 1501 bp, Oryza sativa
tcattggatagctcacaactacatgatcctccctcctcagcaaggtatctcccaggatcaaaatatcttggtatgccctgatcatgagcagaagcaactaactattatcttgtgcagcttgtacatatatacaaggaaattcactttgaacttacagtactgtcaaataaaggggcatcaggcccatcttcagtgagcactgactctacggtgctggtttttgcctcctgaataatccattcccaacaaagaaacatctgacgtcaattccaactcacaaacataaatcagttccctatatgtaaggtttccataccataataaattcacaattagttcaatacgcatattttctaagagataacaacataagacattatttttaacttggattctacagaactgaaagagcctttccattaaaaaaaacattgcattgtctttcagccattttcaaagacagatattactcagtatagctcacaatccaagtcgattctggctgcgtttgtttaaataaggcctccgattttcttagtcatccatgaatcacagatttgcttgctgaactaaatgcataaatagtacatgaacaagatcaagggaaaagacctactcgtacctactcctcgatggcggccggttcagcctcgggtgcctccttccgcgctgcttctgctcctcctcctccttgcgcccggcctccacgggcacggcgcaaccgggcccgccggaatcgcgcggtaggcggcggcctagcggtggtctagtcacggccatggaaaagagaggagtgacggacgacggactgccgtgcgaggtcggggagaagggcggtcggatcttggagtgttctgcgacgagggcgagtcctgcgatcggctgcagcggctgaacggagcggcgacgacgacggaggtgatcgggatcggcgacgagccgcggcgctagggttagagcgggggaggggcggagcagtgtcagcgcgtcctctcgatgatggtgaggagttcagtgttttgtgtacattttctttgtgcatttaagaaagaaatgaacggcttcgttttatattaaaaaaatagaaacattatattagcatagataaacaaagaacaatagcagttagtatacccacgttactacattcgtcccaaaatataacaatcgaatataggatgtgacataaacaaataattatagtgacaaaataggtagaaaaattcaactcaactgtgcggtcaaatttatcagttggttttataactcttaatcactatctgacacttgatgtgtatggagtgcttgggcgagccggccaagcccgatgaacacagcggcgctgcccgggtacagcgtgatggcctggtcgtactgtcgcagcgcactcgccgtaattgtccttgtaccgctcgttcccagccccgggtcacctcctcctgaagactcactccctttgctgcattgatggggcaggtcaactcgccggagaccttgagta

SEQ ID NO: 7932 - DNA, 1148 bp, Oryza sativa
tcagcttagatgcaacatacaaatttacttgcaaaacatacacttcattttcttaatttgtgtgaaaaatttctactttgccgttagtgttgaatcttaatccctaactacccagattgaatttccaatctttttattgaaaaggaggcaagtgtcagctagtcaatcaattaaatgaaggttggaaagtataggtaggaaagccgaaaggggtgaacccaatgggaacaaaataaacagctgagagaaattgcgagctgcaaccttacaagttcaaaatgggaatgggagaagaaacaactgtgagccaaacatgaaaagaggggttgatcatcaaatattgtatgctgagactctctagtatgagaagcagcttcgagcaccatattttggctggctctacaatctaggtagttttgtttttttattatttccaaccgtttctacattatatagtcatatagatgaccacattgttgaaatagcatcatagatcattggggcataggtggtttctgcggctgcactcaactattgaccgatcttgtcaaaggtagagcgacttgctagtcatagaacgttataggtgtacttttttattacaaacatatggattcaaacaataacggctaataacagaatttaacaatcattttattacggttttagataatgaaagtaatttctagccattgcgatgatcatgaattacttccacctacatgtttcaaatgacttcttaattaatggattgtttcactcatttctacaactttcacttccatgttgcatgattgtagacaaaattaacatgttcaattcatgcgttccaagcatgcgtgccgtacttattttcccgcgcaaaaaggcaaagcgtgacctggcaatctagcaaaacctccaagtctcataccgtgggccccacccaccattccccccatccgggcccacctgcagccgcacattgtccccgtgccgttttcctaattatatttacctccattgccactcctctttttttttctcctaatatttaccaccattgccattctccccctataaatacacgcacgcaccctcttcttccacctcgagccagccatagcctcctctcctctccacgcgacgagcaagtgaaggagcgccgc

SEQ ID NO: 7933 - DNA, 1284 bp, Oryza sativa
atttgggccgagcccgaaagggaggaaggggaagattattttcttttctttttatttaaattgattaaatgaactttgtattattataattatttcttgagctccgaaaattcgcggaaaaatccggagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcccgaacgaaaatcggggcgttacacattcccttcatcccttccttaataacccatccgttgttctccatgttgatagcgcaacgacccaattcccttttctctttctctctctctccctacgttcttccatgatatgttgtatcgtggtgattagatcaacaaaactaaccatatatgtaccagcaatgatatatgtgggtatcaactccgatacttatggaacaatactctaatagtaccacacattatacttgtaagggcagtaacagtgcaaggcacgcatagcgcgcttctagcccatttgtgcgataaaattggcccgaaggccagtaggccacacaccccacagtgctcgtgacccacaatacgctatcaagtcggaactcccagtcgaacgaaaacagagttaattttccccacctgccccttcatgcttatcctctacacagaaaaaaatcccgtcacttctccccatctccgcgccgctcccccgccccacccacccccctccgctaaaaaaaatccgcagcttctcctcctcattcaccacaccacgcgcttctcctcccagatctgccgcttctctccccaaatttgacacttctcctcccaaatccaccgcaccgtttctcccaatctgcgccacttctcctcgcccatccactgcaccgcttctcccccaaatccaagcgcgggaggcaagaatcggtggggtgggagggtgattttggggattcacttttcggggcggcgcgaggaagcgacgaatcggagcgacgacctccacgttgcaggggcggagggggtttcttgcgctgcgcgccctcgttgcaacgaagaaactcgtctcccagataaggggcgagcggctaagcagaggcgcgagcctcgtcgacacgtaagcgagtccaatatggcaggtgaaggtaacatgccatgtacacgcactgggaagggcctaaaggggctagcaataatacgtgagtactagggattgatgaacca

SEQ ID NO: 7934 - DNA, 1501 bp, Oryza sativa
aaatccccacatcaaagtaacaatgtaacatcccaaattcacatcacaaatcataaagttacttatacacacaaatcaaatacatcacaaaatcgtaaaaattacacacaaatcaaatacatcacagatccaaacaatgaatcatatatttgtatatctcagtgaatcacaaattaaagaaaaaaagaaaaaacaatgccgctgccgcgcttgccacgaccgctgggatgggaaggggaggaggggggatgaggaaggggaggaggtggaggagaggggatgaggaagagaggatagatctaagcaaacggggagatattcgatctgtctaagttgtaactgtgtaggagaggataagtaatagggattatatactacgcgttcaatttgatctttagtctcggttattgacaccaaccggcactaaagattctcggccctctgacatacatctgacaggggatggttaccaaccgggactaaagatcaaaatttttataaccgggactaaaaacaatctttagtctcggttctttttggaatcgggactatcgtggattttgccagaccgaccaaaaatggtttcttcactagtaaattttggacaaatctaaatgacttataatataaggagcagagggaatatgtttttatctttcatccctacgctgtgcaagtacaagatctatctgtcctttgtttgatattgatggcacgaattataccgtgtcaaataaacgtgtcaaataaaagatactactactaaactatgcactgtgacaaaataaacaataagaagattgctaattttcaggtgctgctccctggctatcggactgagccgtcttctacttgtacaccagacatgagaggaaagaagcatctcaaagagaactcgcttgtctaacatcggtccgaagatgatgacagtggcccagattcaggtatccaagggtagctatggtgacgatgggggtaagagagggttgggtggaggaatggctagggttgcagtgggcgacgaagcggcagtagcgtatgcttctagcatgggaaaaaagggtgagttgctagcatcagtggcaggagagccttgttggagtgttatgaggtgggagaccatagtggcgtgtcgtctagcgacacaaatcgtccgattagacctgcaagacgacagagcagatacaactcaccaccgctatgtttggggaggaggggaagggatgtaagaaggggaggggcggaggccggtctagcagaactcggtggcactagtgaggccgagaggcggctcgatgaggtgagagaggggaaggagtggtgatggagctaatcgatctcgacctagccatttcaatcagaccaaggggagggagaacataaggttgctatacaaatcttggcacaatctggaccatccaatagtgactgaaatttgtgtgtatttttaggtgactgtagtcccataaagatgatcaattgtttgtttttttaaaaaaaa

SEQ ID NO: 7935 - DNA, 1501 bp, Oryza sativa
ccttttagtccccttccctagtctcatgaagttcatggcaccaaacacctcaacaagtggcaaatgatgaaatgatgtaaatgcacaactactttattttgggctggacgtgttggttctcaactgaacctgcaccgctatcagacagtgtacataacgcaatcgctgagcaaaggaaacagaaaggctactgcccagcgccattttatttggccatttctgctgcaaaagctctctttatttgtttctgaatatttgaatgccaatttggcgacaccaatttctagagagtttccgtggtggcaagacaacctggtacttattgtatagtgctttccttttcgagttgattttccatttgcatttgcaaagatttatataacaaatttgagtataaagaatacatcagtgatgaagtggcgtgactggctcaaatcgagctaagagagatcactcgagcaataatgaacagtgaatcagaataatggatacgttactgtccagtacattgctactgatccttgatgcgtgtgttttgtggtgataagtttgagccgtaaaagcagtggtcgaagctaaacaaaacaacaccatcaaaccaattttggagttttatctgggatattatgcgtggtagtggtattcttggatgcctttggtgacataatttgttgttgaccccaactttttttaaggacaaaaatgtttgtgtcaacactagtgttactatgtgcccatgtcatatgtacactgcttaagcggtgagcaccagaaacatacaaccgatgaagcgtacgttgctcacacgagcaaaagtaactttggtgtaaagatatttggctcttctctagtttgttggagcacattacgttgcattttcgacctattataagtcacactaaccattttacattttcatgatctgctcaatttcgtgcacacctcctgtacatgttaatttctctctagtgctaattaacgatgggctctgcacaaactcccctggttttgatacagacaagtccaattttattcccgcttaaaactaacaaagcttgcattttatctataacacgtctaatttcttgtgggcactgcacatattcccctggttttgatacaggcgtatccaaaattcactcacacttaaaagctcaaaaaagctcccattttaatcaccacacgtctaacaaatttcttgttcacatccacagaagaagctatccatgctgtactttacattgcagtattagactttttatactacttttacattacattattagacctttttttaacacaaaaatccacctacccaaccaattttttgccgggctggtcctcctccccccgcatgagccgcccgtgcgatgacgtctcccggtgggtcacaccgtcacacaccgtgctataaataggggggcttggcctctccgccatgagcaccacacttcaccagcttcgctttgcacaaagcctcagtgcctcactgcacttgcac

SEQ ID NO: 7936 - DNA, 1501 bp, Oryza sativa
ttcctcttcagtgacgcagattctatatatccccatcatgcagaccttgcaaattcttgacaccctcaacgatttcccccactgtggtccaggatcatttcttcagttctggtctaacttcatatatctcaactcctcgtcaagtccctgatatatcatgtctccgccagataattttataagcgacctggctaacctgtcgtcaccagtctactcgcccttcacatttgtgaactatccaaaccgtagaaccttcttgtccttctcttggacccatccacaagttcctgcaataaccatccgtctgttgaaccacctgggcaggtcaggcgaccgcccaggctccatcgttgccgtctccactaccaatagccatcgacacctataaaaataatcgattatcggaaaacattattagtcgcccgggcttaaggatgccgctggctccaccactgctaaatgtccaagctctatggtctaccgtcggttcgaccaccctgccggcccggcccaaccatcttgcactcctcgcgcctcttcttcccaatagcaccgtcgagctgttcttaatgttttaaatctttgtgcacctactactattgaggacttggggaactctaccgattacccaagatttaactagatgagttaaatctttgtgctattgcaaaaatttataaaaaccccaggagtctgatagaaggagtaagaaggacaggaatcaagacagttccatttatcaattacccaagatggtaagttagccattgctaaagttcacaggtacaggtatagttttgaataatttatgtgctcgaattatatcttggaagatttcattctacagttaggctccgttcaacagcggcagttgggaacctggggttggggttgggaactagtggcactgttcatgtactgtagattgacgtgaggacgcatgcacgtgacggcactgtttcgaccgaaaactgtttcccacgttgccgttttggaggcccacgatttccgtcaatatccatcaccccctacctcgcgtttttcatccgagagaacgccacccccaaccagtctctcgactcccttcgatcccctttcttcctccccctgaatcggcggtcgtcgaggtgagcagaggaatccaaggcggcaggaatcgattcccctcgcctgcaacccctcctgcccccaaacgaatcttccctagggctagagcgggtactcttccaagtagctgcatgcctaaagctgccggaagcgtcgtgtcctccttcgattcggtcgagctgcatcggagcagtgcatagtgctcttgatctgtcgcgtcatcctccaagatggtacaagctggccggcgtgctcgctgcacgcatcgtccttggcgcgcgtggtcgtacatcccgtgtggcacagaagtggcgagattcgttgcaagaaggaggcaaagctggtggtgtgctcagctgccctctatttgaggccgagcctgtgggtgcgccga

SEQ ID NO: 7937 - DNA, 1501 bp, Oryza sativa
cgccttggattcctctgctcacctcgacgaccgccgattcagggggaggaagaaaggggatcgaagggagtcgagagactggttgggggtggcgttctctcggatgaaaaacgcgaggtagggggtgatggatattgacggaaatcgtgggcctccaaaacggcaacgtgggaaacagttttcggtcgaaacagtgccgtcacgtgcatgcgtcctcacgtcaatctacagtacatgaacagtgccactagttcccaaccccaaccccaggttcccaactgccgctgttgaacggagcctaactgtagaatgaaatcttccaagatataattcgagcacataaattattcaaaactatacctgtacctgtgaactttagcaatggctaacttaccatcttgggtaattgataaatggaactgtcttgattcctgtccttcttactccttctatcagactcctggggtttttataaatttttgcaatagcacaaagatttaactcatctagttaaatcttgggtaatcggtagagttccccaagtcctcaatagtagtaggtgcacaaagatttaaaacattaagaacagctcgacggtgctattgggaagaagaggcgcgaggagtgcaagatggttgggccgggccggcagggtggtcgaaccgacggtagaccatagagcttggacatttagcagtggtggagccagcggcatccttaagcccgggcgactaataatgttttccgataatcgattatttttataggtgtcgatggctattggtagtggagacggcaacgatggagcctgggcggtcgcctgacctgcccaggtggttcaacagacggatggttattgcaggaacttgtggatgggtccaagagaaggacaagaaggttctacggtttggatagttcacaaatgtgaagggcgagtagactggtgacgacaggttagccaggtcgcttataaaattatctggcggagacatgatatatcagggacttgacgaggagttgagatatatgaagttagaccagaactgaagaaatgatcctggaccacagtgggggaaatcgttgagggtgtcaagaatttgcaaggtctgcatgatggggatatatagaatctgcgtcactgaagaggaagagcaagcgctatggtggtgttactgtgaaaacacgacagcttgggagatctgcttaactccagtataagtccaaggcttgcctcgagttctaatagcgtgccagctagtttgatcatgcaatcagcaaggaaacaacaagcaggattagtcagccgatagccgatcggccaaaaggccgatagcgtatatttagtagtcttagctgatggagttagactgaattggctatgggctggatagatcagagaatataaaaccttaaatatgccctatcggctgtaatactgtctagcaagattaataaaggaatttaagacaatattatgaaaagagctgatataacaatattc

SEQ ID NO: 7938 - DNA, 1501 bp, Oryza sativa
aaagaactatggtcaaaatacggcaatagtgccgtacaggtctcctaagaaaacatcttgtattctttgtacgaggagatcaaatattgacagcaagttccatgttaatcccttgctagcacataatcgcatatacgatcgagagggacatactatctcttgtttttttttccttttttttcttgacacaatactaaaatattctccttgtaacttttctaaagtcaaatactactaaaattattccctattttctaatagtaaaatagagccacaaaagaacaataagctttgggaagttggagtgactctagtgcggacaaattccccccacataggatgagacggaagaaccgggccccacccaacgcacaaaagtatgcgcatccgcagccaccaccgtcgcgtcgctgacgcagcataaataacttacccaccacgtcgatgcagccgtggcagtgttgacgcacacgaaagtagcagagaaaaagtaaaattaagctcgtgagctccgacgagctaggcagctagctgccgagtcagcgagccgggcgagtgtgatctgatgaggagtacgtaccacgttgccgaacatgtcgaggaaacggcggtaggagtcgtacgcgaagcggtcgccgctcttggccgccagtcccgccgccacctcgtcgttcagccccaggttcagcaccgtgtccatcatccccggcatcgacacctgcacacacacgcacgcacggatcgatcagcaacggagatcaatcgatctgtcacatcgccggcgtggcagagaggaagagagagagagagtaaatataagtaagtgatacgcacggcggcgccggagcggacggagaggaggagagggcgggcggggtcgccgaggcgcgccgccatgtactcctccacccactggagcccctcgacgatctcctcccacagccccgccggcagcgtcttccccgccgcctggtactgctggcacgcctccgtcgacaccgtgaaccccggcggcaccgacagcccgatgctcgccatctccgccaagttcgcccccttccctcccagctgtacacccccccccccccccaaccaaccaaaaccagtgtaaaaaacaatcaaaattccaagttcataacatcatcatctcgtatcaacagcgattatttttaccaggtccttcatggccttgttgccctcgctcttgcccttgccgaagtggaacaccctctgcacacgagcacattgagccggagccattagtgaccggtgcaagtgcagtgaggcactgaggctttgtgcaaagcgaagctggtgaagtgtggtgctcatggcggagaggccaagcccccctatttatagcacggtgtgtgacggtgtgacccaccgggagacgtcatcgcacgggcggctcatgcggggggaggaggaccagcccggcaaaaaattggttgggtaggtggatttttgtgttaaaaaaaggtctaataatgtaatgtaa

SEQ ID NO: 7939 - DNA, 378 bp, Oryza sativa
gcatctggagatagaatttgctgacgtgtgaaagtcagggaaaggtgagatggacagcaccaagcatgttggattggcctcatctcttctttatatcatcaattgacaccatcttatatattcttatcccaagattatacaatccattcaatttggttctaatgcactctcactcctcgcttttcttgccaagattttgccagagaaaaaaaaaggacatttgagtgatttgttcattctgaaatgaatggtgggcaagcacgcgcaatcccagaaagtaacatttcatgcttaaatctgtcccttattggggcatttgacttaagtttgtcgcttattggatggagctttataatcataaaaaggagggaaacgata

SEQ ID NO: 7940 - DNA, 1500 bp, Oryza sativa
acaacttgagagttattcatgatttatattcgcaaagtttgacttaaacattgtcctaaatgacttcctttatgagtacggaggaagtatttgaataagataaatggtcaaacatatatataaaaaaatcaacggcgtcatatattaaaaaataaaggaaatactacgtaacaccaaataaggtgatgcaccaatacaccaaaaatcgccagacatgtgaggcctttcctgtacgttcaccctaagtcatacagaaggcgaaagatgagaagtgacactttgatttgttgttggtagatatatcaagattgctatacactgattgacagggcggaaccaggagtagggcagctagggctagagccttactcctggtcctaaatacccattgaaagcactccaaatttaagaatttagaaaaaaaaagaaagtaaacctataaaaattacatcaattgagccctactcttgagaaatttttggctccgccaccacccattgttactatctaaccccgcgcatatcgtgagccgttgttggtgcttctgaaacgttggagacagagagagaaaaaaaaaggtgatctaggacctgttagtcgtggcagtgagaggcgacaaatgtgaaatcaccaacactagaagcagcagaagaagaagaattcgaagaaatgggttgttgaacacgcatatgacagcaacaatactgcagatagttgcaaatggtccttggaggtatatacgacaaagaggcaaagcaaacaagcacgatattgggaaatagaagtgtcacattggggaattgaagggtcagaaatggccggggcacgagccaggcacgctcaaattaattgcagccatcgatcgatcaatccatggatgcagcatgcagcgatggatcgatcgccatcatactctccagctagctagctcgtcgatcgttgcaatcatggaccaatatagatagatcgatgtgcattgcactagctatagcttttgctaagctgcagacatcacggcgcactgatgatgtgagatgatatgatacagacggcaatgcacctggcacttggcacttggttaattccactcactcatcacttaatttgctagctagtagcttatttgtagtcgattgaggtttgccaattgtccatgtctgcttgtcctcttcctccaccctctatatatatcccaagtggccactacagagcctccattattaatcatagctaacaagtatatcctctcttcttcttcttcctcctcacaactcacaatatttcagagtagtatacctttcttgctagctagctagcttgttcatcgatcttgttttgaggtgttgagatagctaggatggtggtgaagaaggcggcgacgatggcggaggcggaagcggaggaggagatgatgatgaggatgatgtgtggttcaggaggcaacgagatgatgaagacgaagatgaagaagaagaatagagaaggggaagaagaagaaga

SEQ ID NO: 7941 - DNA, 1501 bp, Oryza sativa
tagccagtgacgggaagtccaccgccgcgccacgcctcgtcgtcgacaccatcgctgccgcaaccgcgtcactgcctgcgaccgctgctgcatcaccgccattggcaccaagcacaccgtcgccgccgtccacgtcgagccgcaacgacagcgacgatgtccggcgccctttcctccacgaacacctcaaccggtcggtatctaaaccctctccctttcatctacaatgtcgttcatcaacccaatagagacaacccgactagatctaaacctaggtgatccaacagagaactctaacaatggtatcagaccaaccctagggcttagatcggttcggggatagaaatccaaataaaaagaagaggggaattgatccccggaaaagagcaaaagaaagaacagcacacgatccgcacgggtcgaaaagaaaagactcacctaccgccgccgccggccgccgccgacgcgcgcgggagtcatgccaccaccggtcgtcctcacgccgacgcgggagagaaaagagggggcggcgccgcgccgccggcttgccgggcgccgctgcacagccgctcgacggcggcgcactcactctcgggtgagtgcgcgcgccggcaaaggggggtgcgacggcgccgccgcgccgtgccgccctgccgccgtgccgtgccgccgtggctagggttccggccagcaagcggctagggtttcggacggcgtctttggcggcttggggtttttgttaccccgaaagaggtgcccggccgtccgatcgaaaacctaagatcggacggccggcgatggctgggctgattttggcccaagagggcgcgcgccgggggctcctttctcagcccaggcccaggttgcagcctggggggagggggcaaccgcgcgcgcgaaagccggccgtgggccgaccggctgcgcctaaataagtctatattaggtcccttggggccgaatcaaaagaaaagaagttcggtctaggtccctgtttcagaagcatttacaattatagttattaaatgtgtttatttcttcaacgtgaaaattgtttagagaatagataaatgtgagaaatgcttctgaacatgtattttgtatattttcatgcaaattacaatagaattttgaattgtttttgcatgttttacctctgtttaaatttgaaccaacgggagaatttttacagagagtaaataacagagtgttgttactgtttatatgaattgtatatagatcttccgctgcaaatagatgaaattgatgaaaaattagtgtttctaaaattaaatttcgaaccaacgggagaatttaattttaggaacattaattatgtgctatgatgttgtaattttctgaccaacgttgataaattgcaatgttatagttatggctctatgtgttatgtctattttctgcccaacggtgatgtagacttaatacatatattttaatgttaattttgttctcacaatacatgattatctcaggtggtact

SEQ ID NO: 7942 - DNA, 1501 bp, Oryza sativa
tccctctctctcttttgccattcagcatctaactctttttcacctttgaaaagtttagcaggttctacaggacatggggtagtcaacacccagtccacctctcccaagataaaagcaaggtcgagttctcttttctattctccgtagttatctcctgtcagggtcagaatatctttaatgtaacccatcaaggagtaccacctgagataatcatgtattgtgagaacaaaattaacattaaaatatatgtattaagtctacatcaccgttgggcagaaaatagacataacacatagagccataactataacattgcaatttatcaacgttggtcagaaaattacaacatcatagcacataattaatgttcctaaaattaaattctcccgttggttcgaaatttaattttagaaacactaatttttcatcaatttcatctatttgcagcggaagatctatatacaattcatataaacagtaacaacactctgttatttactctctgtaaaaattctcccgttggttcaaatttaaacagaggtaaaacatgcaaaaacaattcaaaattctattgtaatttgcatgaaaatatacaaaatacatgttcagaagcatttctcacatttatctattctctaaacaattttcacgttgaagaaataaacacatttaataactataattgtaaatgcttctgaaacagggacctagaccgaacttcttttcttttgattcggccccaagggacctaatatagacttatttaggcgcagccggtcggcccacggccggctttcgcgcgcgcggttgccccctccccccaggctgcaacctgggcctgggctgagaaaggagcccccggcgcgcgccctcttgggccaaaatcagcccagccatcgccggccgtccgatcttaggttttcgatcggacggccgggcacctctttcggggtaacaaaaaccccaagccgccaaagacgccgtccgaaaccctagccgcttgctggccggaaccctagccacggcggcacggcacggcggcagggcggcacggcgcggcggcgccgtcgcacccccctttgccggcgcgcgcactcacccgagagtgagtgcgccgccgtcgagcggctgtgcagcggcgcccggcaagccggcggcgcggcgccgccccctcttttctctcccgcgtcggcgtgaggacgaccggtggtggcatgactcccgcgcgcgtcggcggcggccggcggcggcggtaggtgagtcttttcttttcgacccgtgcggatcgtgtgctgttctttcttttgctcttttccggggatcaattcccctcttctttttatttggatttctatccccgaaccgatctaagccctagggttggtctgataccattgttagagttctctgttggatcacctaggtttagatctagtcgggttgtctctattgggttgatgaacgacattgtagatgaaagggagagggtttagataccgac

SEQ ID NO: 7943 - DNA, 904 bp, Oryza sativa
attaagatataagtggtatctgtcatattaattatttcgtgaggccctaagaaatggtttcacaaaaaagaggttaacgaagaaaataattaaattaaagtatattagctagaggtgcagaaatgaaaaaaaaaaagagaaaaaaaaacaaagcttgcacaagctgccacgtacaggtacatctctctggcgaacatggggcgcacaaactaactctggattctctcttgagtttaatactgtgatttgtttttggagcctgtacgtgcttagaggattaggaactacagtaattaacatacatatctaggactaacaacatctaccactaagtttagcaatagtcgtactaattatactatacaaacagtatattactaatatactactttcatattttaatgtatgacaccgttaaatttttgtctaacgacgtttgacattcgtcttattcaaaaatatttatgtaattatcatttattttattgtgacttgattcatcatttaatattttttaagtatgacataatttttttatatttataacaaaaaaaatgaacaatcaaatattaattaaaagatcaacggcattgtacattaaaatacgatgggagtattaattaagagtataacataaccgcgtgtctaacaacaagcatgcatctacctgtaaccaatagcaaggcttagcacttagcaggagtaatagttaattaattaattaatcgattaattagaggaggatttgtattagtaaaaaataataaattattaatagaaaagtagagggggtggggccgggcatgcggcgcccgacgcggttgtcgtattgagagcatgcacatgggggccatgtgtggcgcccccgccgtcagctcccattggcccacgtgtcgcacgcagg

SEQ ID NO: 7944 - DNA, 1501 bp, Oryza sativa
accacggcaatggtttatatatcttcttttacaatgggtccggtcgccagttaacgatcatattcatatacatgttataagacattttgactttttctacttaaacttatttaagattgatcaagtttatagaaaaatatattactagtatttttaagacaaaacaaacatattatcataacatattcaatgttagatttattgaaactcatttaatgtcatagattttggctaatgtttctataaactaggaaaaaatatgactataaaaaaggtaagacaacttataatatgaagcggtgggagtgtatagtcaataaaccaccatggttttatggcaggaaagtttatcccaatgctcttatttttatgttgttgtacttattgagttacatttgcggtttatttatcttagttttcacaacaatagtcagtaaaaaatgctctagggatcatgcatggtagctagtgtagtaattagtacatttatgcatgcatgcatccatgtatatatgttgattagggacatgtgtattgcaaagaattgagtttcatttttcctatcttggatggagacctgcatggcctctggtctaggccacaaggaacacaatgcaagcatgcatccacaacttgcacatccattgggatctagcttctttaattggagcatgatgtgtataagaccaaaagtctcgcatcctaattagcctacgaagctaactctatatatacccagcttggccatatatgactgatttgaacacggttttgacaaaatcttcaataaaattgtgatctatcaagattcagaagcactatataaaacaaattagactatgaacggcgctacaagaagctaaaaggagacaaacatcctttctttttcgtatcactgtcttttggttgtgacatgcattcatcatgcatatatatatgcacacaccttgcattgggccctctcgatcttttcatgtcttgcaatatatttcttcactcaaatagtggcgttctcatggaagatagtacacaatgttagctacaccatcgaccataaggaaattgatctgtggaccggtagttggcgatatatgtttttcttttctttttcctgataataaaaagagtgagttgattgcgacccaaactaccacagacaaacaccctctatagatgatcctaaccgtcatctggtatttggatctagggacttaactttagtctctgtatttagacactaatttagagtattaaatatagactacttacaaaactatttacataaatgaaagctaatttgcgagacaatttttttaagcctaattaatccataattagagaatgtttactgtagcatcacataggttaaccatggattaattaggttcaatagattcgtctcgcgaattagtccaagattatggatgggttttattaatatcactactacaaaaaggtaaataggtgtcgccactataggtgccggcacaccaaaacccgg

SEQ ID NO: 7945 - DNA, 1271 bp, Oryza sativa
ttaatctctatgtaatatttgtaatatttgatctaacagaaactactgtcttaagatagaaggatctcaatcagaagtagagtatcatatcatatggcctccctccccaactcaaccccaccaccggcaggcggcagccctctcgactccacattgactgacaacacgcagttgagttatctacccgcgtcgcgtgcaaaaaaatccagcgcaccaccgcccattctcatggggggacccaccaccccgactgcccccaccagtcagtggagacagagagagaagggcagaacagaaggcctgcgccgcgaagcctcgagaggaaaaggcggcggcgccaccggtggctcgcgacccgcggcgaggcaccgtcgcccgaagcccccccccccccccctgtcttcgcctgctccgtcgcgccgaggtgcgagttgttcactggttctggggctcgcttgggttctggtgattcacccccccaccccgaacccaagggcgtgtcagctagggaggaggaggaggatccggtggtttcgaccatgttattgacactgtttagtttacatgtcatgtattcgagctttcagctatgtatggtgtatgatttgatttacctgtgcttctgctagctctgttccagtaggcttaattgcattctcaagtttcagattttttttagtagcaaataatgttgctaagattcaccgtgcgtcctcattgtcccgatgtttacttccttacaacagttcgcctttgaaatcaatcgagggtctaaaagagccaacaaaattattccccccccccccaaaaaaaaaaaaagaggcaacaaaacaatgctgcattactgcaggaaaaccatttgcttgatgagctcccgactgaggctaattgtctgtttcctttccgtgttttgcagggtttctctagcaaaagaaatctggttcctgcaaatacaccatctgccaaggggagagtaccacaacagttggagttcacacattgttcacctggtattgttgcctgactcttgggacttgacattgtgcctcagcccaataaagctcttgaccaatgccaaagtgacattctgtgcaacatgcagcggcacttatctagaagtgatcaagtctatgatgcttcatctgaggatcaaccatgtagcagcagtgctgaccatctcccaggactaaggatgttttcgaggtcacggagatggaaaataatgatatgtgcatggggttgcagtcagggaacgagtaggcttttcccag

SEQ ID NO: 7946 - DNA, 463 bp, Oryza sativa
caaaattcaaaaagaatttgaatccaaaacttaaaacagccaaacatatccactggtatccatccacctgccccacggtttcatcggccgagctaaaatccaaatcgaactcaggtcgcccactgacatgcgggccccactaaggtgacggagagatctcaaccaacccctcccacgcgtctggctcgttcggttgccgccatttccgtgagggaaagggaggaaagcagttaagctcaggataaaccgcctcctaatttgagataaatccgttaatccgactcattaatccacggataatcactgcggcatcgtaggccttttttgagctataaatagagctcctgatcccctcctccactccacaccaaaacctctccaatccccaaatcctcctcatctcctcttccagaacctttctttttcgatttcgtgttcgagttctttgtgattgcagcgatgg

SEQ ID NO: 7947 - DNA, 1495 bp, Oryza sativa
gctcttcttgttctgtagtgcagtttgtgttcccttttctgatcagtaatttttggcctgttcctggtaaaaaagaagttgaattttgataaaattttttatgatcatttgaatggatggattggttagccattgatagtacatctatgtgcttaaaaagtttgtattgctgcaaagtggaacccaagtatattcacgcttgaagcaaattagtgataaggttaggcatcctttggagtgaaggctggagatagcatagcagtaggtgagctgcacttgtcccagcttagttcttgtaaaatcattacaaaatccacaagactattgatagcatcaaacgaatatcatatcatgtggagcactccacttgcattttgtttaatccccatggctgcacgttatcaccagcaatatccatattgcagcagaagatgagtaggattagtattttaaagttgtcttaatctgcttgctaattggatggttgacttcacaagaaacgagcgttgtgttggctacatgagcacgaaaatcaagggactgttcactttgatgccaaaaaaaaaccttaacaaatttaccaaaatttggcagcaaattaaatgtaggcatattttttttaactttaccaaaatttggtaaggttaaaaatggcatcaaagtgaacaggccccaagagatgcgtccatgagcatgatacacgtcgcacggaaaacccatctcctccgcacgaaaaacggaacagtccattagcacgtaattaatagctaatttttttaaaaatggattaatttgattttttaataatacttcaaacaaaataggaacaaaacttttggtagaacaaaactatataaaaaaaaaagcttgtcatgtctcctaaatattctccactgactaaagatttaacatagaaaacaagagtaacaaagcataagagaagttgactttaaagaattaattaaggtatgtggtactaaaaggtaaattgtatgtgctaatcttgtcgattctgaagtctgaaggaaaatcaataaaaataaacacaacaatgatagctgcaaatcaacccattaagcagagagagcaaaatattaaacagagaaagcaaagagagatgaagactagttgttgcatctcattccaatataaggtcctctttatccagtttccatccattgttttgccagcgcagctgttctcctcttctctgaatcaatcacctcaagcattcaagcattccagataaaacaaaacaaaaacagagcaaagcaaagcaaattgcagatgaaacaaagcagagcaaatttgcaccagaaggcactctcgaatagaatagaattttaagtggcgaatcaccacagttcaaccgcaatagcataagactgacagaaggtagtaacatctcatgataagagatgaaattattaatgacttaatcctaatttaagacgacaccgacgcgacgacgcaatggcaaagggaagctgctcag

SEQ ID NO: 7948 - DNA, 286 bp, Oryza sativa
gaggtcccaagctcaggggccagatcaggcccccacgccttcttgtccgcctcacgggacaggactagggttcatgaaatacggttagattccaaaaaaaaaaaaaccaatgttcggacgttgctcaaatgttgttgctgtctagaaattcgataagtttcatcctaattaaaatttcaatagataaataataaaaaatcctataaatagtatgatattggtaggacctattgggatataacttttttttaaaaaaaatatgaattccacgcattttcataggaca

SEQ ID NO: 7949 - DNA, 1501 bp, Oryza sativa
tgaccatgtgctgaaacgttggaaagtcgtgagctaaaggtttcactcgcaatttcgcttccgttccttttagaaaccttttgatcttcttcttatcagtgtccacatcttccggggcatatcgagccaatccgttgaagcgactcaaatactcgttgatgcaagaggatccttgcttgatatttgcaaattcttccttcttcaaatcaattatgctttcagggatgtgtgctaagcgaaaggcttctgcaaactctgtccagatgatggtactagcatctgtatgggtagcacagtagttataccaccaatttgtggtatgtcttcttaactgatgtacggcataaaagggttttcttctacggagtgcactgcaccaaatttaatttcctttccacatctttgatccagtcattggcttcaatggtctcagttgtttgggagaaccccggtgggcgagatcttaagaattcgttcagtcttgaccgacaattatcttgaaccatatggggttgatgctcttgcgtgtgttgtcgttgcataacaactatattctgaatcattccttgtaatatctgggtttgcatggccatgagtgggcaaaagtccactgttggggggctgatttctgtactgcggcatcattagttgatccagaaacaactgcatgatcacttctcaatctgttgctcatctgctaggctaattggctgatcgggaatttctgactgagctgacccttctttagaaccagggcggttaggggcacggatctgacggatagaacaatgtgccattggcttcagagcgactgagatctgactgaaccagaaatgggataagaaaagaaggaaaacaaaaacactacatcaaaacggttttcgaaatcacagaagacataggtggtgtattccagtcggtatcccaactggtctaacacctgaacacggactaccaaacaaaactcacgcacgcactagttcaccacaactcccaccgagcgggtgacggtactagggtctgcctaccaacgagggcttaactaagactcctagaggcttgagctcacctttcttcaactgggcgtgaagacaggtttactctaggataaaggtcaaaacactcgactagcttctacttttggacacgaaaagatttttcgcaaaactagagctaaaggggacaacgacaccttagctttcacaaatagtttttttttttttggtactcaaataatgccatcctaataaggggtttcgatcctagggccaactaatgctctgataccatctctgtcacaccccaatccggcaccgccgcacaacggcacctgataggagcgtgtcgtaggaaaaacggcgcgaaccgcttcctacgaaaccgcgaactcggtaccagtcccaggacatagtgctggtacccacggtgacaaatatgaatcattgcaaatccttagaataaatagaggacttatttaccttaacttaggttgcagctcaga

SEQ ID NO: 7950 - DNA, 1501 bp, Oryza sativa
gcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatgtaagtgggcccggcgaaagctatcaaatgtaagtgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatataagtgggcccggcctaggggaaggcgggacggcccggcctaggggaaggcgggacgttacattgggcgggcagtctatgacctatgaaagctatcaaatgtaagtgggcccggcctgggggagggcgggacgttacattgggctgctgttcttaggatcagtatgttaaagtctaggttttcgccggtttttctttaattaaccgtattgttgtaaggtttttagatctggttttccttataaactagatcaactctcttattctatggtgaattgtacgaactccctgcctgtcccctcgaaaaaaaaactttatcatcttaatacttctatatgctatctcaatatctcatatgtgcttatataaatatggtgtacgtatatgcgagtgttttgcagttttactgtatttatatatagcaggcatctaattcatcatatagtattaaatttcaaaaatattatgagaacgcacgcggccgtaccaataccatattagcatattagatgagtccactagcactgtactccctgtgctggtggccttgctagttggtactacgttcctgtcctaaactcaattatcggtgccgttgccttgtcctgcttgcatttgcatgcatgctaattaaagtgttcgttgctgtttcgtcgcatgcacgtacatgatcaggctgtgtggtgaaatcaaaccagattagagagagatcaccgtgtccgtcgtcatcggcgcgcgatgccgccgatgagca

SEQ ID NO: 7951 - DNA, 271 bp, Oryza sativa
agaaaaatagaaccgggaccataaaattgttacgggtcagataggaaaaccaacaaaaagagcaccggccttgttaacccagaagaagggatggggtttaatttaaataaagaggttaaaaaaggaaagaaaagccccccccgcccacatatctctctccccaaccccacccaaattagcaagatccgacgagaagctcaatccacattacggcagatcggcagatggcgcacaagctgaccggcgcgcccgacacgccggggacggcggg

SEQ ID NO: 7952 - DNA, 478 bp, Oryza sativa
gccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacactgcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 7953 - DNA, 1501 bp, Oryza sativa
cgcttcaatcttttataattccaggtatattcactatgtgaagcagcatttcaaacctgtgctgaccaaggaggctgaaagagttatctctagttattatcagcgtcagcgacaatcaggaactcggaacgcaggttagccggacttgtttttgtttcttgaagtattttgcagcctctcaaaaataagttttgtgcagcaaggacgactgtgcgcatgcttgagagtttgataaggctagcacaaggtatgctttgtaatctacactggatcactcaccttctcatgcccatcttgtctcaattcttttacactttatcttgtcttttctgctgtagcacatgcaagactaatgttcagaaatgatgttacgaaacttgatgctatcgctgccatattatgcattgaatcctccatgacaacatctgcaatagtagatactgctgggaatgctctgcactcgaattttacagagaaccctgaccaggaatgtatcctgaaatgtgattccatagcttacttatccaagaatatcaaatatttaactgatgaaatctcgaactgataatttttactgtagtgccacgtatatggatgttcttgcctatgtctctggtatggccttttgattcgggcaagcaaaggtgatctgttgttcctataaacgttaacactacagtactttccacttcatgcagctgattggctcattctgacgtgaaatattttcttatggaaatgcacctttaaagtatagattctgtaaactgataggcagctttctccactccttttgtttgtcttgacatattatagatattgaacaggagaagaaaatccttacgcaattgggagttagcgaagactccccattgttataaaatatcattaccaatatgaagatttacaagcaaacgtggcttatataccatgctgcacaatgaatcaagtgatatgccaaggtgataaccactcttgcttgggacatttaactattatggtcgtcttgttcttataattataagtgagtggtaatggggaatatgggataaacattgcagggaatatgtgatttgcactagattactacggtcagtttggctctaccaggtaacggtattggaaattgtaacttgttgttttagatcaatgtactggaacttgaaggtctgaaatagcaactactccctccgtcccataatataagggattttaattttttgcttgcactgtttgaccattcgtcttattcaaaaaattttggaattattatttattttatttgtgacttactttattatccaaagtactttaagcacaacttttcgttttttatatttgtacaaattttttgaataagacgagtggtcaaacaatgcaagcaaaaagtcaaaatcccttatattatgagacggagggagtaaaaaggttctctactttatattatggcaaattatattatagacttttcattgtcactcactcttgacatttccttttg

SEQ ID NO: 7954 - DNA, 1501 bp, Oryza sativa
ttcaacacaagaacttagtatttgacaggataattcagttcattttaaagtaaatgttatgatttcccagttcttttgcttacctcgttttctttgttgatgtgtgttagatagatctcccacccgtcgggcccaacggcacaacggaccttgaccgcgccctgatcgggggcgcccagcctaatggctggtgggtccccgtcacactgcgccatataaaagaggggtggaggtcggcacggcacaaggtacgagattcgtcgccgccgccaactccgccctacaaactctaatccgatcgagggggcgcagctagtgacgggaaacgccaccgccgcgccacgacctcgccgggattgcccacgaccaccgctgcaacgacaaccgccgccgtcaagcacaccgtcgccgccgtccacgtcaagctgcgacgacaacgacgatgtccggcgcttcttcctccacgaacacctcaaccggtcggtatctaaacccctctccctttcatctacaatgtcgttcatcaatcccaaatagaaccacccgactaaatctaacctaggtgatcctagtgcaaagtatatcagtgtgttcaggcgttcagccttcagaacatgcatattaattaagatgactagcacgttcatataattaaacatgatgctcgtgctattacttgaatggataagcaaacaaaatctattatattcatatcaacagtctttcagaaaccattgcattcagtttcaggggtttagaagatttttcatccagtgtattgcttgctggcacatctctcaaatatagaaaaaaggaaaaacaaaagtaataaaagatgcatgttgtcaatcaccagctgcttattggatgaatttacaacttatacagcaagattcttcaatacatctagcttcacaactaggacaaattggcagccttaaccatatttcttctcaaaattcagaatggttcaaaataagaaattcttgtcaacatgtttcttgattcttgttattgctaattactgttcttgcgaaccacctagaagtagcaatggttgttataaaaaatcttgttcttgcacatcatctagtagtgtgcttcaacaaattggctgctctgggaaaacttcatcaaaaaagtgagctcatggggctggatcgatgcaggagggcacgggagcaagggggcacatcacagagttagcctccatttctggctgcctgtgcctccgccgctgccgctgcttctgccatcgtgctaccgatgcgaccgctatcagccgccgcgatctacaagcctagttgaggaccaagttagggggagcgaaaaaatttaaagatttggttttggagagaacctgaaacgccactcgttacttgattcattgttgtatgtttcaaatttgacggcgagaaggcgtcgctgccgcggccgttgagggcatccccttcaattgcagcgacaggaaaatgttttgtgtgcctgatggccctgaccc

SEQ ID NO: 7955 - DNA, 1501 bp, Oryza sativa
acgccgttgaaacccaaaacctctttcttctccggggaatttaactatttgccacttttacgtttgccaattgttcaaatatcccttttaggtttgcagttaactatatgccattggagagagaagtttttctaattttttgccacttttcgcactgtacaccgccacatgggcttgctagcgtggaatgggcacctgaaatgactagtatacccctgcatctgaaaccctaaatcaggggatcctctctctcccgattccgttcgaccgccagccaccatcgacgggcgacgccgtgccgtcgacccctgcccgccccgcgtcggccccgcgccgtcgacgccggcccggcgcgcgacatcgacgcccgtcccgcgccatcggcccctgctcgcccagcgtcggccccgggccgtcgacgcgccgcccggcccgccggctcaccgccccacgccggtcctgacgttctccacccgcagtccgccgtcgacgcatttgtcagatccgcagctccggcatcatcccggcatttgttcttccccaacagcacatcgtgacctggtagggcatcgtcgccatcgtcctccggcggcgatgaagccctcagtttgtccttcttggtaagttcattttctcccttgccctccctgcttgtattgtgttgcatgcatggagttagatgtgttctaactccattttttttatgaatctgtttatgtcaggattgatcctggcaatgcgcttagatttcttgttagggttgctaagtatgttgcgaatctagagtatggaatgctaccaatgtcagagcaagactatgattggtgggttgatattagcagtgggtataatttggataaatttcatgatgaaatggctagcaagataatctgggggccaagccaagaaattagagtttggggtttggacactgaaattggcactgaatgtaagttgacaaccaatgaagaatttggccagtggatgaattctatgttggatgataagctggtagagtttggtgttgaagttatttataaaaagggatatgaacctattgaaggcattgcaaatccagttgattcagctattcaaggtgtctctggtgtggtaactgcagatccaattgatcagtcaagtgctcaagttctctctgctatgattagtgctgaagtttcttctcctggtcatgaagaagggacgggtgatacctctagccatccacaaaatgcagaagaggctaatgctgttgtagattggagtaagttggctatacttgttgaacctgagcaagattgtgatgttaatttattgttggatgaggatcaagtttttgaggccatgggcttcaaagcagcagatcagagagcagcagctgctgcagcagctatggaagaaactgcaattcctattattccaaccgagattcagcaagacatgttagatgcagccattgtagtggacgatgaagtacccattgatgtgttggattgggacaggg

SEQ ID NO: 7956 - DNA, 1501 bp, Oryza sativa
gccgacgccgacgctgagctggaagccgttgctgaacgcgccgcgccaccgcgacggcgccatctccgacaggtagagcggcacggcctggttggcgaagccgaggccgacgccgaggaggacgcggccgaggatgaccatgtagatgtccaccgacgcgccgccgacggccgcgccggcgaggaaggcggcgccgccgaggagcatggacgggcggcgccccctccccgccgtgacccgcgacgcggcgaacgtggtgaggagcccggcgacgtagagcgaggaggtgaacgccgtgagcagctggctgtcgaacttgcagtagttgctgacccgcacgtcgccctccatccgccggtgcacctccgggaagaacttcctcaagaacggctccatcgacgacacgccacctgcaccgccgccgccgccgccattaacgaagcttcacttctctcgatgtctcatgctacattgtgttacactgtacctgcgatcccgatgtcgtagccgaagatgacgccgcccatgccggcggtgacgcacgacagcacgacgaacgcggtgacccttccggttccggcgccgccgccgcggcgctcctggctctcgacgccggcgacgacgccgaccgccatggctgatcagatcagttccaagctgcaagtgattcaagtgttgcattgcgttgcattgctactgctgcttattactctatccatgtctccatctcgttgcggctgtgcaccgtggaaaaatctggcgcgcaacaaagacagtggtagtcaacggtttgactagcttgtgttgactagctgtgcagctgattggatggtttgcttcttgcttcttcggctgcaattagagcttgatacgtttcgtctaatgacaattttgcacatgttgctgtgaccacctctcttgtgcttgaatcaagtcactgtgaatcaacataaaacgtgtcacaaagtgcaaaattagtactcctaattaattaagtactacctagagaggaacagcaattaattaagtgctcctagcatatattagtactgtatatgaggctacacctaatcagagttcctgcctttgttctgaacttgaaaaactgacgagaattctttgtcagtagttggatgaaagcataaaaaaaattagtacaaggtgctgcggtgttgctgtccaacagtagattttatgttgaccagttgaagattgatgcgggttaattattgtttttgtgcaacagattagtcaaagatgtcatgtggttgcttgtttcaaggagaagcttcaattatgattagcaacaaaagtccaggcacatcactctctacattcatttcatacccctatacactgaaaaatcaacccctgcacaagaattcttgattcacttgcatgacaaacagatgtactcatgtggaaaattaacttgaatattccagttttctccaagcagaactataccagtcaacatgtaaaagattgtcctcaacttgta

SEQ ID NO: 7957 - DNA, 720 bp, Oryza sativa
atattgccttctatgtgtctgagaaattaaaaactccatatccaaatgcgctgattaaataaaacgtccttgtccaaatgcgaagtaagatttataaatacatagggaagaacatcaaacttcattcttttttaaaaaatgtacgctctgttttgaattaaaccaatcaacaaaactagggaaataagtacaagctaacttcttcaaatatagttccactctcacctccccttgtttctctaatgacatcacaggagtggattttgatccctcgaggggatatcccctcgttgtttgcatgtcactcaaatagttacgaaaaaagttgaaaacaattgagaagatatattaatatgtgatatatcactctacaaacatgcaagttcaaattcaacttctatcttttgcaacgaaaaaaacaaatttgactgtaaatatgcgttaactcgctatagtttaatttgtttttttcgttctgatatatagaagttgaatttaaccttgcatatttgtggagtgatatatcacatgttattacatcttctcaaatatttttataaccattggaataacatgcaaacaataaggggacatcctcacgagggatcaaaatagtttcccatgacattacccctcccatcacttctcccttccatttataatgccttgccagttaccaccactcaattgcactaacttatttcttcctccctcctcagt

SEQ ID NO: 7958 - DNA, 517 bp, Oryza sativa
gagccatcggaagttttggaaagccagagacaagctgagactgtagaatatatacattctttcaaaaataattaataataactgagttagaaaatatcgcaaaaagtaggaaagatttatatatatataaaccaagagcacattgttagttttctcattttgtttttcattgccaagaaaacattgggctggagcataaatgctttatgctaatgtctgaatcaatggcaaaaaccaatttaagtgaaactaacatagcccaattgcaaaaattcacccactttcagttgtttgttatctttagttggtggacgatcaatgttttcaggtcaaagaagttatttaataatggaaatccacagtaccgtttttatctcctataaatatagcatgtcatctgactacatttttctgcaaacaaagccagggaaggtgaaagaatattttatagcagtatcttttaccatgtttacattgagagtcattaatctcaaaatattaacctttcttttgcagg

SEQ ID NO: 7959 - DNA, 1424 bp, Oryza sativa
acggcggcgtgtcgacggcggcggcgtggtcacggcgtgccgacggtggcgtgacgacgacggcggcggcggcgttgcgttctggggccgtgacggcggcggcgtggcgtggcggcggcgacggagagagacggagagagatcgagctgagatcggagagatcgagagataaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgagggcgcaccgggaatatatatacccccggatctttactcccggttgttgagaacaaccgggactaaagatatctttactcccggttgttgagaacaaccgggagtaaagaaaagatatttactcccggttgttgagaacaaccgggactaaagatatcttcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaaactctaattaacgtacatatgaaattgccacctgtgtgatttaaaacttttaaaaattgtaagtatcacatataactagcatatacatgatttgaacttgttgaaacctctaataatcgtgcgtaattaacatatgccata

SEQ ID NO: 7960 - DNA, 613 bp, Oryza sativa
tctgattgagtatatatacattttaaccatatttataaaaattgaaaaattagccgaaaatttttggacacaataattgcttgctggggtccgaaattaccaaatctttttcataggggtcgtggtacgggcagctcgttgccatagatattttttatctcacccgcaacaatcccttatttaataaagggagacaagtatttttctcatctccgtggttagtcgatctcagcgaaaaaattccaatggcacgatgacataaaaggagaaaaatggtatgcatggaattgtactttacaacttttgttttcttcgattgcacaatgtacactgttgtcgaatagacaactgtgtcacgtcgaaagacgtggttctcttaacagtggttggaagtaaaaacaattgtattacttagcgaaaaatttttgggatcccccattacaagacactagagggctatttatagctccattacaaattctctcctttagggtttagattttacaggggaatttatatggttattcttgtgatagagactatctaggacacactgtgtcctttacatttatgggcccttattgggctacatggcttggcccatctacttagc

SEQ ID NO: 7961 - DNA, 1501 bp, Oryza sativa
agaccttttagttctcatctctcgaatgccattcttttaccaatgtagatgcccaatggcacagccgtgaggatgtcaagaaagcactaacatttgcagaatacgagaaagctcagagaacaaatgcgctcaaggtcaatcaaatatgcaagggtgttgagaaaaggcagagcatctctgctgacctcaaaatcgaaagtgaggagcctgctccaatgttcgttcctgggccctatgcgattgctcaccacctcatatcatcatgggcttttgaaggagcaccaaaggcacctagctccttctccaacctatgagccttgatcctgttattcattttcactaaacaacacaacaacaggagatagggaataaaaaattttagtcccatgtatcatgtatgccttagtttcttgttagtgtagatgtgaaatgtgtccattgccggttgtaataaaaggttaagaaaagtacatcacgttcactggaggatttggggggagtacagattacagagcaagtgtaatattttagcatacaatttgtaacagtgtatagatgcagcacagatgtgctgatgtttgtatcttccatattcaaagagctggcatcaagtgtgaaattttgccaggtttgttacaagttgaggacaatcttttacatgttgactggtatagttctgcttggagaaaactggaatattcaagttaattttccacatgagtacatctgtttgtcatgcaagtgaatcaagaattcttgtgcaggggttgatttttcagtgtataggggtatgaaatgaatgtagagagtgatgtgcctggacttttgttgctaatcataattgaagcttctccttgaaacaagcaaccacatgacatctttgactaatctgttgcacaaaaacaataattaacccgcatcaatcttcaactggtcaacataaaatctactgttggacagcaacaccgcagcaccttgtactaattttttttatgctttcatccaactactgacaaagaattctcgtcagtttttcaagttcagaacaaaggcaggaactctgattaggtgtagcctcatatacagtactaatatatgctaggagcacttaattaattgctgttcctctctaggtagtacttaattaattaggagtactaattttgcactttgtgacacgttttatgttgattcacagtgacttgattcaagcacaagagaggtggtcacagcaacatgtgcaaaattgtcattagacgaaacgtatcaagctctaattgcagccgaagaagcaagaagcaaaccatccaatcagctgcacagctagtcaacacaagctagtcaaaccgttgactaccactgtctttgttgcgcgccagatttttccacggtgcacagccgcaacgagatggagacatggatagagtaataagcagcagtagcaatgcaacgcaatgcaacacttgaatcacttgcagcttggaactgatctgatcagcca

SEQ ID NO: 7962 - DNA, 1501 bp, Oryza sativa
gatggtgagattggtgtgaaatcaatatgcaaacaccaataaaaaaaagagaagaatgggacatggcactaccctctttactaatcgggactaaaaattcccctctttactccctattagtgttactaaccgggactaaagataacgatctttaatcctggattcgtagtcttggttggaaaaccgaaactatagagggcttcaaaccgggagtaaagagcatttctccaccagtgtcactttgaaaagatggatcgatctgaccctaagtcactaaattaattcaaaatctacatgtaaatctgttctgctacaaaatgaattgagataaattacactattggaccacaagtcaagcaaattggtacaacatgaagcaagtaagagataattgtccaccagagatatcaaccgcgttcacatcactctcatatgtcctccacgctagttcacaagtacgtaaaccacatcatttgcttatccgccactctctcaaatttcaaagaggatagatggtttacaattgattttcattagattcatcacaaggacaagagaaataactgaaactgtgtcatgctatatgttttttttaaaagaacatatggtaacctgtataaagcttgtggtgcaaaagtaaaaaataatgcttggtccttgcactcaatttagattattcgacccaagtttacttaattgtatttacttagttgtagatgtacatagtcctacggtcctaccacaatcgcacatcaccccatgcccagacactaacatgctaatatgtaatgactccagatttgagtcctcaaaccatgatgtgatatctaaacaagagaataggagcaatagttcctccctatttttaaattatccaattctccaaagtagttatttagcaggacactgagggctgtgagtgcaagatatggtctgttgtctatatcttttgcgtatgttttcagttttgttgctaagataagataataggatttggtgatgggacaaacggttgctccacataaaattatagattaccagctgattcaatgaaaaaaattcacataggttttaccaagttatagtatatatagatatactatgccattaatcctcatagatgaaaagaccccttagctgccaatgcaagagtgcagggccttcaccattgacaaaaaactgaagttgccctaaaatttttgaagttgacagattactattctattatcatgcatgactttaacgacatagcacacactttgagatggatcaggatcctctgcagtcgaagtcacgtgactttgtcactaacatttgggcttgatgatccctggacccacacatgtcagtgacaaaggcatcatacatttgactgcagaggatctcaatcccattatattgaggtcatccaattagagacgtgacctaggacaacccatctcagtcacaattgagtggaccatatttagggaatttaaaacagaattatttattcatgctt

SEQ ID NO: 7963 - DNA, 1137 bp, Oryza sativa
gattctccagactctgtggtttggcctcatgaaaaaaacaaaacgttttctgctaagtctatgtatagattgatgaaatttgggggtgttgtagacagggatatgaaggagatttggggttgcaaagttcctttgaaagttaaacatttcctttttttggctgggagggatagaattccttgtgctgatcttcttgtcaaaaggaattggaaaggggggggggataaattctgcaagctttgcctggacattgaatcaaccaatcatgtactttttaactgtcctctagctaagtttgtttgggttctcataactgaagtaattgaaggggggcttgctccttctaccatttgggatggggtaaagtttcttaaagaaaaactagggaggaatgtgggtcttttcgtttgtgcaagttgctgttgggggctctggcttgtaaggaatgattttgtgtttgaaaacaaattgatcaagtcccccttgcaggcaatgttcaggatcatttcgctgatgcagagatggatgttgctgttaaaagaaaaagatcgaaaggctctgtcttccttgcttgacaagatgaagcgcaaattggaggatctgcgacctaaggatgtgttgcctgtcgatgcactagtctaagaagggtctctataaggtccttatggttgctgaggtagatgttttagcgttcctgggagtttatgaggtggtgtttcgttctttaggatccataagtctcggtgccccggatggttgctggtgatcctagctttctgtgtttttttttttagattatgggtacctcacacccacacggtatggttatccgactggttataggggatagcttatacctatcaaatatgtaacggatcatgttttgggtattacgtttccttgtatattatggaacagcctaaagtcctggtttgataatattgtaaattagatttaggaaaccgatgccatattggttaaggtttctatcttgtaatcctgcccgacacaacctgatcgtcaaatctatactacacctggcggattcaaatccccaaacaggagtagggtattacttctcattgagagggtctgaacctgtctaaatccttgtctccgcatccatccacttttagg

SEQ ID NO: 7964 - DNA, 187 bp, Oryza sativa
gattcctttttttctgttattggagtataagtagcagtagctaagtttccatttgtaagttttacaattcagtttgaatgaaagaaaccagaaaattgccccacaaattctctctctctcgcgaagttctgaaactcagtaaaactttgctttctctgttctgaattccttttctgcgttcttcagt

SEQ ID NO: 7965 - DNA, 1424 bp, Oryza sativa
gattcctttttttctgttattggagtataagtagcagtagctaagtttccatttgtaagttttacaattcagtttgaatgaaagaaaccagaaaattgccccacaaattctctctctctcgcgaagttctgaaactcagtaaaactttgctttctctgttctgaattccttttctgcgttcttcagttttctcgtctgttgccgtgcccgacgtatgcagtgtgcgcacacggtgttcgatcgggtgactcgtagctaacaaatcttgtaccagttcgtgctatttcttcgtttagtgatgcagccatgtttatttgatttgtgtactaatatttgcaacaagagaaaattaacttgatggcgctacttaacttggtggcaagtacgtacgtattgaacaatgaatagctaaaattagattctgtatttttgttattaattacttatttcattttatgttgcaagaaaaaaatgtaatgttagtacttactccctccatctcaaaataactcaacctagcaggagatgtgacccctctagataaaggtagtccagattcattatactaggagagatcaaatcctctcgtaggttgagttttttttgacggagggagtaattagtatgaacctataagtagtctggccaaatgattgagaattcgttgtcaagacaggaaaataaagaaagctgtcgtgatttccatgcatatcgccgtcctcatgttcttcacccaaaaaggcttagaaatttggaataacaaagcatgtttttcttttaatacgctccatgcgtgacagaactttagaatacgtgtatattttcaataaggtcattgcgtaattctagtaggagtgtgttgcagaatatttacaaatactgtcttatgcttgtcgtttactctgacatgtattttatccgacgacctgttgtatgtgtgtaggcggtctgtttcactttcttgcataagacaatcatgttcttaagtttcaacacactagaactcaaagatccacagttttgatgtgttagtcttaaattaatatttgtgttgttactgtggtcgttaccgagtattagctagtgctctaccttctctctaagtagaacatagtctaatttaaagaacttttttttttgatttttttgtttttctttttttttacccaaaatactactaggcaccgtccagtagttttaatttaaagaacttttacggggtagtaacactataaaaacgatttcgtgtacagagactttatattgcagacggaccataactagtcgcgtctgggaagataggctcattttcgcttgcggtccatttatgaggaccacacggttcgatttttccgtgtggtcctcttaaatggaccacacgcgaaaatgaacatattttcgcgtgcggacctattaagagagcc

SEQ ID NO: 7966 - DNA, 1501 bp, Oryza sativa
atgtggggcctcttgatgcttttaaaatattcttgcatgtagttatgttgtgatgttagtattcttaacacggtcttgacaatcaagcgtattgctcacttagtcgtaccgatgaaaatacatcacgcgataagatgataaagtgcacacatttactatattaatatacgaaaacgtttcatgttttaaacttgggaccttgtacatatgttatgtaacataattatttttgacattaggcaaacattatattacccggcttttagaagaaagccaaaaaagaaacacacagagccttgttacaggaaaaagaaaaacaaaaatatcgaaacatgaattcaccaataataaaaggggaaccacacgagatctaaaagtggatggatgcggagacaaggatttagacaggttcagcccctctcaatgagaggtaataccctactcctgtttagggatttgaatccgccgggtgtagtatagatctgacgatcaggttgtgtcaggccccctagagggcctcctgcccaccttatatacgatgggggcaggattacaagatagaaaccttaaccaatatggcatcggtttcctaaatctaatttacaatattatcaaaccaggactttaggctgtttcataatatacaaggaaacataatacccaagtcatgatccgttacatatttgataggtataagctatcccctataaccagtcggataaccatgccgtgtgggtatggggtacccataatctctacagtagcccctaagaccttcacagtcgaaagataatcttctctcaaaccagattactccaaagccgagtgcttcaatcatctttgccatggtctcctgagtacttttaccaaatctgaagactgtggagggctgaaaaataattaaatgtaaacttaggtgcatcgactagatgcacctaataggtgtagcccccgactatgtggttagttgaacaaactaagcatatagtcaaggagtaaataatccaaccaactgagtggttttgataattatagtcaaccgagtgacttgatatcaatatacagcatatgcggtgtgagtctccgaataacatgatccgagtgatataccaactgctttgtaaaatacgatgcgagcaacctaaagttgtgtacatcatgaaaaattcacatagcaaaacagctatagaagaagcttatatgcggtgaataaagaaatttctaaagtattgggcatacaccatgcgcacactggtttaacaaatgtgcttaagtctctaaaagacacaccgtttcaccacacccggaaatatatggcatacgtggtgtaaaatccaagtaaataaactcataaaggatttaccaaccgcctggaaaatgaccaaatatataatcagcctaagccataatattggtcaataaaaatgcacacttacgtggcaaaaagcaatgatattgtatccaatcaattgctgtataaacccaaacagcgccttgacta

SEQ ID NO: 7967 - DNA, 1501 bp, Oryza sativa
  unsure (1)..(1501): unsure at all n locations
gcgcggcggcgggcggtgtgggcgtggccttgagcgccctgagctcggcgagctccttgtggaggcggcggttgtcgtcggcgagctggtcgcaccaccgcttgaggtgctcgcagtccacctccgtctgcttcagcttcgtcctcgcgcggcggttctggaaccacacctccacctgccgcggccgcaggttcaagctcttcgccagcgccaccttctgcttctgcacatcatccatggatcagaggaagaaaattcagccatgccattctctcggattcaatcccatctccaatccaatccaccattggcgatgggtaggagaagaagcttaccggagtgagggtgtggtgcgtcttgaagcactcctcgaggacggcggcctggtccttggacaaccgcagcttcttgcgcgcgccgccgccgccgacgtcgcagccggcgtcgtcgacctcgtcgccgctgccgctgccgctgcctcgcttcccgctgccgctcgacaccgggctgccgggtgagcacgcgaacctctcatcctccgccgccgtcgccgcaaccacatcatcacgcctgatcacttcctgctccgccatgccggagttcagacagaacccagcagccggccatgtcgccgccgtcgtcaagcctagcccgaggctcaggccaagatccaagccttgcctctccatgtcttaagtgctctagatcaatagctacaagtaagtgctactagtgagtgggagttcgtcggcgtcggagacgatgaagagaggaggagaagaagacgaggggtataaatagatgagaagatcatggattgaaatcaagaaaagaagattggtcgacaatgatgagctggtggcgcgtgggtggatctgctttgaagattcttgaggccaagccaagggacgatcctgcagtttgcgatcgaggttgttgttttgacttaacgggcaccattacagaatacagctatagagcttgatgagaagaagacgaagaaggtagtagaattgcagctgcatgcttgcgagtgtatcaatcatctgaataataatattggggattcttcgtcccaggtgagattagcagctaataaactagtccagtcaaggnagatattnnttcttcatccaaaatatttgttgctgtgtacgtgtgcttgggtgagtcgctatcgatctgtgtaagaaatatatggagtgcggctgcacgatttcagatgttgtgtagttgtgccaatctaggaatttttgagcttcagttttgagcttgaagctagccacagtgcaagaagctttactgacggtatttggaggaattttgcaggattttcatacgatttaattcaattcctttgaaaaatcctacgctatctacctatttcaatctttggtatgtcagagtaatagcatgaattcgtatttttggataaagaaatattccagcttttgcataaggtgtacatgcattcaactattcattattacaaagcattagc

SEQ ID NO: 7968 - DNA, 1501 bp, Oryza sativa
  unsure (1)..(1501): unsure at all n locations
tgcgttcagactcctgcaaacctagtaataaattaaattatagcagagtgagtttatttttaagtatctgttatcatatcgcctccttaaaattatattcactataaaagcaactaatctaataatctaaagctgctcttttgatagcttttgattggttcacttggtgcctcttactttggagaaaaatcataaatctatactagagaaaaaaatacctaataatcatatgtgagaaaaaatctagagaaaaatatcacatatggattccagaggcttccaaaactatcttccctttccaaccacatgaacttttactcctttaccttctataaatataccacccctacttggtactactcatataactctttaaacccaaaattattaagaaaaaaaaaatctaaaatagcgaatttacattcattttccttctttaagtatcatacgcctacttggtactactcatgtaactctagaatatatagtaaacccaaaattataataccaaaaaaatatgcaaaacaaacaaagaaagaagacaaccttattttcttatatcatcatacctactcagccttgttttcttatatcatcaaacctacttagctaaaaaatgattgtgttttttttttacacaggatatgttaaaaactctaaatgtactaaatgcttgatctttcaaaaattcaaattcataagaaaatatatttgaatcaattaattctgataaatctcaaaatttcttttacttgtttggatttatcaaaatttatgtataaaatgatgtggcacttgtagcaagtacttttatattcaggctgaagaagcgatataaactgttaggttgttccttatttggtcttttctaatgcctaatgcagtagcacacatggcaaattggcaatgcatgacgttagtattaggaaataggaggtgatcttctaccactaatgtgagatttaatgcaagtaagactgtttgtttaagaatatactatataatataaaatgcagtgtgctagctaccagtagtacagctgctgttgtctttttatattttagagtttatgtatgcatgaccagtatgcatggagtcataaaaattcatacacgagatggttgggaaacttggcgatgatttttacctttaagggttgnnaaagaggtatgattgtttgatattgatacatacttgttggtggagttcccattgctggtaactattacattctgggtgtgctgaatgattatgcttggtggtagggtgctagaggaggtggcttggtggtagggtggtagactaggtggatgtggaggtccaccgtacaacggtgccgacatccatggcctgcatctagatagtatgtttctcattctcttataatatttcaagaaaacatcttaaccatacaatttgatctagatagtatgtttctcattctcttataatctttcaagaaaacatcttaaccatacaatttgtgttttttcctgttaga

SEQ ID NO: 7969 - DNA, 1501 bp, Oryza sativa
gcaatatcatgcaacaattcatcaattcgattccctgatagaatacactttcgtgcaatcgtgctcgtacaaagccaatgctgaagaaaccacaccttaaaattttgcatctcgatctcaccaactgccacaaagaggtaccaggagaaggacgagcacttcagcagcgagagctcgagaaggcttctcttcacgacggccggcacggcggagtcatcgaggaggctgcaattgacggcgaggctgcggagcgcgccattgcctactagaatccggcattcgtcgacgggaacatctgcaacaacagcgaccagaacaccagcatttaattagggggaaattgatttggacgggagaggagcagagcggaggggatgaacactcaccgacggcatcctcgtctacgagactacgaatacatgagcaacggctccctcgctgacctcctcttcaaggccggtagcggaggtggcagctacccggccctcaatctcatccaccggcggttgaagccgttgtcgcggcggcggcagcgaggcacggttgcctactgcgctgagggcgaaggtggacggcgttgctgagagggattgccgcggagatgatggagttacacgacaggagaggggccactgttggtgtcgacggcggttgggagggggagagatcgggaggtggggcaagggagtgacggcaagcgccattgttttcctcccggtgatatggatgaagcgccgagaaagctatttggcaatcagtcacgcgtgcccctccccgcacgactggacacatgtcgcgcagagagaaggagggaggagctagttttctgttttttttcttgttttttttcctttttttcgtttatgtttggttgattttttcttttttttatccgttttgttcgtttcggttcggtttggttttttttccaggttctcttccgttatgttctttttccggttgctataaagatgtatgaatacaaagtttgtactcatatgtaaaccaagtttatattcgtacgtatgtaaagtttgtatacgcgtatacgtaatgcattttcttgttttttatttttttatacatatgcatataaagtttgtatacatcatatacaaagtttgtatatgtcctatataaactttgttacatcgtatatagactttgtatacgtcatatataaactttgtatatatgtatatatttttaatgcgttaaaaatatattcataaaaaaatatatacatatgtatatagtgtatatacatacatgtgtgtatatatagtatgtacatacatatatacatatgatgtataggagatacagatagactagagatgaccgcacgcgcgcgtggggcgcgcggctgatcgcgtatcagcgccccccatgaagtgtggttgccatagcctggtcggctgacaagtgggcctgaacatctaccacgtaagtaaaaatagtgtaaatagggtttaaactgccatagaacatgtcgacgagt

SEQ ID NO: 7970 - DNA, 1501 bp, Oryza sativa
tgcatatcccgccaaatacgttgacatgatgtgatgcagcaaatgagcaaatggtatattgtaccttttcttttcctttgagtcaataggaatgccacactattaagagggatggtgcattgacatatgaggagtgatcaaagtgctcaaaatctatttttgaaagtgtctctcctcagtttgaagtgttctggattttttcggagttgtccgaaactcattttcggaccttccaaaaaatacacagaacctgttgggcgcttctagaaatttttggatatgtccgaaaaggattttcggactttccgaaaatgactatgaaggcaaatatggttatgtatattttcggacttttccgaaattgatttttagagtttccgaaaatcatcagttgtcccaaaatcgcttctgtgtattttcggacttgtccgaaagggattttcggactttccgaaacatccagaaggtggtttttggttctggaaattttcggatttgtccgaaaagttttcggaatgtccgaaaaatctttcgttgactttattgttagtgctgagctggaattttcggacatgtccgaaaatctttcgaaatatccgaaaatctcaattattgtgcataacgagcagattttgggctgtggctataaatagcaccctcccctcacttgtgagggctgctggtcacattggatattcttgtgcccttggcttgctcttgttgagattcacttttgagccttgctttcttgtttcccctctcacccgtgttcgattcggatttggtgtgtgtgtgagttgtggattcgagtttgtgtgagtgcttgttgttgacttcgtgaagatttgtgagcacttgcatcatctccgggagttcattgcaccatttgttactcttggaggttgaggacttctaggcggctaggtgtcgctcccgagccaccgatctacttgtggttggccgggagaagtttgtgaaggtcggatctcacctccgaaagggaagagatacccttagtggaaagagggtgcttagtgcaacctcttgaggaaagggttagctaagacctagctcttagtgagctcctcaactgagagtagaatcccctcaaggattcgaacttcgggaacaacttcgtgagcttcatctttggtgactttacttcctccctctccactagctttgcttgtttgagtcgctataggtctagttgctgtttgtgctaacatattcttgttgtaggcaactagatctaggatttactttgtgtttgtgctgactccgaaaattttcggatatatccgaaaatttcggaaatatccaaaaattactgcttccgcttttaattgaatttttgaattagcctattcaccccccctctaagcctaattgacactttcaattggtatcagagcctaatctcctaattaggcttaaccgcttggagagatcatgtcgggccaaacaggggatgggaatgatggtgataagggagctaaga

SEQ ID NO: 7971 - DNA, 296 bp, Oryza sativa
ccaaaagtatcattcctaatgaatatgcttcacactgttcttttaatgcatcttatgttcttaggaagaatgctagtgatcgtgttgttgctaagtatgtaggcccaaggagcaagaatatttctaatcaaaagagtgctttgggtgcctaaggcacttgttactaacatgagaggacccaagcaagtatgggtacctaaaactagaaattgatctcttgtaggaatatgtctccggtggaagaagttgagtaattgatagcagatgcaccaatcacatgaccggagaagaatcaa

SEQ ID NO: 7972 - DNA, 1366 bp, Oryza sativa
gcaaaaattaaatagacatatcaaaactaatcacgtttatggcgcttgaaccgggttactggtgactgagcatctcttggcggggtctggtcatatcgaaagttgtaaatgtcctcttgtataatatcaaggtcaccgccgtcgtcgatgaaagctgggtgcagaataatcttgttgttggggtcttccggcggatttagatcgtcaacgtcagaagggggggaagggcatagggtagacatgtaccccaagtcctccgcgtagatcatgccatcatcttccatcgatggcgacagcgggtaagggggtggcgacagtggaggagggcttgtcaccccaaactcttcggggagatcactctcatgctcatcctgttgcagcgtggcatcggtggtggggttgtgagtgggatcgacaaaatgtgtctttgtggattcggtctcttgtttatcacccatggttgagttggctgcgtaatacaaatgatgagccgggcagtttatattggggaaactgacaggatggttgattcccacatatcagggcaaacaatctcagcgattttgtagcgattcttgtttgcatgcatgcgcgatatatctggagtaatgtgcgcatggataaacaaccataatgccaccacagcatagcgacgtaaagttattaaataactatatttaaatcatgtcgtgtaaagttattaaataacaatatgtaaatcatgtcgtgtaaaaaaatcctctgatacgtctttcagcatctataggctcattccagttattttttaactttgccaacgtttacttaaattctccccatggccctatagtactcccgaaacaaagacaaatttttaactccttacatgcgacatcgaaaggcaaaacaattatctcaatcagttaaactataacttctcacacacggaacgtcttcatcaccgatcggtctatgcaagttaattttaaactatttgacctcatatgcacaatcaaccaccaccgattttaacataaacatgactctgtcgtacgggtggaccacggtaaaaatttaacttgttatctgcaacatcttaactcatcaccaatatttaaaacagttaaatttttactatcacattcgctctccctttgacatgcgaactgcaggtatcgtttgcgccacaatttccgtcagttaatttttaactctctaataggttggtttggttttggtgggctgacattcctcatttgtgtgtggcgccatttaaaccgtggcgcgaagcgcatgtgagcgccactgtgtatatatatatatatgtgtgtctatatatagacatactataccgcatcctaataactaaaacactccccctcacact

SEQ ID NO: 7973 - DNA, 1032 bp, Oryza sativa
gctatagccggaaccacgctggcagaccagcaggggtcgatgcccgaagcaatagataggaaattacatttgcttagcttagataattaaaacacatagaaagtcctctctagcccacctaccactagttgttgtcctttgctagtcttagccttaggtagattacacacgttccctgagttcgatatccttttggggtcacccgaaggtgaagtgctacagcagtattctgtgcgcttgcggatttatctgtggtcgcaagaaataccaacagtggttgtcctgttggtgcgcagttggttgggggtgaggtgtgaggtagggatgaaaacggagcggatatggacggataatgtttataccatattcgttttcatatttttttaccggatacgaaaacgaatacggatagctcgaatacgaaaacaaatacggattatctcgaatacgaataagaatcgaatatgatcggacacgaatacggaaataaatttttctcggaacacgaaaaccaactcaacttctaatagaaacaaatatcaacatatataattagctcattttatataaaatgaggtataatttataaatattttttaaaatttaaataatattaatagtatggactagtgttagagataaactactattaaaatctataaaggtatattgaaggttatagagttaaaaagaaatggggtatgtctcatgggtcctgcggatatccgaatagcactgttcaccggatatccgaattattatccgtatccgacggaaaccctggtaccatattcgtatttgtatccgggagaaaatatccgtattcgtatctgtatccgaactatccgagaattatccgatccgaaagttatccgtatccgtttttgtccggagcggacggaaactatccgctccgttttcatccctagtgtgagggggagtgttttagttattaggatgcggtatagtatgtctatatatagacacacatatatatatatatacacagtggcgctcacatgcgcttcgcgc

SEQ ID NO: 7974 - DNA, 1501 bp, Oryza sativa
tgttgcggcggattctagatatggtggaggagagcagccatcatgttggcctgctgggcgaggatttgggtgaggatggggctggtgccatgtggcggtggtggcggcggagggggaggtggaggtggaggtggactgccatggttgttgttgtggctgccttcggggtgactgccctaaccggtagcagtgcttctcctggttgtcaccatatgaagattccacacagaaccagcaaacagaaagagctgacgattaaaactaaccacccacgactaccataattcttaaatttatttctgctattaaattggttcattaaggttcaagttgcttacgcaaataaaataaagacaggctccgacacagttataccacacaccggtataaccatgccccacacaactcagcaagagaacaaacgaaaagaacacacgcgcgggcctactagctgctcgtctacttctgcgatgggtcggggcggaaggtgagcaatagcacatcctccgtgctgccaacgccagaggctcccaactcctgaggaaccacaggcgcaggctcagcgcaaggagtctccacgaagcaggtccatgccaaggactgacgaaccagctcaggcctggaggtactcttgcgggcggtaatcttctagctgcggcaaacgcggcggcgcttggggcggcagatctccccctgagcaatcttgagctgacacagctgcgcctccatagcgtccaagtccttcaactgcagattctcttgacgcagctccaggatcttcatgttgttctcgaccaggccacggcgcgccatgcggtagaagtcgatacgggccgcgtcgtacgcctctaccatgcgcgccagatgcatgatggtagcgtcatcctccgagctagcatcctggaaggtggcgtagtcgcgggctcctccacgacgagggtagtagcggtagggcgagtgctgcaactcgtccgggtagcgctggtgaagagtgccgatggcgaggagtgcagcgttctggcaggtggcggggaaggagtccctacccgcggtgacggccagcgaagtcctcttaggggagccggtgaggatcatcgcagtgacctcccaagcggcgcggggctccgcatcgtcaccatcctgctccggaagcctcttgccctggtagtccactccatgcggatatcccaggacaacgcacatgccccgcagctccaaagcaaagccagtcagatccagaccacgacggttgaggttggcggccatctataaataaagacaaaagaaaaattttagagatcagcttttgatgagaaatgaagcagcaagacagagagagactaaaggattttcacaaataagagatgatttttatttcaaaatactgctaaggcttgggttctagggttcgtcctagggtcaaggaggctctgataccaacttatcacgactggaattaacccaacatgcattccatacgtgcgtgtattattccttgtcc

SEQ ID NO: 7975 - DNA, 1501 bp, Oryza sativa
gtggtcgtcgccctagtcttccgctgttttccgtttgtcttcgtgtgtgctgggccttcgccgcccatgtaataatttatctatttacacttctgcttgttaaactctgaattgtatcaacttttggtgtaccttgcctcctgggacaaggaataatacacgcacgtatggaatgcatgttgggttaattccagtcgtgataagttggtatcagagcctccttgaccctaggacgaaccctagaacccaagccttagcagtattttgaaataaaaatcatctcttatttgtgaaaatcctttagtctctctctgtcttgctgcttcatttctcatcaaaagctgatctctaaaatttttcttttgtctttatttatagatggccgccaacctcaaccgtcgtggtctggatctgactggctttgctttggagctgcggggcatgtgcgttgtcctgggatatccgcatggagtggactaccagggcaagaggcttccggagcaggatggtgacgatgcggagccccgcgccgcttgggaggtcactgcgatgatcctcaccggctcccctaagaggacttcgctggccgtcaccgcgggtagggactccttccccgccacctgccagaacgctgcactcctcgccatcggcactcttcaccagcgctacccggacgagttgcagcactcgccctaccgctactaccctcgtcgtggaggagcccgcgactacgccaccttccaggatgctagctcggaggatgacgctaccatcatgcatctggcgcgcatggtagaggcgtacgacgcggcccgtatcgacttctaccgcatggcgcgccgtggcctggtcgagaacaacatgaagatcctggagctgcgtcaagagaatctgcagttgaaggacttggacgctatggaggcgcagctgtgtcagctcaagattgctcagggggagatctgccgccccaagcgccgccgcgtttgccgcagctagaagattaccgcccgcaagagtacctccaggcctgagctggttcgtcagtccttggcatggacctgcttcgtggagactccttgcgctgagcctgcgcctgtggttcctcaggagttgggagcctctggcgttggcagcacggaggatgtgctattgctcaccttccgccccgacccatcgcagaagtagacgagcagctagtaggcccgcgcgtgtgttcttttcgtttgttctcttgctgagttgtgtggggcatggttataccggtgtgtggtataactgtgtcggagcctgtctttattttatttgcgtaagcaacttgaaccttaatgaaccaatttaatagcagaaataaatttaagaattatggtagtcgtgggtggttagttttaatcgtcagctctttctgtttgctggttctgtgtggaatcttcatatggtgacaaccaggagaagcactgctaccggttagggcagtcaccccgaaggcagccacaacaacaac

SEQ ID NO: 7976 - DNA, 1501 bp, Oryza sativa
cagagatacctgaaagatatggatcatggaccattattgaacgtgtctgcaacaacactggctgcagggcattgaaaaagcagaagaaattaaagggtggttttgatcactcactttgatgtgagacttggaatttttccactgccattttgtcaaatgtcaaccccttgaagttgcttccccactacttgagctcctcttttctctcttttatgttcactgccacttgattgatacttagatcctacaatatactagctaactatagtgtgttgaccttgtctctaccatgcaaattgcaagagtagggaaatatcgaggattttagctagccccccatcacaactttttctcctcctttttatcttttcactttcgaaaacttagaacaaccttcttggataacttcgaacaaccttcttctagaacattctatgaaggcccgcctcgaacgtaggaaggaaatatttcattttgatgtggatatgaaaattgacttattcggaattgaaggttggaagattaccatattccaaacaggtccaattcgaaaggccagaaaatcaccatgtttcatacaagtaaaaaaaggtgggaaattctgaacttacatatttaaaatgagacattacatcatttaactctaaatctaaggcctcgctctttttggattaaccctgatagattgtatatgcattgccacgctttgataactataatttgtccgaaaacttcataaatcagaattgcttaaataaattgttctaagttatttattagatttataatatatagtatttaatccatccctgtaattaaggcgatcatccatcaattttcatcttcaaagaatgggcccgtactagcactcaacaaaaactcctgtataaaaaggaaaaatgaaaaaacaaggagctccccaaggtaccacattatggactaccattatcagatcagattcactaatcacaaccattgcaactctaccattactatctagtattatctccgtcttaaataattacatttctatcatttaaattttatcccaaaaaaatttctgctgacaaaggatccaaatattccttttaatcaagtttaagaatggtaattaagtgggcttattgtctcgaccttccttttaatcaagtttatgtaggtaatgtgtggtcattaaattgggttattgtgttaaattgtgtttgttgctaatctatctttaattctctcaaaatgtaattagtttgggagggaggtagtagcaactagcaactaattactaggtctaaggtgaaaaacacagggacctgcgatgtgggtcccacaccctgtaccaggcccaggcccggcaagcccacgggcgccgcgggcccatccaccaccagcaccaaccacggcgagacctcacgacctcgcccacctctccctatatataccccctcgccatggccgcctcctcgtcaccaccatcaccaaccaccaactacagcaagcttgagct

SEQ ID NO: 7977 - DNA, 1501 bp, Oryza sativa
ataatagtatcccgcagtcccggttggtggaggatagcccaggtacgtagccaccgggtaactaaagtgataacatgcaaaggagaagacaccatcttgttatcaaaaattactctattcctacttagccaaatggaccaacacagagctgttgcacccatcaaaagcagattcctcatttctttgaggacacatgatagccaactcccaaacatatgaccaacagtgcaaggaggtttcagattagaagccaaatgaattacagaccacaccaagcgagataagcggcactgaaagaataaatgttggatagtttcatccttgtgacagaaacaacatgtcttgctgcctttccaatttctcttagcaaggttgtccttggtgagaattacgccccgacgtaaataccaaaggaagattttaacttttaggggtactttcaccttccaaatccgtctattgatattcagaaccccggtatgtgttagagctagataatgagatttgaccgagaagtccccattcggggtgaggttccagtgaaactcatcttgctccttgtcacaccctgatttttgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggagttttctcggatttttcggagctcaattcctaatttttaatcatacaaagagcatttcagtaattacccacatattaaattaatcattaaatggtctaattataattttgttaagtactttgagtgtccaagtattttcatgatttttcttgaaattatttgagcattggaagtatttttaacaattcaaagatcatttaagtgattattttaattgggaaagtaataaaatcctcctcctcagcttgggccattttcggcccattccttcctttccttcctctctcttccgccggcccaacctgagccgcgtcctctcctctcagctctgccggaaaagtctactttccctccctgcgctattgttcatcttccaactcaggcagagcccgagccagccgtgccgtgcacagtgccgccgcctcttccttccaaatctcgcctccccgttgctctttttctccaattttgttgaggggaaatattactcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatcaaggctataaataggaccccctagtcctcctctttcgtttgccccctctcccgtcctcttccgtgctccgtagctccgtcgccaccgccgccaagcaaaccgccaccgccggccatctccggt

SEQ ID NO: 7978 - DNA, 1501 bp, Oryza sativa
  unsure (1)..(1501): unsure at all n locations
tattgctgcaatattgcaggttggtattgattctgctacgggtactgtagctgactgtggttgtgaggtggaaattctggagtaagtttagttgttacttgtttatttcccaaacatatggtcatactttcagtctcgtctccatatatatatatatatatgtaggtgtgagccacttccggatggtcgtttttatctagaggtaaaaccataatatttttgcaagatgttatgcttgagcttataacttctgttctaggttggtttggctcatattgagtggatgtggttacacatactagcgtaccttacaatatcaagatttatcctggtnnattttgcagcaatcacctctctggatgcagactcatagcccacttttgttttctaaaaggaccccttatggatgcttatttttaatctntatttgtggggcgaaccattcaccggatacaatgaaccaatgtgttgaacacttggtgctcaaagagactgctttatccctgttgattaatgaaaaaccctttcccctgccaaaaacgttttttttttatttccatagataatgtcattcaacaaatatgaatttgaattattatcagatgtgaaaataatactttcagttataggtggaaggttcacggcggtttcgtatcttgcgatcatgggaccaagatgggtgagtgtgtcaattaatctgggaatataacatgttggatcaacccttgtgtatgttcattttactttagtcatttcccttttcaggtatagggttgctgaaattgagtggctccaagatatttcattaccagacggatcgcaggagagaaaagatgtaaaatcttgttaacttttcggactgcaattcttttagttgtgctgtgaagtattgcaaaaatgtgatggacaaaaaccagcttaagcaccacatgatgttattgaagtaaaacttgcagagtacgaattaagaaaatatttggacataccatcactaagatatagaagtttgaaaatgatgtacgttgtgaggctgatagggatacatgctgcgtgattcattggttcttgatgagctgcaacatgaaggaacaatttaactagttaccaatagaagacttttacttcaaaaggagtacttgtttcaataggaccaagttttttgtcctaataatgcatgttttatttaaacaaaatagaaaaacattttcacaactattttgaaaatgggctagtacttttcccagtaaaatggacacatagcctatgtttgcactcgaattcttagttgtacatttgttttgcacgtggttatttttccgttctgatgaaattaaaatctgctttacgcttacctttgtcttcactgtttatttgaggttttatatgtttggccttctgatatttatagacggaagagaaaaacatcacaatggaatggtaatgctgtctctattaatttgttctaagtgacattgatgtaactcttttggctcttttcagc

SEQ ID NO: 7979 - DNA, 898 bp, Oryza sativa
cactagagccatgacatctttgatggcacaccctgaagtgtcctccctcttgacaagagactcaacagacgcagctgatttctcttggttatcaacaaaacaatcatttgttcatagaaccaatgtccaccactggtcttgggtttcttggcttccttaccagctgctgccttacctctcttgggaggaggtgagaaatcctcatcattactatcatcatcatcaccttcattcacagcttttgtatctacattaatagtactggaaggttgggttgaactttgcggtaaatttccactagtaggattacagtggtcatctcctgtgtttcgaaggtcttcaaatatttgttggagcaaatgttcattttgaatcccccgtaacttgaactttgcacaacctggcaaatccttgaggaacaccaagggaataatcagaagagtgacacaaatatttgcaaaatcatggttaacaacttaaacatcaacattaatatgtagtataccttcttggctcttgcccaccaatcatcagatgcaacaatagtagccctagcttggtcccaacctaatctagtctctctagctatcagtttcttccatagattatactcattcctcagcttgctccatttgttcttgaactgcagcttttgatagcgtaagccagtcttttcttcaaattttgcaatcacattatcataccccaccttgttcaaatgggtatttgagcgatttcctatcctaacttgttcagcgagcaactcacaaactatcctagtgttttcatctgtccattcaacattatttgcaccttgattttcctctactactgttgctgccatctgcagtagttatgaaataacacatatgcaaatcaaagcacagatgcacatcaa

SEQ ID NO: 7980 - DNA, 1501 bp, Oryza sativa
tgaatgtcctcttggagatagcaatctcttgcatcatgagagacacaatgtcgaactgacgaccctgaatgatagcatcgatgacgtgccaagccacccccctaatgtcatcattgttgccaaggcgagggaggatagtggctctcacaatcctgttgaccacactagggatagtcctcaagccgtcaaccttctcatgtgtgtaccgcactccatcttcatagaactgagagagatagtctatggagagcggattgtgagtgtgctcctcatgcaaatcatctctaaaatccaagtgaatgttgaggagccgccggaactgcctccgagagatagaacactggagggtgtcagacatccacttcatctcactatagtctctagccacccacactgtaacatagaactgtcggatcaaatcttcattgtagtcttgcttgagggtcacaatccagtcaatgccaactatcttgaagagatcatgcaagctctcaaactctggagtctcattgatgtctctccaagaaatccacttatgctctgcaaaagctttccctgcataaacctgctcatacacagtcttctgcaaagcggtgtgaaaccggggatccggggtgtcccgaggcctcaagaactgatcatgatgcctcgagatggtatactggatttctcatgttcaccacaaactggatggagggatcaatttgcatctcatcaccttcttcatcctcatcctccccactaccactgacatcatctccactttcctcctcactagccccctcaacattttcctcaacctcttcatcacttgagcgtaatcctctccgctcgactcctcaggctcactcacgggatccggagtgggcgcatgaagaccatggcgagtgcggggaggcatcactgtcaaagagcaaaggatgataggatattagcaataattttagaaacaatttggagaggtgaaaatgtacctatatcctgtggaggggtggttagaccgtagccagtagggcggtcagaccgacggcatcagaccggtcagaccgcccactggtggccggtcagaccgacgtctgctggccggtcagaccgggcgcacacgccggtcagaccggcggctgacccacggtcagaccgcctgtggctccgggcagaccacctcccacaagttcaagcatctaaaaattttcacaactacacatttgagtctaaaatttgctagaacaatatagcacaggattggaacatgaacatcaaagggttggacctatttcatcaagattggaacaaagggagaactacccttgttgtcaaaacgacaactgcatacgtcgaaagacgtggttactcaacagtggttggaaagaaagtaaagtttattgaattgagaatttttcttggggatccccccattacatggccctagaggtctatttatagctttagcacaagcttgcaccttctagggtttggggttacaggggattttacatggttg

SEQ ID NO: 7981 - DNA, 1501 bp, Oryza sativa
tgccaccgccgtccccttccgccgctggacacgccagagccgacttcttcgtcgccatcgtcccatcgctcctcctctcatcctcctcgcctcctcgctcctacccgcatgtactaacgccgcgccaccgcagcctcaccagagccggcttcttcgccagccgcggccgccgccaccaccggccccttccaccgccatcgccaccgccgccgcgcactccacagctagcagccgtggtcttccccatcggccgcggatggagccgacgtcgtccccatccggcgccgccgtcaaactccatcgctgccacaggttacttgcatactgaaaaactgaaaatgtctgcaaatttttcaatgacttacattttgtgacatactgaaaatgtctgccaaactgccacaggttatattttgtgaatttttcaatgacttacattttgtgtcttactgaaaatgtctgaaaaagtgtgccaaactgccacaggttatattttgtgaatttttcaatgactttgaatgtggctcaaatacattctgtctttgattccactttaattcccctattgatgtcaacaacatgtgaccatgtgaactatctccagtggttgaattatctccaggaaatgtacttgaatgtctctggttaatctaactaataattcacagcagttatacattttactgaatcaagtatgtgcagtttcacataataatttgcagtacatgtgtttgatttgatgcacgttatcttcaataggtccagaaggctggagctacacaatcagctaggtcttaccatggtaaattgtttccggttattctcaattgccgttcggtgggctcaggataaccgatcgaaattagagttgtgatagttgatttgcgggtctatggaggggaatgtggggtttgcgctcatgatttggagggggtttctgttcggttcatgcaccagcctcctatagtgtctttgttagatttatcttatttgcgcacataatgcaaaccatttaggtttacggtggtcgttggacagaagtagaatgtgtttacccatcggcgtgcccaatgcccacctacgtctattttcttgttagcgaggatatcgatcaattgactgctcaattaatcaattcatctattgtgtgggttattcaggtcaatcggctcctcccctcagcccacttccatggtcaatgcagtaagctctacatccggacctactgcaaggccaggtcaatacactccatattttgcttcatttgcaaatcggttttgcagctaactaattggatgagaacagatgtcacatgtatgtactgctcatatatcttgatatcatctcgatctcgcaaaattttgatggtttgcttctcaaattgttttttactgctcaatgtattttttgtattctgttttatagcgatttgtcatatacttctaatagatctcaacctgtattgctgatggttgcttcttccagctcaatgctttttctc

SEQ ID NO: 7982 - DNA, 1501 bp, Oryza sativa
gatcgtcgctacactcgacttatgcaaatacttaagcgtttttggacgcatatgccaaaagtcgagagcgaatgatgagggctgaaaagtcaatgtgaattcctttcgctaacacgcaagggggccgacacgcttcgcccttccgaacgtacaagttacaaaatgcgatgatagcgaaaagaaacctaaaaacatgcacaagctccatcgggcaaaagcatatacatgttatataaaggagcaaaaaattttataagtatattacatcatccgtttcaggacattttcgcctcgcccctactaagtctggcgaacacggttcatcatctatattgtacacgaatttaaggggaaaaggaggcgaaatacacaccgacgtcaagcgatagcagctcgacgattagtcattttgaagtctgaaaaaagtgtggcaatgtcatcgcggcactggatgtggcacctatcgtaatcctctaaggttcgaccaggatgtcttcgcctccaattcgccattttgacaaccacatagctacataaaaggcgaacgcttgatcgacaaaaacgccaagggggcgaaacgaatcggccgaagcatcgctcgccgaacgttgaaactgcgacagcttgtttcagaataaagatactgaatgccgttacattcaacttacgcaaaacacaagcgtttttcccagcgcaaaatgctacgaatcgaaaacggaagtcgaaagttgagaagtcaacaaatcttttcaccaatccccgaaagggggccgaacgcatgactttcggcgaaatccccgctaaaacaatagggaaaaggggaaagaaaaaaaatataagtcaagaatcgcgcaaagcagacaaacttggcaaaatataatcacccagtgttataatacagtttcgccattctcgaaaggcgaatgctagtgttcatattttttctgcaggagtctaaaaagaggtttcggcaggaacattggccgaaagggggcgcctcatgccataccgtatagtttgcacggtctcggccgaagctccttactcacccttgcccgtgaggggcttattggaggcatgccatgaagcccttcgaccggacctgccgaaaccatagtaccagcaaggattcaagctaaagacgtcaagaccattcaggcgaagccctatggcgaaagccataagcgaagatggcaaaggctggaaagccgcgtcggtactccgaaagtaaaggcatcttgagcgaaggcatctcgggcgaactacaaagacttcgccatgacgagttcggcatcaaggaggcccaacaggccgcccccggtcttttaggcccgttcaccgtagactaggcccagcctatcagcccattaaaggcccatatgtgcaaatgacactgcgtacccatgtaaatgtccctttcataagggcaaccatgtaaaatcccctgtaaccccaaaccctagaaggtgcaagcttgtgctaaagctataaatagacctct

SEQ ID NO: 7983 - DNA, 1501 bp, Oryza sativa
caaaacctcacttttaactaatttgagttgctactataacaaaataaagaatgcttaactaggtggctaattgatcaaaagaatacataaattccatatttgattttagaactcataagtatggtggtcaaagatcaattggtcaaaggtgtggttttatgaaacactagaaccataatacccagggttatatgccatgtgctccttgtgattttgtgtaactatgacataatacaaggggtatgtgaattttgctctagaaactctgaagcatctgtgcttgaacataaacagttgataggtcaaatggacatattcacaaggattatgtgaaacccttatgtttgttactacctccgtcccaaaatatagagtttgggttatacctctacgttttgtaaccaagacacgggtaaattctccaattggtggtcaaggacagtgaatggcttgcagaaaagcaaggggctcaactcgttgattattttggtcacttgggagatttggaatcatagaaacatttgtgttttcaatggagcaaaccctagtgtggtgaatgtgctccatgctgtgtccagtgaggccacgctttggtgtttggcgggagctttgaacttcgaagctccaagacctgttgtctaaggcttgtagttcttgcaccctaggcaggttggcatgtgttatctttgttcttagagtgggcgtgtgttgtgttcctataagactttcaattgatgggtgttggggtttgtttaaatcctacatcccagccttcctttctatcttttaatgaaacgatgcgcagatctcctctgcgtgttcgaaaaaaataagagttcgacacgggtattaagaaagtatgtggaattaattggggagatattgtgattggttgagaagaggaattatgaagataatttaaatggtggaaggttgtgattggttgattggttgagaagaggatgtatgagagagattgttatattttgggacaagttttgaatgctataagttgttatattttgtgatggagggagtagcttttagtgcatttcttactttgatatactaaataagaggttctcttccaatattattctttgacaaaactcagatgcagatgcaaaggtgaatttccaatcctatccccgcttatgggattagttttcatacctccctctgtagagaggtacttcccaagtagtgggagactgggatgtataataccttccttccaaggaaaggagaacacatacatgaatagcagttttcttaatccagttctttacaaaaatggatcacaacagccaacttcacatataaaatgaatataaaatttcgaccatcagatgtgataaacttgaactttactcacaaccttctggacagaagaattatatatattcataataagttaatatatataaaatcacgatgcgatggacctctgtaatatcaaaagaaaattagtttacttttcttagaataaaacgagcagtcg

SEQ ID NO: 7984 - DNA, 370 bp, Oryza sativa
tggccgagtagacgaccgcctccacaaccgccttcggcaaccgacctccgcggcctataaatagacgatgaggtcgccccttttcccctccacaccatccgagctcttcgagctctgtctttctctctctcttcctcaagaccggctgccgccaccgtcggccgatctctctcaccggagcaccactaaccaaatcctctcaccaccaacattgccttactccggcgaatccatttttccacttttccccttctctttcgtcccatttcaagccccaccggagctctctctctcctgccggttcacggtcttgagctcgtcgttccggccattcccttaaccccctctgccggccactaccttacctagg

SEQ ID NO: 7985 - DNA, 1501 bp, Oryza sativa
tgagaagcaactgctaagaagctagctggtgagaatctggagaagctggaaaacccagcttctgtcttctagttcattttccagattctacatctatagattcttagaatcttggtaaaaagatgggttgttagggagagcttttggtagctagagattataggagaagatgcaactgctaaaaactcctttaaataggtccttttagtaatgtgtcacgacctctaaaatcgcttacattttgagacggataggacaagaaaaagcctggaaaatcagaaaaaaaaaaggaagagcgaaaatgacaagattacccctccgccccttccaccttctcgcagccacacctcctcctctttcccctctcctccctctccactccacacgccgtactcgcctccgtcttcccccccgatctgcgggcgcgcgagctcggagcgtccttccccgcgcgcgccgccgccaccgccgagagagtggcctcctcctcctcctcccttccttcccgcgtggcctgggcctgcggttaccccgcgcgcacggccgacgacgactgcgacggcgacgaaggcgagctggtttcggaggggggcgcgacgcggccgacctgctcccccatctggttcgaatcgaaaggtatatcctcgttcttctgtccttggcccttgttccactccaaccttctcgacgccgctggatggatgggcggcttagattcggaatccgtccgatttgggattgggtttcttcccgtcgaattaacgcatccggttctttgtgcatttcgttttattttatgcgtggtagagagtactagtagcatcttgtagcgtgtgtttccgtgaaaacaaaattgatttggttgggggattatgtgatggtgaagccatgaagctcgccgaccactgtcacagtgtgactgcagagagatgggtgagagagggggaggaaagggattgatgagctttccctctgtaggctacttgcgctatcgcaggagatggcttcaaatggatccttgttccattgcaattgttgggttactggagatgactctggagaataagatctgaatgagtaaaatgtggttcgtatcgtgccccttgggtaacccggccatcgattggattgatgttaggttttgcaaaagttgaacttcattttgtagtttaattttgattccctttgtttggcgtgaatgcagtcgtatctctggagaatttttgctgaaacgttaaatgtgttagagcaatcgaatgcttgtcgtggtttactttgtgcgaggatcttttttttgcctcatgctagcatgtgaactgcttatgaaatatgaaccattgctatgttggtgaagaaatctggttataacttttgttgaatgcaatttgtaggtctagtggtaaatgtatgacctgacttgaatagtatcttttcaggtggatgccaatcggttggtcggttaaaaacaactaatttagctgatcctgtggggaagaagtaa

SEQ ID NO: 7986 - DNA, 906 bp, Oryza sativa
atgtcctcgcacatagagagcagcacgatggcgaggtgaagcgacacgggcatcgacgtgaatgagtcagcaagcgcggggtgcgcctccaccagcgtgtaccaacgccacatgcagatgagagaagggagaagataatggcaaaattgttgttttacatggtttttcttctgtcaattaggtgggtgacatgtggatcccacgatatttttttgtgtgtgaatgacatatgggtgtcacattttttttattctaatgccatgccacgtaagcgccacataggacaaagactcggtaaagaccgccacgtaggcgtcacgttagccaaaaccaccgagggatattgtttgcatgggttgtgatagctggagaagtcgatttacccggttttgtgggtggaggacaggaatcatactgggcgatagttgggggagccgaagtataatttttccctattgtttgtgcgtgtatatttttcatctgggctgcctttgggtgaaatgcgtggcccatttgagagtccacacccacctgggctggcgcctgagccagctaagcgtgaccaaaaagaaagaaagtggcggggtttttcaattttggtttattagtggtgaaaaaaggggtgtgtttgttcagtggaatcctagccgcccaaaggagttggaagcatcttggccgtccaagagcgatccgtgtcgaccgatttggaccaatcagagcgctggatcaaatttggcacggattgagatggtttggttttcccgctcagcgctttgaaaaatttgggggataaatatctgaggaggggatggggcccagacgtcagccagggccagccccctcgtcttccccttcctctctccactcctccaccaccaccggccgcctcgccctccccgccggcca

SEQ ID NO: 7987 - DNA, 1217 bp, Oryza sativa
aattaaaaaaaaacgaaaaaacgatgttgttgttgccgctcgccacgaccgccggacgcggctgccgccgcccgccggccaccgccggccgcggccttgacacccaccggcccgccggatgagaaggaaagagggggaggaggtggaggagaggggatgaggaagagagttagagaggagagatctgtggagagggggagaaattcgatccgctaagttgtaattgtggaggagaggataagggatagggattatatactacgtgttcaattttaatcacggttagtattaccaaccgggactaaagatctatctagaagatctttagtccttggtgatctttagtcccggttattgacaccaaccgggactaaagattctcggccccctgacatgcatctgataggggatgaactgggactaaagatcatctttagtcccgtactaaggatcaaaatttttataaccgggactaaaaataatctttagtcccggttctttttggaactgggactattgtggattttgccagaccgaccaaagatggttcctccaccagtgttacatactaattacatattaagtggtgtgtaagtgggatgtaactactgtgtaaatttgtaaatatataaataactacccgctgcatacacatacatgcaagtgtgaactcagaaaagcagcgggcagcatatccaattgccataaaactgactgctatggagccaaaaaactggcgacaaaaatatagtaaaaccgtaatttattagtcccacaaactcactctacttgcacaaaatgatacttatcacacatcgtacccaatattctcaagtgcaacaagacaagctttgtacgatagcagcagcagagatctgtgattggcagctgctagctcccaagatcctgttgcagcgacagagagatccacaaactcactctacttgcaccacatgatacttatcacaattcacacatcgtaccaaacattctcaagtgcaccaagacaagctttgtacaatagcagcagcagcagcagagatcagtgattaggctttaaatcactgatcaagatgagtggcgcaacggcggactgggcatggtggctcggcctcgtcgccggcgccgtcccgctgctcgccctcgccgtctggcactgcaccgacgccttccacagcgccgccttcgcgttccgccgccgcgggacacgcgcgagg

SEQ ID NO: 7988 - DNA, 365 bp, Oryza sativa
gctcagtggccgcacagtcgacgccacgtttcgacaccacgtgagccgaccgatcccttcgcatctcgaccgtccatcgactacgtacggacaccgtatttatagctaacacaaaattgctactcaattttgaaattaatggaactgtatatatagtaaattttgactacatatttagaatacaaagctcaaaattgttatatttcgaacaaatatagtaggctatagtaaaatgagacccacgtgtcagtgacatcactgcttgttgtgcatcgttttggatataatttcatcaaccaaaaagtaattaattagaatgtctatttatcgttatgttcatattaaatgccttaatttaaactagg

SEQ ID NO: 7989 - DNA, 1442 bp, Oryza sativa
tccgttcgctcataaaagtaatatatttaacttttatgataagatttggttaaactatcaaatgcttagtttaaaataacaatatcataaacttatatagtactttataaatttattttcatacaaaatagactgttaaagtttcaaaattttactaaatccgattctaaacatcaaatatttttgaccgagaaaatataaatattattatgcgccatgctttagtgacggtgccagagttagaaaagagttcaatattgctgtaaaagaaaaaaaaagttcctcccggggagggggagctggaatacttcgtgaaaatttaagtccaaattctgctaagttcgataaattgaacccttttcgaccaaaagtatatctacagtgcaccctccttgtggacgacgatgtagttcaattcaatagcctcaacgagtgcctggagccatgtatatatagccaaaacccatagcatcaactgctcttatatatatgggaatatatcctgtgcacactcctttcatataaactagcaaatgtcacagaaaattctaaaaaaaattacacacatacttccaatagtattacacgtacgtgtgaaatcttatcttcaaattcattatattttagccataaaaaagacaaaattctgacagatttttaccctttaatctgtcatatttttcaacttttttctacggttaaaatataatgaatttaaaaacaagactttcagatatgtatagtacaattaggagtagatgtttaattgtttctagaatttttcatgatatttgctagttagtgtgtacggagtgtgcatgtgaaatttatgcgcataggatatgtacttatatatacattaattttctataaaagggaacaccctaacagtatacattaaatactctcccgtaactaattaattaccagttgcaagcctttctatgcatataatataatcgaaaaaaaaacaaaaacccacttgcaagagtctgccccattcacacagctatagccaattaatccatcaggaaacgcacgtacgagtacgtcacaaatgtcagcaattaattaattaactgtccatacgtgtgctctacgacgtttgcaaactatatactcctgggtttgtcagcaaatttgttcgatctctctcgatcgtctcaagaattaatgtcagcatctgatggacgatgatgatatgatgaacggtgaaagagatcgagatcgagagagagagagagatagagagatagagagatagctctatatatgtccatgcctgcctgctgtaatgggcactcaaatctaaatgacgatatatatgacgcatggcaccaaacagagatgcaaacatgatgacacagctgataggtatgcttgtactacatatatatctatctctcacaagaaacacaccaagtggctgagagagagatttg

SEQ ID NO: 7990 - DNA, 1501 bp, Oryza sativa
cacagcgtcgcccgtcgccgtcgtgagaaaacagatagagagagagaaagggataagaggagaaacgctcacacactcccactggccacacagttgagggcgctggcgcgagatctgcggccatggacgacgacggcggcagtgtcctcgctctccccgtcggcgccatcttcctctcccacaacgtgcctgcccactgcccgtctgctctgtcggctggccgctccccgcgctgtcgcccggtcctccggcaggcctgtgcagcaggtgcatctgccgccgctccgcccgccgccggccgcgcgccgccgcctgcccgcagctcctccccccgccgccgcctcgtgggccttttgggtggcggccagcgggggagtccgcacgccgctcctcccccagtggcccctcccccgctgcccgcccgcagctcctccccccaccgccgccgcgttgcctgtcgtcgctgtcaccacagttgcgtcgcccgcgtctccatcgaattggagagaagcgagagagagatgaggaaggagagaagaaggggagagagatgagctagcgtactgacaggtggggtccacgtggggcccacgctgactcatcccgccacgtcagacaaaaccgggctcaaaaccgccagaggatctcaagcgaacggttttgttagttgagggacctccggtatctggttttgcggttggaggacgattttgtaactcgatgacaagttgagggaccttcggtgtacttttcccaataaacttctacagaatataagtccacttactatccctcatctttacatagagtttaaatgacatccctaaaccgcaataatagaaatctgcaccctccatcttcataaaaccattcaagttaggttctatggcagtttggatgaacggtttcgctgaagtgacatcctattcagtaaaaaaaattaaaaaatatatgggacccatctgtaagtgtcatacattttcttcctcactcatttcacttccgcaatcgctcagacgtggcttgcgctcgatgccgttctcgtcggtcccctcgaggaaccaaagagccgaacaaggaatatgatttagacacagtttaactgttgatctgaccacatcgtgcatatattcagacgatcatggcgacgcaatatttcgacacctctgaacattgcagtacagtaccttgagattcagaagagcaacctcgatacccatcgcagtttgaaccactacacatggagcaaaaacgaacaaaatgttcttgtatgtgattacaacaacaaaccgcatcgctgatcaatgtctcattgcactacagaattgggtgattaaatttgtgattgctgaaaatcatctgcatggttataaatttaaaaagaagaagaagaagaagaaaatttggcctgatcctgtgtttcagaagccagttttcagacgagaaggtgaggaggatggatggccaccgccgctaccccggcatggccttctccatcgtc

SEQ ID NO: 7991 - DNA, 499 bp, Oryza sativa
cgcatgtaaatatgcatgcatgcatgcatgcatcgcctaatggccatctaaccctataattaaatcatacggagtataatacttcctgatagttattaatatttaatttctcgatgtccattatagccaatcttgtatgaaagaatgaagagttgcacattaaatctgagaaaatcattaagaagataggtggttggatttaaatatgtctatcataaataaatttttcagatttaaaaatatgtctatcaaaactagatggagagagtatacagcactattgttactactagctagcagtgcaagcagtgcccaactatggcatggtttatttctcaactttttctttacacacataaactttcaacttttccgtcacatcgtttcaatttcaatcaaactttcaattttaacataaactaaacacaccctatatatacaggactggactaaggtagcttgctagttggcagcgttggaaacgccgaataaccagtga

SEQ ID NO: 7992 - DNA, 994 bp, Oryza sativa
ttcctgcagcccacagctacattcacttgcctctaatgaagggttggtatcatacacgatctgaaggaccaccacctaatcacaaacaaagcctcagaaaacacactcaaatatgcatatagaacagtaaataacatgcatctacggcctcaacacctcaaaacgcaaaaacaaggaacgccgcttggactataaacagtactgttgcttcaaacctttatatctcgaaaaataaaaatgatatgactgcaaataaatacattttgggaatctacagaatgagacctacaactttcgtgtagaacccatatttttattctgccatttagatgccctaaactgcaaatcaagacaagattcagaatctgcccaagaattcagactgccacacttaaaacagccatatctggagttctactcgcccaatcaaagtgtactttaccaatatggaaagctaaggaaaaactctacaatttcctagttataaactttcgcagcaaaaatcattttgatcctctaattggcgaaatacagagacacagcaaagctgacagcgcccagaaacactaatccaaaacacaacacctaatcccatcctctaaccctccaataacgacgaattacaaccctaaaacaacctataacctctgcacaggagagttaagcctctttggagaacttgagagaatatgatgggaaaaccaacccaccactcttcctgctcgtctcctcttcctcgatctgtttttccaatcagattcttgattagggctatggttcttggagatccatggagtagggttaataggggagacgtgagttccataggtgccgagggggaggtgtggcggcgtcggctgggaaggtgggagtcgcctctccctagggtattaggtgggggaggtgggctggactactgcgacgtggcccaaattgattcggcccaattccaaacatgttattttatttttaatttcagggtattacaatattg

SEQ ID NO: 7993 - DNA, 726 bp, Oryza sativa
cgagtacatttacaacggagtatttttaagcctgattgagataacttcgttctgacggcccaagaagtctaggcatatgttcgctcgtcacagagggccggatctgtactagtgacaattagtttaagttagctgcattcaatattttatatgaggaagtaccattttattgagaacatcacaaagtgtcaaacagcaaaaatatgacctatttatacaagtgaacgaaatacagcttcgtcggaatattcataactatatataccgcatattcttctctctatctattattttcatgtgttctgttgctttgctataacgaagagtttcgtcctttgataaatcggagagggaaaaaatggataagtgttttcgaaaaagaaaaacagagaaatgttgcatcgccgtttgcaaaatgccaagtcaacagcagcatacagaattttgagtcaactgcaataaatgcatagccccatagtatcgcttatgctagccgaattttaaatttaaaacttaatttttttgattttgtagtttttttatcgaagtttattttacacatcggacactagaaacatgtatatacaagtcttacccataaatttcttttttgttgttaatatgcggttcggattaacatatgcataagcaaaataagtccactttgactctctctccaatctaattcgtatctctcaaccagaatactaatatcttagccctagc

SEQ ID NO: 7994 - DNA, 1501 bp, Oryza sativa; identical to SEQ ID NO: 603

SEQ ID NO: 7995 - DNA, 1501 bp, Oryza sativa
ttaggtccaataaggacagtgggggcagttgcaaatgatggtaattgatgcataatttttgagcaaaattgaggccaaacttattatatgtcatgacttgtgtttttaggtacaaaaataatatatatgtgactgttttgggttttgggtcattttgagggaattgggatggatatgcatagaaatctattattaaatgaagttactaaaattatggcatttaggagaatatgaagtgtcccggtcgccaaatctggtttggtcgggttactgtctgcacggtaccgaccaagacaaattggtaaaaagaacatttcgttcaaatacaacatttgtagaaatctgttatcgttaccaatatcctagattgatttcaaggtcatttctttatggaaccctgttgggggaagtccctcgatagcgggaggtcgtgagacccccctttcgtgggtttggccgggggaagaagctcgcttcatagaaatcacgtatccgcccctaaggctgctaatcaacttgcacacaattggattatacaggttcgggccgctgtggagcgtaataccctactcctgtgtttgggattatggttaagtgttacaaggacgtcttccctccgtatgagttcaggttttctcagaatcatccccttgttcggtgggcaaggtcctccttttatagttcaaggggataccacatgcaccgcctctatctacccttccatgggagggggacccactttaccttgaccgggtcacgatccgtgccttcgcttggaagctaagcagcagcccttccttgagtgggacccagcgccgccccctgcctggtacggggggcagccctgtcattctctcataaatgagtgaagacttgtggtggtcctcctccgaatgacgtttcgacgggacgggtcatacctatctctactccaccggatacagaggcgacatgggggggcacagccgcccattcaattggacgtgaccggcgacaggcccgtcatagactggtcacgtcctaattgacgggggtcagctagacggcaccacacgactgcccttactgcattaaacacagtgagggacagttgggcaccgcacatcgatggctgttcagcctgggtccccttcccgctcgttccccccgccacatggtagctgggcgagggcctcagggcaaagcagcgcgaaagcccgaggggcacaacgtggcaccccgaggcccccccggccgcttctgtaactcatgaggaggtgagcgtgggtgaggcgaggataaaaggatacggaggcaaggactttgccttcttcctttcgccaactgcccacttgccttctcgctccttaagccctaatattctcgccacttcacaatatcccgcgcgccaagccctccgccgcttctccaccagccatcatggctcaagacgctggtgacacagtgctcccggcatcacgcattacggcggatagacaccttatcctcccccgtaagatca

SEQ ID NO: 7996 - DNA, 494 bp, Oryza sativa
ggctcgagcctgagcccgaggccgaggccaaatctaccctaggacccgaggcggggggcgagagggacagccactcccccttgcatttggggcgcgctcggggctggtcgtgccgaaggagggccgagagcaggccccagtctcgcgggggatctagcagcactctgtcgtcccgggggtggaccggcgacgtataggtgctgaaacccacctcgagccgccttgaatggtccaaggatgtctagcccccagaccgcaaaaggccaggagagtgggatgacctgcaaggcttgggctggctggtggcctcccttcgcccaggggcagagagagggcgaaaccactcgaacgggtggaatcctccctccgcgagggttcgcgacgggaaggagttggggagtcgtggcgacggtgacgagggccgtggctcccactagagtccccactcctggatggggtgggggtaaacgccaccgcctcctccacctccaaga

SEQ ID NO: 7997 - DNA, 1501 bp, Oryza sativa
agcaacatttgattccatacaccaactctgcattctgcaaatttctaaaaagcacaataatgcgacatataatttgacaaaggaaatatatatgtggtttcgtgcatatgattcatgctctagctctcaacttgttttcgttttagcaaaagtgaatgtattagtagtactttattagtcctgataacctgctggtggacacattttgttattacatgattctgtctgcatctttgagattagctggttaggtcttttttttttctgggaaggaaacacaattggtactttccttaaagaattgcatattgctttggtagtttggctcgtttggacattggaatgagaaaaatgagaaaataattcctctttttcactttgatacttttcattcctcttgataatttcattgtgatgtacaattgcattcgtatttctatattggctcttttctcaatattatttatttttactatgaatttcatatatttctaaataaatggactattatctcaatattatttattttaatccaaactttatattgtatttataaaaggactctttttgattcctatgtttttattccgaccttcaaatattttaaattgtattttgacttggattctttggtttaaactacaccgttatagtttagatccacattataatcaatggcttagaatttttattttttttcctgattaacgtgaaaatttctaaatcatgagagcgaacgtgtatagagaccatcaataaacctgtggtctcacaaattatttttgctcacaacataagcttggaagagttaatgattagcaatacgtgctgtatattattatgatgactcactaaattgtggcaccagctctttgagtttccaaaagacataatgatgtgatatataattagagtaaatcaaatagagagaacggtattccgttggaacggtataggtatgatacctagatatcaggcatgatacatagtatcatctgtaccattccaacggtattaccgttccctagtctccctcagaaaattatttttcctgagagaaattcgtagccatgtgcagttgcattttattctacaccaacctgccctacatttctagaagggcacaataatggcagatagaaaattaaagaaattataagccccaggtaatgatgtatgttctctgaacttgatttttttttactagctaatatgtacatctcaccccttcagccttttttaagtagtcctgacatacatgtgaatatacaaatttgacgttacagattctgacagcttcaataagattatgcagcagctttattggttgagaaggaaacaaaaaactggaactatcctaaaaaagaatgttggacagaaagcaaaagaaacacattgtttgacctggaatcatctacctagatgctagcaatcctgcaatctcttcaggaaaattcagaaagaaaccattcacataatcaggatctccaaatcattcaga

SEQ ID NO: 7998 - DNA, 1501 bp, Oryza sativa
gaccaataaaaacttaactagcatatattttatttaatgtgagtatatgtgtcatggtggatacatcagctgacaggacgctagtgatgcccacgatatgtgggaggagtgtgggtccagtagctatcggctgggcccaatttcagtgagtgagacctaataatgatatgctatataaagtcggcagtggagagagatgacttgtaatagaaaatatctcaaactcaattcaaatcttctctcttcctgctcaatattctgtcgcaactaccttcttcttcctctcgtgcttcctgatttcctcacgatccctctagaagttccaaattctgtggcgatcgtgacaatatggtgggggagaataaagaaacatgcagattttaactccccgtatgcacaagaaacgagcatatatattacaaaacaaaaagctaatactatcggccaatcactgcaggttcactaaaaatagagtctcaagataggaaattaggaaaaaaaaaagggcatttgaccaataagtgagcatggggcatcaaaaaatctagacaaaatttgctataggacaacaaaaaaaaaatgtaattagctgtaaaacaccgtaaagacgtgaatttgccctagaacactttaaaagtgtggtaaattgttgcaggacactgaacgtattaaaatactagaaaaaatgcccgtgcgttgcaacgggtaaaaacgtttttcagtggtagaaccgcaattaggaactgagcaatgagttgaatcgttaggatcactatatatatacattgtaattgaaaaagttaataaaacatgttccttggtttgggccgaaagcccatcctttccttcattttcagtcccaacccagttcgctacctccctttacttgacctgactctctccgatccagcccacaagtggagctacatgcccaactcgcacagtcgactaccctgactctctccgatccatctcataagtggagttataggcccagctcgcacatctagcgtcttcaacctctagatagtcatgtgcccgtacgccggagtcaatcctccccatcaaatctagccaaatgttttttatatcccaaaattggttgaggtcttttgatccactcgatctcctccttttgtttttccctaaatcggaacgtatccacaaaattcgggttaaaaaggtcggtcggctatcatcggcgactaagactaaatccagtgaactaaagccgaattgaaaggaaaacggtgagaaaaaatgataagggaggagtggggaatcgacttttgcaatcaattgtggggaatcgacttttgcaatcaattggaggttcatgggggagacatatcaaagtgagatggcgctagggtttggtcaagcggcggtggtttgcaacagatcggatgagataaaaaaaaaactggatggaaaaaaaacagcgacaaaaaaccggatgaaaaaagcgaaaaaagacggaaaaaaccaaatcgaaaaaaaa

SEQ ID NO: 7999 - DNA, 1501 bp, Oryza sativa
cacatcgaacgacacacctcctatttcgtcgatcacctcttgtatgtcgtccacgagtgcaacgtagcggtccaccaataccatgtggggtggtcctcgttgatccgccctcaccataagtgttggatcggccagcatgggtcctggatccatgggtactttcgctagtggctggcagtggatccaccgggcgggcgacgagaaacgagagggattggtcttttcctagctaggtcgaaaaacacatgcgatgcgatagatctctatctctctcgttatatatcttctctccgatccatcgatcgcatcctaatcgatatcgtgttcgagcttccatatcgcacgtcgcgcgcgtcgttccggatcggagattggtgtacgtacgttgatctcaatgttctaccgatttttgtccgtctgcgtatctgattggagtttcctccgttaattaattgccgcaccaaccacacctcttctcggaggccggccggagcgtcgcgttgtccgtggccgcgccgtccccgtcccggcccgcccgcctcttccactcgatcgacagcaagcagtggagcgcgcgcgcgcggcgtgcacaggccggtgaggtcttccgccgtccatcgatcgtccatgcatgcaccagctagcaccgcctcctccgatccgatccgtctgtgcggctcctccgccagcgtgcgtacgtagccactaactagccagcaggcagcagcgacaccgcaacagctagccctgcaaatttgtaaatttgctactgccgttgtagcacagccagcaggtagccgcgctacaccttctagctcttgcggccgtacgtcgtgcttgctcgttgttgcccgcacgcgaaagccctactgtgactccgcaaaagttactaatttcactggccaatccccaacaggaacacaaacgcacatatctattggtccttgttcttcgttcaataagatacccatatattgtttaggctcactgcatacagcatactaatacaattatacatcctggatctttggtgatttttttgggtatgccggtgcatacccagcaccacccctagatctgcccctgcaagtggtgggctggcctgtcccgtctatggttgctgttaatcaggccgacgagatatgatccatctgcctccatgtgctcgatcgagtccatgcagccctcgtgtgatttctcacctgtcaccacgtacaccatcgatcgcttgccgcggcagcagcgcgcttcagcgatatgattcacgggtgttgcggattttacagcaccgagcaagtgattgatcgatcgaggtgccgcttcacgacgaaatcgctattagtcgcgcggcgagttcacccctactacttctagcccaaactgtttctataaacccacgggcctctgtttttttttttggcttcctcgtgttgtgggctaatagccctcccgcgcgcgacacgatagagaaggcggcggacgttgcgtacggacgtacggt

SEQ ID NO: 8000 - DNA, 1501 bp, Oryza sativa
aaacattgacataggagtgtgatttactttcctagagatataattgagccactatcaccctaggtttgaaaaacataacttagttgcttagttagagttgaccctcaccaagcctagcaatttaggttagttttgattaggtgtcatttagttttaaatcgcctattcacaccccctctagtcgacatctcgatcctacatgcggtagccctccgttcctcttcctcgcttgctctccccctcctttaactcgcttggtagctcggttagccttccggtggttcttaggcgccgccccaagccccgccgccgctcgccatagccttgctgccatcggcgctcgctcccggaggccgcctctcgtcgccggacctccacggcacctccccatcccatccgacgctagaaacgggtcccctgagtcctagagatgctcccactccgccgaatcgaactcccattgctccggtggattttccccttttgctcgccgccagccgccgccatcgcaatccatcgccattgacctctcccaaagaaatccgagccgttggctcactctctcttgtcttcctcgtcattccggtgtgctccctgttgcctctcaccgtcgcaaggtgtcccggtgaaaccgccgccgtccgccgtctatctcggcatcccccttcttcctccgccagccggcccgcgtggctgccacgaaggcaccacgtcggcgccagctcgaccggaccgagtcaagctgaccccggtcagccgctccctccgtctcccgctcgcgcgtgcggtccaccgcgagccgtgaggctgcgcgtgggcccgacgcgtctcggtccatccagcgcaccgcccgtgcgccatccccaccgaaccctagcgccgccctcgcgtgcgcccatcaaaccgtgggccgtgtcaccgacaagcgggccccacctgggaccccgctcggtgcactcggtccaccggacccccccccccctctcccgtgccctaatgggccgacccccgcgctcgccaggcccaaaaaggctcggccgagccgcgcaagccatcgggccgcgccctaagccgcccaaggaagtctgattcacgtctctcctttatttcttttcagaaggatttaataaatcctttttcctttagacagaaaatcctttaatcttccaaaaatcatatcttccaatccgtagctccgattgactccgttccacttccaataattccgtaaaattcagatctatttaatggcactaattattagtctaaataggatctttatttggtcttttgtttaggtttttattgtttgcgtttagtcgcggttgccggattatcatcagtcttgggcctctcaaagattcgtgaagcttcgtgaagaccttgagcaacgcaagtcaccctttgatcaattgctcctataattggaaaatcattattattttgtttgcaatttgcattattagaatcacacacttaacatgcttggcctcggtttgtg

SEQ ID NO: 8001 - DNA, 524 bp, Oryza sativa
ctgtaaatgattatcggagtcaatcctcaataaaaatattttcacacgtttttcaaatgtaaagagagaacaaactaaggactccatagttttgtgaaataacatatttacaaatagaaaatagtttgtaaataaaatttttatatacatgttattaacaatctaaaaatctaaaagattaaaagtttaagctgaaaaataaactaggatggaaattaaaaaaaattctaaaatcaactttaaatttaaatttaagattaaaaattttaattgtagcttatgtttataagtataagtataagttaaaagatgaggcgataaaacaaaagaggcacagaaagaaaaaaaacctacaagtaataataaagccataaacaactccgcccgaggccgagataccgggagacgcatcacggaaccacgccgccgacgacgacccccgccgccgcacaactccgctcgccgtctcctccgcccccgcctccattccgccgccttccttagaggaagccaagtttccagcg

SEQ ID NO: 8002 - DNA, 223 bp, Oryza sativa
gtggcggggagagcgggcgaggcagagggcgcctcttagggcctttaatgcgcggcactccaaccgttcctcactgcatttaatgcggtgtgggtggacgtgcggcgccgcccgatagacccatgtcaatcgggcgtgaccggtttatgaccggtcacgggtgattggacgggcggtagcgtccccacgtcccaccctgtgtcaggcggagtgggggcaggta

SEQ ID NO: 8003 - DNA, 1501 bp, Oryza sativa
gattttatcttagtttttgttaacacgctattcaaattgataaacggtatattttgtgtaaaagctttctatataaaagttattttaaaatatctgataaatttatttttcaagtttgtaacaattgacaatatgaaactcaattaatcacattctaatgactttatcatttatcgtgccctaacttcatttccatttttagtgaaacgaacatcgccagtctgttcatatctcccggtcctatgaggctagatcgattttcattatcgaaaaaaaaatcttgagttcccatagctcataaaaatatttatagtaagatgtttattcttttagggatggagtggtaatgccgtcgattgtgcttttttatggtattttggaaattttgattgatgaagtaagtgaacagtacatctcttagagttttaggttataagacgttttgacttcagtaaaagtcaaattacttcaagtttgactaactttatagacaaatataataatatttataataccaaattagtttcattaaatcaatcattgaatatatttttataataaatttgtcttgggttgaaaatgttaaaacttagtcaaacttaaagcagtttgactttgattaaagtcaaaatgtcttataacctaaaacagagggagtagttaactataaatactgttcctcgccaaaaaaaaactacaaatactgaggaccgagcttagctcggttggcaagttcgctgtggtgcgaacggctggtcgtgaattcgactcgcggggcctcacctcgacgggtttttccagtcttttctttgggactgtccttcagggcagtctcgactagaaaatagggagtggtagtgcagtcgattgtgtatttttttaggtcttttgaaaattttgaatactaaggatcgagcttagctcggttggcatgttcgctgtggtgcgaatagtcggtcgtgaattcgactcgcggggcctcacctcgacgggtttttcccgtattttcttcgggactgtccttcggggcagtctcaactagaaaatagggtacacacgcatgtgcgttcagtgggactgcacgtttcccgtgcattgaggcctagtgcctccattctcaatcctagcgtgtgttagggatacgcacacgtgtgtgttcgtgtgttgtgatgtgattgtggtgtgtgagtatgcgttctgagttgtttcctttaaaaaaaagggcaaatactgtagacccattgccagttttaatgattagctttgcattattatgcagtaacaactaacaagggatgctcatacataaaagcaactgtcattcaggatgattttcctggatagacgaaaataataactactcactcaagatggcgaagtaaaatcatcagccattatacaagttatttaccggataatgagcatatataggtcacgctcataatctatagtaaaaaaagtttagccgatcaattaagcagcagtcaaaacttgcaggcga

SEQ ID NO: 8004 - DNA, 779 bp, Oryza sativa
tgtaaatgcgatgtttgtggcgcgacgtgtactagcgtggggttttttgtcgacggatttgattggtcggcgggggctgacgggtgggtcccacgacatttcggggtgtgcgtgtgacgtgggcgtgaagtcatggtggtgacgaggcagggtcaaagtcagagttgtcatgctgctttatttagctactgttctgcttttggggagcgaggctcagaaaactaatttctgaagcttctactaatcgtcaagatgagcacgggtagtttggacgattagtgagacacccatggtataccgccatgtaccattcctctatacttctgtatatgtctagatttattaatatctatataaatatagacaatgctagaaagttttataatatgaaacagaggaagtataacaaaaaaaatttccacacaatattttactacctccgccccaaaataaacgcagtcgtggatatccgtgtccaacgtttgactgtccgttttatttaaaaaatttataaaaagttaaaaaaatagttacgtataaagtattatttatattttatcatctaatgacaaaaaaatactaatcacaaaatattttcaaataagacgaacggtcaaacgttggagatgaacagtgtaaaactgtacttattttaggatggagggattagtaaatttgtagtttagtgcctaactatcaccgagtcaaaggctcatagcattgtggtggttggcggcggcacatgtggatccacagtggttggaggcgcctcgtcgtga

SEQ ID NO: 8005 - DNA, 445 bp, Oryza sativa
attgaaaatcgctgcaacttgcagccgttttgaactaccataggcgtatctgctaccaaaaaatctctttcaaacacactatttatattttgggatggagtaagtaagattagaagttctacgtacagtggtctggacacttggttaagtgagaaaccatgtgcataaatgtgaacacgctgagtatttcctcgaacgatcgacatttgaacattttagttaactgaacgagctaatctaactttgtatatatacccaatttggtaagcgtatattaatcgatgtttggcttgcggtgcaagtaaaaaatgggcgccctgatcgactactgtgcatgccgtacgttgaatcactctacggtcttgatcagaaaattaactaagagctagacataacattgtagttaccactaattcatcaggtccattagtgcttgacttgtagt

SEQ ID NO: 8006 - DNA, 359 bp, Oryza sativa
acacggcgacggcgcgacccctcccctatcccgatcgacttccacagctagctagcggcgctcgtacgtgaaaaccaccgtggtccccaatcaccaacccccgcaccggtgtagcacgcgcgcgccatctccccccatcgcggctgcatgcgcgtcgcgatccgggaggagaggaaaatttctaccgttttttcctgtgggagaagccgtttttggcacgaggccgcatgcagttgtgttggggttatccaaccaaaccgcgggggcggtgtggtggaccacggaagatggcgtgcgtacgtacgtacgtgcggcgcgggcgtacaggcgtacagggcgccgcgcgacgcatggatgga

SEQ ID NO: 8007 - DNA, 1501 bp, Oryza sativa
aaaaatagaaccgtggcagcgagccgattccgttttcgtaggtcccgacaacaacagagacacggtggcagctacgactgtggtacaaaacgtgaccagaactcgaaactctaaacgaactagacgctaagaccagcaacacgacgtgacaatgcaacacaaaattcaacaaagcaaaaactgaaaagaacaatgcaatggcacagtatggctaggtaatgatacgaattttttttgtatggctattttctggttataggaagataaaaactcaccgagcaacaaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaagaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgatgctggatccgttggaaggaggacttcgagagctttccatcaagtactcacgggcccaaaacgaagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcagcctgcggcccaagtctccatcttctccctctctttttccttccctctctctctcttgggctgcccctccctccttcccatcggcccagctccctcctcctccctctctcccccgggccacctctccctcctctcctcctgggccgatcgcccggcccaagccgcgccccccctacccgagccgctcccctcccgcgtacgcacgcgcgttgcacgcgcgctgaccgcgcgcccgcgtggggcacacgcggcggtcgtcgtcttcttcctccagccgcccggcctcctctctctctcccaaaaaaccctagcgccatttcccgaaaaatccaaccattctttccaaattaattggagggaattaatccccattccttcctcttcaattccccctaattttccgcttgaa

SEQ ID NO: 8008 - DNA, 1501 bp, Oryza sativa
accgaaaggacgaggacggggcagcgagggagagggatccttacctccatgcgacgaggcgtgggaacgacaacgacgaacgggcgcggcggatacggacgagaacgacggagacgaacggtgaggggacacttcggcggcgatccttggacgaaggcgagacgcggccggcacaaggcttgacgacgcggagccgaggatgaagacgagcacggcttgacggagggacgaacaccacgatgatgaggacgacgaccgggaccggcgaggaggcgacgagggcagccggcagcagctgcacggagacgaggacggcgtgggacacgacggaggtggcacaacgagatgacgagccagcgaggaggaacgaccgaccagaggagtcgtcgacgagtacgaacggagatgacgacaacgaacaccgacaaggctcgggtggaggggaggcgaggccgagggcgaccttgccgctgcgatgccggaggtggtggtggcgcggccgacggcgcacgggtggaggaagggccgaccggggaaattccggcgaggcggatggagaggccggcgcggcacggcagtgttccggcgaaatcgagggcaggccggggtagagggcgatgtggcgacgtcgagggaggatggcgacgacgacagccgccgcaccggcgaggtggcacaggcggctggaggcggtggagtggtggcgacatcactggtcgtcggcgaggaggtggctccgatgttttccctgcgaaacggaggcgacgccggggaagaggaggcggctgctacaccggggaaggcgactgcacggccgaccggcgtgctgacactgcggcaggggcggttggaggtggccggcgctcggagagagagagggaggaggcggggaggggtggtgcggccacgggaagacgcgggaggaggctaaaacgatagaacggagggaggatgctccattttataggcgcggggagggagccgggcatgggagagggcggaacggcgatgggaaacacggccggtggccatggaaagaggttggaaagtccgcggccgttccgggcgatggacggcgccattcaagcggaaaattagggggaattgaagaggaaggaatggggattaattccctccaattaatttggaaagaatggttggatttttcgggaaatggcgctagggttttttgggagagagagaggaggccgggcggctggaggaagaagacgacgaccgccgcgtgtgccccacgcgggcgcgcggtcagcgcgcgtgcaacgcgcgtgcgtacgcgggaggggagcggctcgggtagggggggcgcggcttgggccgggcgatcggcccaggaggagaggagggagaggtggcccgggggagagagggaggaggagggagctgggccgatgggaaggagggaggggcagcccaagagagagagagggaaggaaaaagagagggagaagatggagacttgggccgcaggctgatgtgacca

SEQ ID NO: 8009 - DNA, 374 bp, Oryza sativa
ttggcaattgccagtcagtccgattggcgcaacgtacctgtggctggtaaccgttttcaccagcccttgcacccttgcaaccgtgcaactgggcaactggagtactattcctactactactcctaggctcctagctccgtggagaaggtgacccaaccccaccggcaccgcgccaatggagggcggcggcgacgacgacggcgggaggagcagggcggaggcgatcatgcgcgagctcgagaggctgcgcgcggagagggaggagctggacggccgcatccgcctgctcgagtcgcagctccgcctcggcgccgctccccttcccccctccgccgccgccgaagtggagcccacgggatcgccctcctcctcct

SEQ ID NO: 8010 - DNA, 1501 bp, Oryza sativa
tggttggtgacataccgtcaatagctaggcgtctgtgatgattttatcaatcttaagattaagatacatgtgtttatgctcataaggataagtgtccgtgtattatgagcgtctgcgtctgtactttttaaagaaaaaaagacgaatatatatcaaacagaggaagtagtaatcgtatttacaaatgtactaggtcagacggtaagcacttaatttagaatctccaagacaatataactctctgtgttgcagatcatgtcattacggatctcaagtggttgtgaagataccaccattcaggaaagctcatttattgtattctaacccattattagcatttgattgtataagttgatcgggcaagctcgcaaggcgcctatggttagttttccaacgggttcattctaatttaagatgaacaaacctactgtatatccaagcttaccaaataataaggttgccagcagatgctaagatgacgtgcaatttgttataaaaccatttagccatgtatagtgtgttacaagaataaatatttaggggtgacatgaactattctgttgatttgttgtcacttaccacattgaagatttttgagcaacttgccaccaagcgacatgatcatctagataaaacaaattgtatgctcattaggactcaaaatattccaatccattagaaactgtggttcttaatccaatgttttaatgtactctttctttaaacatctatttaaccatctaagtattatatatgtcgtaagtagtatttatagctattgagttatcataacatctagttaggagtacataacatggtcatctaaaacttgacgctttgtgaataatggcattactatagccgtgtaggtatcatttataaaaaaaaattccaaaacaacaagaaaatcatgtcacaaaagacattctatatattcacgtattagacaagttgtatagatacaattaatagcccataagacatatcacaactcttactcgtttgtgaatactgatgtcagttggtgtaacccgttaccacatctcaaaactataatggcactataagttcagagacatatcattactatgctactataagaaaaataaatgttgagcccagtacaaaaataattccgcaatgaaacatgagccccaacgccacaaggtttctcataacacattggcagtacccccattttgaacacatgcggcatactactacgatcgattttgaccgccagtgtgtgcgccaatagtgcggattagctgctgacagcccagaagaaggtactgaagaaaagaggggatcagtgggagaatcgcgattagcacccgcgggcgggcgcgcacataattagtacagtagcagtgagcgtcatcaaattcgcccccgtttccctttgtcctccatgtgattcctcccgaccgagcccggccttgtcccttctcctcctcattcattttcctcttcttcttcttcccacctcccctcctcaact

SEQ ID NO: 8011 - DNA, 1501 bp, Oryza sativa
actatataagtatataggataagggcatgtttaggaaattaagagtctgtttagggagcttaagggtctgtttggtacagctccagctccacctctcctggagctagagctcagccaaacaatttcagctccaccaaaactgggagtggagctctctcacaaaatgaactagagttgtggagctgggtttaggcagttccacaactttactccagacccaactcctagagctaaatttaggagttggagctgtaccaaataagctctaagattatgagaagcagctggttgatagccagcttctgggaatctggaaaagctgggtttctcatcttctggtttctagtttattttctgtattctacaactacaacttttggcttgccagaatctggaccaaaagctggactgtctagggagcttctgattctaggagaagctgcagcagttagaagctccctaaacaggccctagatcccctggcaaaatttacatccatgtcacatacacgtttgaacacatgcacggagtattaaatataggctaaaaaaataactaatagcatagattgcgactaatttgcgagacgaatcttttaagcctaattgctacatgatttgacaatgtggtactacagtaaacatgtgctaataacggattaattaggcttaataaattcgtctcgcggtttactgatggattttgtaattagtttttttattagtctacatgtaatacttcaaatgtgtgccgacatacacgatgtaacactgtaaaactttactcccctgcatctaaacacagcctaagttacagtccatactactactgcagcttccagtccacggacccttttcacattcaaaattaaggatccgccccttctcttactcctctgtctaaaaaaaaataatctcaatcctaagtttaaacatacatacatacatacatacatttatgtacatatatatagtatatgtatgtatatatatatacacatatacatatacatacatacatacacatatatatagatatggatactcatactctatgtagcaccaattaatttacctacctatatatatatagaactactatatggtaccttaagtgctacgtagctatatggcactccacagatcatcttttcgaccctcacccgaacgtagtaaatttttaactcgcggctcccaccagcatctccgcaccccaccgtatcctctctcacaggttcaaataggacgccactaacagatgcagcgcgccaggaagcttcgtagagcgactcacggtagtccccgcgtccggtttatctgttcaccttcgctccctcaccggtcatctcggtcaaaatattactcatcgagcgttgtttccgtttctattgctttttttaccctgttcgctctagcacgagagattcatctttctaatctacacgtggcaccatgggctaaattaactcccagcaaaattatgcttcagtaaaattttcact

SEQ ID NO: 8012 - DNA, 1501 bp, Oryza sativa
gcgggctcccacgccggccgccacccacgagacccacaaggcggcggcgcgcggccggcggcagatgcacccgccgcacgggcctgccggaggaccgggcgagcgggggcggagcgggcgacggcgcggggagcggccggctagcggagcaaacgggcggcgggcagccgcgctgcgggagaggaagatggcgccgacggggagagcgaggacgccgctgccgtcgtcgtctttggccacagatctcgcgccaccggtgggagtgtatgagcgtggggcagctatacctggccaaatgggccgtgccaagccgggccggcccgagcacagcagtactgtagccggccaaggcccggcacggcacgccagcctgtgggccgtgccagcatggcccgttatcccgtgccgtgtttgggccgacgcctcagcccgtaggccagcacggcacgacacgtttactttagcgtgccggcatggcacggcccaggcatggcacggcccaccggttcatttatttttcctacgattttctaatttttcccatatatttctcatattttttatttttttccacattttatcctatttgtaccatatattttatgatatatttcctaaattttcctcacatttatcctatatttataatgttttcctttatattatgttttttctgccttttttttcttttttcccctcaaatttcaatttttataggccacatgtactagtgggccggctaccagcccacggtccgctacagtagccgtgccggcccggcacgacccagcacctccttgggccgtgcttgggccgaggccttggcacgtgggccagcacggcacggcccgctacaggagccgtgcctaacgggccgtgccctagtgggccgtgccgtcagtgtgccatgccgtgctgggccggaccgcccgtttggcctgctataggggcagcggcgggcggagcgggcacgacgccaaagacaacttcttcccgcggcggcgccgccccagcttcttcccgcactcgcccgccgccgacaccacttcgtcgccgatgagaacggcgtgacgaacgccagggagctgaagaggtatcagtgactcgcactccttcagctgtgctgcctcgtcgacgacaaggagatcgaacgggcttgcttctggcaggtagtgcagacgggatgagctcgaagcttgtgcagactgcagagtatgcttttggtgttccggactaggaaatcttctaccgaacgcttgtcgaaaatgttcggaagttcaaagtgatcagataggtgttttagcttctgaagacactgagctctagcatccttcatctctgtactcacactatcttgcacatatgtcacgaaattctgatgccttgatgccttccagtgcagagcagaaatcagcacgagttttgtcgaaacatgatttcggcaataataaaagggggtagcgcacgagacctaaaagtggatggatgcggagacaaaaga

SEQ ID NO: 8013 - DNA, 489 bp, Oryza sativa
aattgaatttcgatcagctcgatgcttcaaatgaactccatgaactgtatcgtgtgaagtactacaaggttagtttcatccatgctctatctatatattaattaattaatcatcatatataagccatgcattctagtatattctgtacattttatatatgttgcatatacttttattcgtatatataggtgttgttatatatgattaacctcctgtttgaatttgcaatattcaatataatctcgtaagtgatcttagggcctgtttggtacagctccaactcctaaatataactccaggagttgagtctggagtggagttgtggagctgcctaaacccagctccacaactctagtacattttgtgagagagctccacccaactccactcccagttttggtggagctgaaactgtttggctgagctccagctccaggaggggtggagctggagctggagctgtgccaaacaggcccttactgttgcagt

SEQ ID NO: 8014 - DNA, 1501 bp, Oryza sativa
atgagtcctatttatagtactcatagcttacttagaaaatgattagagacacataaaaagtagaatttgccgcacatatacctctgatgaactcaatgtagcagctctgagtcctctttgttcatattcgaggaaggaatcaacaagtactgcaatgttaaacaacccgacagatcaaatgccaaagtaagaatgcacggattcttaatacaggcaatatctgataaaagcctaaaatgcgagtcatgttatgtacactctgtcatcaatttaaataataaaactatccttctcataggtatatgttctcgattattacgtaatttgactatacattaacagattaatcttgcagtggtgagcatatgttacatacatgtaaggaccttgttttgttatgttcaagactcacgttgcttctgatatcggtcaatacttggagtatgtagcaacatgaggaatttatacaaaagatttattacttaatactcactatttgtaatacaatttcatattgcatgaaaattggtgtagataaatcaagaagtacaaaacgcatggtttccaattctttacaagcataagaaaattaataagcaaaccaataaatatgttgcacatccccactgttaatgaaaccatatttctgaaaaaaaaaagacagtttaagctatgcaatgcctcatgcgtgtagaaatcagaggctgagttaaatcaacatgtaatctacaaaattgttctcatggtcgtttttacatactggaaactggatccatccctcccctcaacagcatttaatcgaacacctaccagcctaccgggcacaatacaatacatgcgtagagaagtcatgatcattggttgatcatccaagaagtcacaatcaataagaaacaacgatagcagaccatattcctagggcattatgacttcccttactccacatcaaagattccatttttttcataaacctgggcttcaactgaagatttgatatttagctgttaccgaatgaccaaacatgtaaccccaaaaaacctagttgctccagatagttcatatttatcttttcaattgtttttacagctcacattattgttgtttggtactacctctatttcaggttataaaactttctagcattgctcatattcatatagatgttaataaatctaggtgcatatatatatctagattcattaacatatatataaatacagacaatgttagaaagtcttataatgtgaaatagaggaagtactttggtttccaagtcccaagtgcaaaggtccccagattcataaaataaatatttgtttgtagtggcagcttcctaggagggctaggaatacaaaattgccagcttcgatttcctattttttgtgattaacagtgaacacaattcattcctcatgtgttgctatcacaagttcacaaaatttgttgcactgaaaatgcaaatcatgttgtgttaagaatatgctcaatgttgctctacaga

SEQ ID NO: 8015 - DNA, 226 bp, Oryza sativa
cctaccctgtatatttcgtccaaaacgctacctattgagcgcctgatggataagaaaatattgagcatttgttccacatatcccgtgaccccctctctctcgtctctctcccacgcaagtcctcaacggcggactgagagacactactcatctcctttgtgtcgtcgagcaacgcccctgttggattggggggtgggggagggggcgtcctagcttcccgtgcagc

SEQ ID NO: 8016 - DNA, 1501 bp, Oryza sativa
  unsure (1)..(1501): unsure at all n locations
tcatcagcatggcacacgtataagtcggctccgacttctccttctaaaatatttaattaagcaagggtgagtaccaaccgttctcagctagccaccactacagaatgtatatagtgctcacagggattcaaggatggcttggttcgttaatctgcgagggttcatccaccttccccaagcctcgcttggtccggtttaccctcacaactagttttcccacattttccatcactacgaccttctcactcattggacaaggtcacacctcttttcctaatctaagcaagattaaaatctatgagcctagtcaagagtagtaaaagtcccgacgctcattaaccgcaagcacggctatttgaatagatttgttttactcacactgcagttaatgtatgcttttaatcctgcactccacgacttgcccaacacataagcctagtcccaacacatgagacttatcacgtcccgttttttcagtcatcctcgcattgcagcacccgctccaacgactatagatccccattgcactcccgtcacaacacaacacctcgagctagcagtgaagggagtcctggcgctcccgagataataaaagggggtatacaatatatataacaatatatacttaggtgcattttaggtttttgcctcggcattcaaacgatcgatccaatcgatccacacttccatcacaatcgtcaccactgcagaaccaccacgactggggtgccaccccacaactatttcttagttcgctgggtctatacccattgaagaaatgcggttgtactcgtttcgtttcctgtatagcttcttgactcagtccttaattgaccagggttggcgacttgccgtttacagaaccacccatattctattcatgctgcccagtcgaaatcattttgttttattaagtttttggttttcgcaaaggttttgtgttacgggtggcgctcatgtctccacccgtcttccgacatacactcacatcgagtgatcacctccatcacatcgatataattgttaggaaaccgccggcccatgaaggcccggcccggttaccccctaattgggcccatcactaatatgtaaagtggcaaggcattgccctataaatagagggttggaggagaggttttgtacacttgagaatgcaatgggtgaatgagaaatgatgccacaccctcatatcttgtgtctccacttttataaacattatgtaacccctttgaactacggatgtagcactgggttgcataatacgttatcagcacgataccaagaagaagaagggtaataacacgtagatccgttttgcatctcgccgtctaatcgcgaaaacgaattactctcctcgttctcgttccgtttttgcttttctctggaganatctgctaacgccgacttggagtcgccggcgaaagccgattagggatttccccaaaaacactagctggctgagcgcgtccctccacgtcatgccgcacacggataccccgac

SEQ ID NO: 8017 - DNA, 718 bp, Oryza sativa
gcgacagttaaatggtgattaaatcaggccaagccgaattgaaggagaaaatcataggaaaaatgatgagcgatgagtggggaatcgatttttgtaatccattggaggaggaaacacatggatagacaaattcgacgtggtgatagaggtagggttcggcctagcgaaggaaaaacacggtgaggaaagaaaaaccgaaaactagaagcccttactgcatgcgagaaaaaaaaggggaggaagaaaatggcaaaaaaaaactggacggaccattaaaaaactgtttgaaaaaaaatgtgagaggaaagcggcgactaaaaaaaatattctagtaggtatatatacattaaatcgactctaacagataacggaccacggaaacatcttcaatctttatctacttatattatatatgatatatgatatctgttaccttctaatgcagattttttttttcaaaaaagcacaatacaaacgcagacaataagaggaaggctactttttaactccacagcgaatagtttaattcagcctacagttaactctcacaacaaagaaacacagttgcatcaccactttgcacgctcgctgcttcctgggctgccgaataagcgatcgagccattttggacctatcttgggccaaattagagcaagtacagtagcaggctataaaccagctgtaaatatattttaagaagataaataaagagagagaa

SEQ ID NO: 8018 - DNA, 353 bp, Oryza sativa
ccttgcgtcattgcagcgtaaagaaaggaagggcaggaacctctcaattaattaagagatcgacatcccttttagggttttaccatatatatacctcttgtaaaccgccgtgcggcgttgcaacttcaccccagatatagtgaagatattttgctggctggcgtccgtggtttttttctcttctactttgaaagggttttctacgttaaatctcgtgtcttctatgattgatctattgttttttatcgtttgttcgcttatagtttcctaacagagtttggtatatgccgcttccttgccacttgagaaaccaagcccctttccccggctcgtcttgtcgtgcctgttccagt

SEQ ID NO: 8019 - DNA, 353 bp, Oryza sativa
tgcgcacgtggcagtttcaacgtagccacgcccccttcacatctcatacctaagaatcctgcaatttcttttagcatatttccattttgttggtccttactgaacggcttccttttccccctgagatttctatagaaaataatgcgaatgtgaggtagcttacataaagtcgaaaacaatatcttttctacctacacttcaagaaaaagtagggggggaaaaacacagtaaattccgtagtaatagcaaataaatgggccttacatagacggcccagcccatttcaacagtaagatctccaccgagtcaataaaacgcagcgcctcctctcctctactccgctccgccgtcgc

SEQ ID NO: 8020 - DNA, 1501 bp, Oryza sativa
ggttaaccctgtttaaatctgatgaaaatagatattaagtgatgccacacaaacgagaaaaccattagcacagggttagttaagttttattttttttaacttaaaaatatgttcatttgatattttaaagcaatttatatgtagaaagtttttacacggaatacaacgttagcatttcgaaagtcatgctaacgaaaaccaagttaaaatccatatcttaatcaagttagaatatttaaactacatatgcaaagtctgtatcttagtgcatcagcacgtaccaactggactagcctcgcatttataatttttattttttaaaaaatcaacgtactttataatttgtgctatttaatccctgcattttccatacatgaaataccatacaaaaatataattaccgctatctccgactatagtcgtttgagaagggtcctaaccatttgctcccatgtataatttagccgctataacttcatttaacccgctatagttgtttgggaaggtcaactactaaatatcttatctcgttatttaaaacaccgattataagtaggagtgacaatgatacacctagggcctgttcattttgatgctattttaaaccttatcaaattttggtaaagttgccaaaaaagttgctacatttattttgtagctaatttttgacaactatataagaaatcatactaaaattttgacatagtgtagatgtcgggcatgaaagtgaacaggcccctagcgtagatgtcgggtgggatggtttcaggaaaagaaacatgatgagtagagctacgctcatttggcatatgcaaattattctttcgtgccgtccttttacaattttatacgtgtcttattacctgtaaccttttgtcagagaagagaacacgattgtttacagtcacaaatgcattgtgaagcttttgcaagtcttcagaaatttaatttggttgacttacatagttaaataggagtacctaacatggccagcttaattcatctcacaaataattttggctcaaagccttttacgccttcaaactacagaaacgtattttactaacctcatggcacccaactatgggcccacttgtcatagatagaacccatccgaaatttctagaccgcgcgcagacccgccacccaaaaacccggggcccacctgccatccacccaacacgagcccactccccgctcgaattcccgcacccccgccacatcctcacaaaagaaacacacctcccgctcaccaccacgccacgtcaccgatccgcgcaacccccacctcccccactccccgccgtccatctcccatccaacggcggaaaaccagcagcacgcggatcgtgccccccatcgcttcccctaaacccacgcctctataaagccccgcccccacacgcctcctcctccccacctcatcaccaccgccgccaaccactcctcaccaagtcaaagtttcttcctcgcgaccggcggcgagcggcggcggcggcga

SEQ ID NO: 8021 - DNA, 599 bp, Oryza sativa
aaatgacttataatatgtaacgggagcagggtttaatctgttggtttgaccgatcgtatcggggttgggcgatataccgaaatttcggtccaaaattttgagcaaaaatttaaacaaatactaccgaaattcatgaaaaattaaaagaattaaaagtttcgactgaaataatatcatatctgaggatccgaaatgactgaattttagaaatttcagtccgaaactttcaaccctgaacgggagtatatatctgaccagaaaatgaagtggttaccaagttttctacgttagcaagaacactgtgtgaactgtcaattcttcaagccggacgaagccaaaaatcctataaatgagatcagatctgcagttctgcatcgccgtgcgaggaatgatttggcagtcatctgtaatttgcagacagaaatggagctttccatcgatcaaaatttaatctgacggtgcgtttggtttccttgcacacggcacccatttgcctataaattgcgtgctcccctcctcgtgttgctcataacgcagatcagccaagaacgagttcatcttcttcttcgtgttgttgtagcatttgattcgagatatgg

SEQ ID NO: 8022 - DNA, 1501 bp, Oryza sativa
tcggctccggcgaggatgcggcgaagtggcggcagcggggaggagctccggcgaggacgcggggaggaggaggagcgagcgaggagaagaagcgcggtcttcgcggccgcgggtggaggaggaacgatgtcttcgcgcgtggaatcctcggcggtgaaatcgtgcggtggagaaaacttgcgcgcggatggacggttcagatcaatttggatgatttgacctgtagcattggaggaggacaacttctttttatattagtatagatacatctaaagagaaataattatagggttaaaaatgaaaatgggccattggtgtgacagatcggcaggttcgtaagtggtcttgggatctagtaacttccttgcaaccccggctgagatttattctctttttttatagccaatcctatgaccaatatttatggtatgacgtggctctttcttttttcatcatgagaaagtattttcactagttaagatatgatacaacgcaactaccagtaggataaatggataatggaatagagctatttgcttggctgctagcataaccactctctctgatagcccactaagattttattaattactgattccgaagaaattgttgttgaaacccaccagccgaattttagaatttaattttcaaaggcttctccgtcaacttcgttgccctagcttgcccatgttttatttccaataattgctaagaataatcaaaattagcttcaaattttatgccaagcacacagatactgcatcccctctgtagtcaaatactggtttctgaccctgtgtgttattaatatcgtaaagtagcagcggcgaagtatttttggtcttttttttagctgtctttattgaagctttcaggataaggacgcaagttggtttgatttgaagcaatccacggcaaatttgtcgaagttttggaccaaaacagccagttagatggaaaaaatgagaggacacatcaaggtctcaaatacatacttgccaggcgaacaccgtttgctaggcggttttgtcggttatcacaattaccgccacgaaagccggtaaaacttgataaatttgccgaaatgttgattttttttacttctcgagtttctaaccggtttcacaacgcgaatcggcttgagatgaccaataaccgccacagcatgttgaatagataatccttatgttgtcaaagctaagctgatgcgtcaatgctgaatgtcgtcaaaaatactcttcggtgaccaatagccaataatcggctttagaatttttaaccgtattcgaataaataattgtgttgtcaaagctgtaccttgaagactgaaaagagtcaaacactgagtattttcaattaattgaagcaatgagtataaatagcgtgaatgcacaccgattagttttacgtgcttgtatattttgatttccccgtcaatttctaaagcaagcagatgtcttgagaagatttctgagcaacattggctcacaaatagcaagaa

SEQ ID NO: 8023 - DNA, 1308 bp, Oryza sativa
caaaagtgataaaggaagtgtatacatcactatccacacattcaaccctcgaagcctgaaactttagctccaatcccgaatacttcttgaaaaataatagaaccaaggatctcattgatgtatgaggcaatatgagtcgcaattagtggtatcgacgcgttggcacctagttacacgataagccctcaaagcaagttcttgaaatagtgtgcaaggtgacatgagtctcttcggctcttgaatcatgcagaacattcatatgtttgtctattaaccatttcacacagccaaatatcaccatcaatatcattcatgctatcccctcaaagtaggatgtagcaattttcactcacatccattttcctcttgattcctcttctcttagggcgacactaatttccatttccatcgaataatgacaaaataaaatgaaacagataacattatttccaaacaaaattctttttctcttttttttctcctccctctctttggcactctctatataagctttcatgctggttatgacatgtctcctatttctatttgattgcatgcatccttaaggctcttctccactatctcatctagttgtttagcggtatttgctctccgtcatgctaatgtttcagctttaagactcttagaaaaagttgtatttgcattattttctgcttgcaagacttgctcagtattcacttgttgcttaatgttagcaaatagcaaccctcttccttgcttccgtagcttagcatatgtgtttgaagttcttacccctcgatcaatcaaagagccatatttgctacagctagcactattactcacacatgaatactagcagctaggtcatgtgtgtatgctccgtaatatatattatctatgtcttataggagtaagtaataattattatttttttaatgatattacatttatatgagtaaataatacttacatgcatatgcattaaacagtgaatcacaactcacttgaataatatatatagtgcactacgatcactggattaataacaagtgttgatatctaatttacccataaaaatatttatatgacttatatcattcaatattattaatccttatagcattatagattaagtttagcaaaaatatctttcgtattaaatactatatatacacttgtttaatatctttcgtattaaaagtatttatatgacttatattgtttaatgcataaattaggtatcaacacttgttattaacccagtttctagtcctttttgaaattgagtttttacatttctttagagaggtatttaagggtattgtt

SEQ ID NO: 8024 - DNA, 1501 bp, Oryza sativa
tcacatcagatgtttcaccggacgccgaagggggtttttggacacgaataaaaaaactaatttcataactagctggaaaccgcgagatgaatcctttgaacctagttgttgttagcatatgtgggttattgtagcacttatggctaatcatggactaattaggcttaaaagattcgtctcgcgatttacatgcaaactgtgcacgtgtgggttactgtagcacttatgactattcatggactaattaggctaaaaaaattcgtctcgcaatttacatgcatgtgttcaaaatgtgatgtttttgagaatttttttttaaaaactaagggggtgtttggaataaaaaatttagtccctctctccaaaaaataagggggtgtttgggaactagggactaaatttattccctctcacaaaagcataagtcattatggtagggacttatgtttttgtaagagggattaaagtttagccccactttagtccctccaaccaaacaccacctaagtctctaccctaagactaaagtttagtccctctctcccaaacacctcctaaaccaggcctaagagcaggtacagtagtaggctataagccagctgtaaacatattttaagaaaataaatgaggagagagaagagcaacgggctacaaatttatagccagctgtagcacggactccaagacaccgtgtgtgtatgacaggtgggaccatgtattaatagtgtagtatgtaactattgtatgaatgagctattagattgactatagatgaattgaagctagtagttggctacgctattaaacttgctctaatcctcatcatagtaaaaagtttgggataaacagagagtagcgcccccaccaatgacacgtgggccccgcggagaacacccaccaacatccgtgaaacttccgagaaataccaaaaatacccctccaagaagcacagggggaaagcacaccgcccgaactccgcctccgccccgcggccggacaaaaaatccggaaccccacccgtagaggcaatgacatgtgggccccacgtgaacccagaccgcctctctcaggacacagcaaccgcgggctagcgtacgcgccgcgtacaagagggaggcggtagccgcgtcgcgcgccgcgcggccaatgggaggcgagctcccggatcggtgacgtggcgagaaaatgttttcagatcccgcgcaaactcgcccaccgcccccgcctttaaaggcggcgcccttctccttcccctttcctctccaaatccaatccacccgcatcgcatcccacccacgaacgcttcgccgcttgataaaccaaattccccaccgccgcttcgttctcgccgatccggaggtaaatccatggctggctgcctcgaaatgctgctcgaatctccgcgtgttgggttgtttgtgttggttcgggagtgtgtgttgggttttgggttgttgtgttggttctgatcggttttgttcttactcggtagggctcgaga

SEQ ID NO: 8025 - DNA, 1501 bp, Oryza sativa
acaaaggatggcataatagggtttcttttgcaaaagcagcatttagcaaacatttgagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgttatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacaattgaccatcgtgagctatcattaaataatagtgaatcataagttatcccaaaagtgtgctaatgtttctaagcatggctaagcaattatatctaatatctagttgaaccaatataaataaagctcaactagtcaaattataataacccaaggtatcaaggaataaagtaatcaagaacaaaagggctatagcaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcggttcacgcgaacggacggccgagatcgacttgatccaaaacggacggccgagatcgatcggtccacgaccggctcatggaagagggcgacga

SEQ ID NO: 8026 - DNA, 1501 bp, Oryza sativa
tcccttggattcgtttggaaacccctccccaaatcccgccggcgccattgatggagcccgagaacgccacgccggtttccttccttctccggccgccctctctcgccccggccctatttaaactctccccgcgcctcccccgcccgtttccgccccttgccgcaccgtctctccgccggaatcgagctcgcgccgtcgccctctctctcctccgtcgccgacgaccaccggccggccttctcgctcgccgggaccgtctcccgccccggcgtcgcctcctccggcttcgccgcaccgccatcgaccccgtccaccccctcgccgggtccgccgaccgccggaacgccgtcgaccccgtcgacccgagccgcgccgccgccttcctccgctctggctgcctttttcgtcgttgccgtcgacctagggtgagccgtggaccgccgcctcttttcccccttcccttcccctctctcggccgccgctccgccgtgcctatggccgtcgccggcgaccataggggcgcgggcgccgcctcccgccggccgcgccgagtggccgccgtcgggcgcgccgagtggctgccgcgtggggtccagccgtcagccgcccgcgccctcgggtgtggctgacacgtggggcccacggcgccggccggtgcgagcccgggtgcgcccggtccaccgtggaccatgaggctgccgcgtgggccctactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttctgttggtcgtgtagacgctgcagcttcggaagatccgctcttggtggaggttgaagccgacgtttgggaaagcgagcaaggcaagttacatcatccttgaacatattgaaacccagtttataaaattattttcatttaaattattgcattatcgctttacttaaattcccgcgttatcactgttttatctagccatgcctatgtacctttgttatgaccttattattattgttattgatattattaccttgttcaccctagattaaacagaaccccaactagtggacactctactcatggtaccactagtatgattttaggtaaatgcttcgctggttaattaggcaacattaggtggttttacaactctagactttgggaatattctcatcacctggacattacggaatggatggattattttggaattggattcacacctccccctctattcaaaaccctcaaaatggtttttggctgggctcggggtgcatggttttgatagtagcacctcggccatataaggaccggt

SEQ ID NO: 8027 - DNA, 1501 bp, Oryza sativa
cgcgcagccgcgtttggatgtccggccgccgcactaggttcgccgtcggagagcttccgccgccgccgcccgccgccttctggaaggtggagaagacgcgggcgcgggggaggaagcggagggaactcctgctgcacggcgcgcatggcgccgacgagctcgccgtccacgccgtcgccgaaccacgtggccaagttgagcgcgaacagtgcggcgtacaggcagcacgacgagcagagcggcgccaagaaggcggcgtgggtggtgtcgcccaacggccaagtgaagcgagaaaaggcggtggaagcggcgcgcggcgagggagctgcagccggagccggagaagaagaagaaaagcggatcgacttggccgtgctccgttgccctatctgcctccttcctagctgttcatccaatccatctgacattcttcttcttgttgttgttctttcattcgattcgtgagggctcggctagtggcaatttcttggcgtgcagtccgcggcggggcacttggcgtgcagcagctgccatggcgacgtcccggcaagcagtgccacgcgtgcggcggcgccgccaagatcctgtgccccaacgacctgttcggctgctggagctacgtcgcctattacgacgtcgccggccaccagcgcgcctgcccgcacgcgccctgctcctgctcggagtcgcgctgcgacttcctcggctcgccgccgatgctcctcgcccacctcgtcgccgacatgtggttggtgtcgatttggaatggggtgaaatggactggaaaagtgaactgaatccatatagatgaaatgggttgggttgatttgggttgaaatatgatatgggttggattggtttggattctaagagaagacaaatgaattagagtggtttggacttgtgtagcttactgctttggtttgggctggttgtggattggatttcaaaccattggcaggcttccacgcatgcatgtctctcttgtttggtttccctccatgtactttgatcgcaggagtactaatttgtggttgataataactttgatagtgtgtccgctcttgccgcgttgaaaccaaagagttagagaaatcctatatatttatataaagttcatttctacagtggttattaatgctatttatatcttttcttattaagccacatcatctaaattgtttctttatccctatgtagttgagataggtatattgttcaaattatctctcacgttttcttttgttattaagccgtatcacctttgttttatatttaagatgatgtacttagccacatcactattgttgtgattttaaatggccaatctagtttaaattattataaataacatcctaattgtatatagttttttttctgcagtcgataaagatgaaattatataatgttatgcctactgattatatgttatttctattattactgtataaaacttacgcagcaacccgtgagtttcatgaagtctgatttcactattgcg

SEQ ID NO: 8028 - DNA, 698 bp, Oryza sativa
acagcattaaactttggatgatcatatcttggtcatacgagctctgaatcgacccgttcaagtctcctaatgtttgttataacctaaagaaccgtatgctttctttttatgtattgttattgtttctttataggcttgtagctttgcttgtgtgcttcgcgtagcttctgtcgttccggaggttccagaagcgtggttcgcggtcgtcgccaaaggttcggaaggccgttctctctgagcaaggcaagtcacatcatccttgagcatattgaatcccagtttataaaattattttgatttaaattaatgcattatcgctttatataaattcccgcgttatcactgttttatttagccatgcctatttacctttgttaagacattattattgctattgttattattaccttgttcaccctagaataaacaaaaccccaactagtggacactctattcatggttccactagtatgaatttaggtagatgcttcgctgtttaattaggcaacattaggtggttttataactttagactttgggaaatctcatatcatttggacattatggaattgttggattatggtggaattggacatacccctctcttcctctttcaaaacccctaaaacctgttttccggtggggtttgggtgcatgccagttgtgggaagtagcaccccggccaatataaggattaa

SEQ ID NO: 8029 - DNA, 1501 bp, Oryza sativa
gtctgatctcttcaatccaaggctataaataggaccccccagttccctgtcacgaccggaaataacccaacgggcgttcctgacgtgcgtgcattaatccttgtcccaggaggcaaggtacaccaaaagttgatacaattcagagtttaacaagcggaagcgtaaatagataacttattacatgggcagcgaaggcccagcacacacagagacaaacgagaaacagcggaagactagggcgacgaccacaggcgcttgacggcaggcacgagctagacaccaaagccttcatctttaaggagctcctcttctgggcttgggaaaaaattgagcaagactgagtacaaccaccgtactcaacaagacacacccacaaatgcagaataaatgcaagggagtacaaaggaattatactataaaggggttagggttgcagaaaacagcatttaaagacatttagttgctcaaagctattttgtaaacgcgatcctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagctgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgaacccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcggg

SEQ ID NO: 8030 - DNA, 1501 bp, Oryza sativa
gaatcgaaaccggaaaatcttcgggttagtttgcagagataaaatcaaaacgagtttgattcggacaagatacacaaccatttgctccgattcttgaggggaaagatagaggaagatgtggggataaaaacccccctaacaatcggactcgattgcgacagagggcggcggtatcgatggtgcaaacggcggctcggacggctcggcctggcaatcggccggctggaggaggaagatgggtccgacatgtgggccccacatgtcggtgacccgaggaggaggggcgggcggcgtcggctgggccggcttgggccggttcggccgcgcggaagagagaggaatgttgggccgaattcggcccaacggcttagggaggggtttttgaacttttttgaataaaaataatttgtgaattgttgtttcaattattaaaaatacttcccttgctcaaacaattcccagaaaaatctagaaaatagaggaacaagtaaagtatttaataaaattttatctagctcatttttatgttgaaaattttcctagataattagggtttaacttgtaggcttttaaaataatttctaaaaatgatttaaacaatgtatttttacattagacgatttttagggcgtgaacaagctcaaggctagatatgtgccatcctctaatagctaatcattcactcgaacctatgatagattatataatttgtgatagactccttgtcacgcccggaatttctatccaaaattccaaacgcttacatgtgtattaaaccctcgtccaggaatcaaccgaggcacacaatgacaatttgataatagagtacaaataaataactatttaatactcgcaaaaataaaagattacagaggtagatagttcctctcaaagaataacattctacgcagcggaaaaataaaacgataacaaactacggaacagctatggcgactccactccacaggcatcttaaccaagaacaagctcaatcctccagatcatcaccttcactgaaaaactcctcttctgatgaatgaatattgcaagaatgagcatatgacatactcaacaagccacacagcaaatatgcaagtgcacaggataacaaaggatggcataatatagctcatttgcagaaacagcatttaataaatatttaagagaatagtaaaaacagttgaatatttaatcaatattaaataaacaccatacaacacacccatgttgcacaggcccaaccacatttgaacaaccaaccccagttgaacaaattaaacctccaaaccaggaattatccattccaaaccaggagtcaaattaattatcacattattaacattgatgagtagtgtgagactaatcacgaaaaacattgctcaactcacccataaccgcgggtacggctattcgaatagtttaagctctgatcagaggtgtaccactgtacccacaagacacaaccccacatgatgtcaccatgtgcctcaataccaccacg

SEQ ID NO: 8031 - DNA, 1501 bp, Oryza sativa
tagacatttttggagtgtccgaaatatccgagaatgttgtgctctagagagtgacaaattgacaatccctttgcactgtttctttctcttttttttcttttgcaattatatgacagacagacgcatacgcaatgactgtatcctttaacatatgctcatagagatgtaaaccatcggcacatttctgatccaattgaattcctttaaggtccatttgcacgtgcgtaatattcataagcatcaggatttgaaccccgataagtttagtcatacacatccataactccaccaccacactactggtgctcccctcccccaggtccactaaatctttcctattcttgctatatatgcttgattcactgttgttattttgatttgtcacggaatttatcacctttgttcttgataatttgtctttctttctttcctttttgtattcaagctataatgggatgcagaaatttaaaacaaccacgcatgatatttacggtaaaaaaatataatgtttgctgtgaaccgtattactgcatatctcacaacatgcatgttactgtactgctacaaattaaaatagccataattgttccaaacacaggcccagagctttgcaaatgaaaacaaaagccccaaaacaacacacatatatatgtggagcccagaaccagacgaccacgtacgcagtaagcaacaagcaagcgaacagcactacagctaaccttcattaacttgatctgcatcaatggctcatggtggctcttctagtacagaccgatggcgacgccaagtcatcaagatctcacgaccagcacacaggaacgtcaacttgctgtcgatctgcaggatcaatgaaactcctacttaatttgctaacttaggacagccatttcagtagtgtaatgcagttaatactcccccaataacaaaatataagcatttctacacggtctatttatagagcttctgacagctacaatttctcttataattaaatgtctctaggttatttagcaaacactaggggttgagaaatggaaaaaaatttccatttcaatcacttgagtgatccaaatttgaatgtttaaatttcttagatttccctaccaagcacctaattggcgaaaaatgtattgatttccgtgcattagaatcaatgcctctgaagtatttatagtgccatacaaatttgaaatctaaaaatattatattttgaaatggagggacgtattttgtgtaagcatcagtcaacatatgtataggtggattgatatttcagtccgaagaattggatgtaatttgacagattctgtagtgaaatacatatataactgaaaactaaagcaactctgttttttatttagaaaaatggactaaaatccgatctccacgtctaaactggtttattatcacccgtcacggataactattagtatcgactgatagggacatgacacaggtgagtttttcacataagcgatcattctcctatgatcaaataccc

SEQ ID NO: 8032 - DNA, 1501 bp, Oryza sativa
ctattgtttttttaataaaaaaaattgctgactggactgccacgtagaccaaaaccgcttgcaaagttgctcgggggagtttttcatctggtatcgatagttgagggtgaaaaatgtctggtttttgggttttagggggtaattcatactcacccaatacttcaggggggtaatttgtactttttccaagaagctgaagcttaaaaaactatgacggctaaacacaaactccaagcagcggaaaggggccgagccatgttgtactcccaacaagtccccaaaagtggcaatgccagctaaagaccacaaatggccctctgagtggatggactccagaaccactgagaccgaagagagcgcagagtcgaaaaccctagagttccgttccttccacagctgccaagagactaggaacaccagggagtcgaagccggccagcgcggagatgctcaggtaagcaggccctggaggatggccaccagtcctagaactagctgccacggggggagagagggcagcccagctaggcggcgacagcacatggagtcagacctgatgagcaaacacacagtcgaggaggatgtggtaccgcatgttcctttagctcctcctcctcccggttattggctgctctagttcattcccttgccttcttttggcagaggctttcgaaccctcgcgagccaattgaagccaataaactatagccgagccaagcttctgccctagcttgttttggtaatcgagccaatctttgacaccagggagcttttacaagttttcaagccctagcatatggtgtacttactaggttgtttgatatgttgcatgaatcaatggtaatatcaaaatttcgtaaggtaaaagatatcgatgatacgatttggttctaagtcctagtaaattttggtggagttaattagagtgtgaatttctaaagttaccaaaatttgatggagtaactatagcaaaaacatgtttggtctattacttaccaagattccatatgttagaatttgtaatttattcgaacaaagggacccctgttgtaacataaaccaatagtagttctcaagtgtaaacaaagaagaaaaatgtccgtattgattctcaaagcccttataatgtccccatagaggtctattgatagccataagattaggttttacatatgcttttatatgtttactctttgatggggacagttataagaatgtcatagtactctcatgtctcattggttttattggacttatgttaagtcttaacaggccttggtctactctatatagggccttgctctgaagatcgcctggtaggccggctacaagatggtctcggccattttaatgggcttagccatcaccatcttcatgggtattcgccaaatgggtgctcatggctctggcttcgtcctttccaccagcctttgtaccgaacgaaggggagtgaggccgccagcctgcctcgaacaaaccctagataacacgtgacaaaaagc

SEQ ID NO: 8033 - DNA, 617 bp, Oryza sativa
ccgccgccaccgcccatgcttttgcacggagtagagggtggagaggggggtttggagtcagctataacttaaaagagtgaattttatggtccatatagaaaaatgaaagctcggtgttgtgaaaaaatcattttaatattattcttctccaaataaatttataattgacttataattatgattatccttgctctgtgggagaacctatggactcggtctctaccctctctgtttatattatataagtcgctttgaatttttttaagtcagacttatttatgtttaactatatttatagaattttttaaatatatactgatctgcgataacaaattagtttcattaatattgaacatattttgatgatattttgtttgaaatgttacaataattttctataaacttgattaaacttaaaatagaaaaacaaataacttataatatgaaatggagacggagggagcaccacaaaattaacagctagtagctagcaaaatacaactcggtcgacagcttcggactcggtaattcatacgtatatataatcaatgtatacgatcgagccagctatagagatcccaagcacgtacgtacgcacagatcttagacgtacgcga

SEQ ID NO: 8034 - DNA, 1501 bp, Oryza sativa
ggcttaccgacggcggcggcggcgacggcgccgcaaggcgtggtgtcgcccggcgcggcacacggcgcggtgcggcggtaccgagggcgtcgacgcggcggcacaaaggcggcggcgcagtggagagggtagagaggaggaggagggaatggagtggggagaataggggaggtggggtttttatagggagagagggaagagggggccggttaatggcgacgcgacagcggcgcacagagctcggaacgactgcgacgcgcggcgacgcgaccgcgcggggcgcaaggcggcgaggggacgggcgcggcgacgggacgggcgacgcgacgacggaacagggctcgaggcgacggcggcacgcgcggcgcggcagcgggatggtgacggcgacggcgcagcagcggcggctcggcgacgcgacggcggacggcgcggtgtggggcgcaaggcgcgagcgcgtggcacgaggcggcgacgggacgatggcgacggcgacggcgtgcggcaacgcgcgacaggcaagaggcgcggcgcggggcgcgaggcggccagccgcgcgcggcagaggagggggcaaggctagggaatcccatcgagcacctagagtgcaatgaatagtgtattttcctatttatccctattttagcctatttcctatataaattttattctataaatcctaatttttgcataaatgaagtgtactcaatatttgtgttattctaaccaatagatacaccctagattaatattacccatattataattttatataatttatttgaatctttaattagggctaactcttattccaacgcacttaaatttaaatttaattgatactaatatggtcgcgataatatttttatttatttctatcctcacctaatctttattttaaattgtattccaactatttatttagccaaattaattttagggtttattcctaattagttactctttattcgcgattaatgaactccgaaatcaaaatccaatgaaataggcaataaaatcggcatgatgcaatttatttaaaaagtttttgaaaatccgtatttttagagttttgattttgttggtcgaattttcagggtgttacacccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacatgtttccgtgcgctgacatgccaccacgacataccggaaagaggccgtgaaaggacccttcgcataaccccctctaaccaagcacaccacacctcaggtttaacccccactcctcgcaaggcagcgggcagtcccctctcgtgcctaggtgaatccggaagccgcataggccatcgcagggcccatccaaactccatcacgcccacccttgcctagatgcgtaagctaga

SEQ ID NO: 8035 - DNA, 510 bp, Oryza sativa
gaagttgctttgcttgctctcgtggacggcaagttggcaacggccgcgtgactgatcggatgaaaggaaagagaccagcctgaccaattaggtgggctttcattctcgctgagtgacccagaaaatggaaaaagtacactgaaggtccctcaactattaaaactacaataggtcttttggtagttttgaccctggttttgtcctagatggtagctgagtcagcgtgggacccacgtgggccccacatgtcaagctgccacatcagcctcctctctccctctcttttccactcttgtctctctcctcatctctctctcccttctctgactcagccggcgggaggaggagggcgttggcggccggcgaggggcgacgcggcagcggtggggggagaagctgcgggtgggcggcggggaggggcggcgaggagcagagcgcgtgcggcggggggaggagcggcgcgcggactcccccgtcggccgccgcccacgaggctcacgtcgtagaagt

SEQ ID NO: 8036 - DNA, 1501 bp, Oryza sativa
cgataatgttgtaatgtaagctattcacattaaaacaaaagaacaagtttaccattttgacatgacatgatactagaaggttgaagaatgaagactatatgaatccgagcaaaaacagaactcagcattctaagtttctaacccattaatcaacataataactccgtactagtactatccacactctacccctattcttgttcaggtatactaacagtattcacttctaccaggatccaggaggcgagggtctctcatcgtctgctgcgccgcaaatcaaacagaagacaatctttcatgcatcctaagtcccagataaacacacctggaagaggaaggactcgttgccgccgccggaggcaccgttgggccccgcgagaaaccgctccccgtcctcacgccaccgcacaccgctgcgaaccaagctgacggggaccgagaacggaggagcgcgaagatgccggcggcgggagggagagccggcgccgccggcggcacaggtggaggtgggcgagcgagttcgccggcgatggcgagggcaaccacaatctattgtggtcttgacgcgagcccaattctcattcggcccaattaatgtgggcccatggatttctcaagcccattggtaaattttcagaaaggccccttcgtgtatattgcgcatgatgcacttttgcggaacaacctcagaaaagaccaaacatacctttgccgcgacacaacgtcctcttccttctccttctcatcctcgctacggggcggcgcggctgcggcggcagcggcggcggcggagaggcgatcaatcgacgcagacgaaggttcggttctaccttgcttatgctgggcgggtgtggaattgagatccgttgggagtcggatggatttgttcctgtcgttggtgacgaaccctagcctactctgtttggattattttgctgtgataaatctaatcgggcctcgtttatggtacggattctcgaaaccaatcagtttttagcggatttattttatgcgaagtatagcggtatagtttcttaactattttttttttaaaatcctcggttggacatctcatgcctgcctcggtgcctccccttgctagatgtgcataattttaggattgccgaagggctgaattttggcgaaaccgcattgcagaccaaatcgataaaccgaagaacaaagggttaattaagtgtttaattatgtacttcgtatttctctgcccaaaaaagctttactgtttggagtgccgtgttgtaaattagaaaatgtgtcacaaaactttgcttacactaatatttatagtggccaatgttcattctacaataatagtttggtagtaataccgcttactacatctttctttttatttgcacagtgccactgactacataaccactatgaatcaggtgtactgatcctcctcaataagttggagcaggagttatcatggtgagtacattctaactgcttgatagtagcttgtgctaaatccata

SEQ ID NO: 8037 - DNA, 1501 bp, Oryza sativa
  unsure (1)..(1501): unsure at all n locations
ccggtgaaacgtgctcgatcagaaagtctacgccaaattaaaggtttagaaaaattganacgatatgacggaaaagttaaaaatttaaagaaaaaaattggaatctaaacagtgccaaggtacagtgattgaaaaaaaattaagcgactcacggttaactgcagcaaccggagtcgcagccgaagccgaagtagcagcaacaactggagccggagaaggatggcacacaatcggcagctagcgttgatcgaccaagcagcgaaatgaatagtgcagcagaacgtcgacacaagaaattgcagcaaattttatagatgcagaagaagagaagggggaaggcaacggtcggtagcagacgtgcagcgaagggcaaagtgtccgattccaacagcacacaccaccgcgcaactttcaccgtttctcgagaatttaccctttgctttgatgaaggggcggagccacgtgtaggatagcttgagcttacacatgacaaaaaagaaaacaaaaacaatgataaaacactaaactttagataaaatttaaacaaaatgaatataaaactacatgggtgatacctactcttgataccttcctgcctccaccttgttcaagtcagtaagaatttaccctgtttttgtcgaaatagtttaggatatgtcctcctcctacgtggctatatccttattctggtatttttcttttctggttccttctttcaggccctttgaatcataggaataaaaaaaatagaggaataagaaaaacgcaggattataataggaagnnaaatataaaacaaaagattgcaaaacacaggaaaaatacaggattgatcgtttgattgggttgtaggaaaaacgcaggaattggatgaaagagatagactcaaaggaattttccaatagattgaatctcgggctaaatttccttcaaaacctacatgcaataagtcattccatgaaaattgtataggatttggaaaactccaatcatttgaattaaagggcgaaataggaaaactttctataggatttcaatcctataaaatttctccccaatattttttaaaaaaaaaaatttttccccccctttttttttttgggaaattttttccaaaaaaacggccccttaaaaaaagggtttttttttttttaaaaaaaaaccctttggaanaaaattcccaggngttntttgaaaaataagtttcntttagggtgcttatttgtaaaatatattttcaaaaggacataaatataaaaaatccaaccctggttactactacagcgacttgttaccatacaccagttgtcagttggatagaaccagtccaggaacgtgtggccccctagcaggcaaataccgggcccacatctcagtcacaagaaggcaccatggcccacctaataattcccctccccaaaaatcggttgctcctttgcctaatcactcaattccagtaactttcctctcatctctcacagaaaaaacattcctctcatct

SEQ ID NO: 8038 - DNA, 1501 bp, Oryza sativa
attgtaggtgttcagacggtctgactggtggattcctagcatgaattcaatctggctctttttttatttgcttgaagggcaaggtttcccaagtcctagtgctttcctaaagtctaggtggacatagagaagtacctgttggcacaagattacttctcctacaaaggcttcgtctaattcgcaattgatcatgtgcctcctaggacgtgcgatcgcatgataaaatcagtgctacttcgtgtggtagcgctacctgcctccctcttctcttcccaggtaggtctccctcttctcttcctaggtaagctaatgaacccttatagagaaaaagagcccacttatgtttcttgttttatgcgggtcacaaccaatagctaacctcttttttttttccttttatagatagattgtatatcaaaatatttgtatatataaattatacaaatagacattttgttgcgtgtaaactttgtactagtatatagaaactttgtatagataaaatttgtatatattaatttgaaagaaatttagtagcatatcattttggcctagaaacaatttatatgcgaaaattttatgcataaatactttgaacatataaactttatgtaattttgttcatgtgaattttatacctataaactttgtacatccagttttaaaatagattcaaatagcaatctggaaaaaacaaaaaaaagcatgtggcctacgaagtccaagtgtgcatcttgttggatttggcctgctatagaaaaaaaaatggaaaaaggcccaagcttaataaaaacacacatggattaaaaagaaaaaaatatgcccaagaggtgatagaggtgtcttgggcaccgaccacagggagggtgggagggatgtgccccaagcaccgcccataggggatcgcaccccgggggccgatgtgcccccagccgagcacagcccacggtaggggtgaaaacggtatggaaacttcccgatcgtaccgataccgtttccgcaaaactaatataataataataattttaccgttggttaccgttttcaaattttagttttttttatttctgtaagcgtggcattgaagttgacactaaatagatgaattcataaatatgaaaatttccagaccgtttccgttcgttttcgaaaaaaataataaaataatgtaccgtttccgattatttccgaccgttttcatccctagcccacggggggccatgcacggggcaagcgatagggatgctctagttcctatttataattgttttcttttgattccaatattaaaagtagcccaaaagaatatggttttatgtggagaaaatcataaaaccctatccatagaaaggtttagccggctattttaagtagtaccacaattttgcaaggtagtactattaattctacactgtattcttcaaatttgttcgatctttattatggtatgaatggaattttcttttttatgtgtcggtcaacccaggaattgtagtaaaat

SEQ ID NO: 8039 - DNA, 1425 bp, Oryza sativa
gatatcttctggcaccatatatatatatatataccatatatatatatatatatagtactagtacttgccaacgaaatttggtagttacatcttaaaatatagcatgcagttacatatgcgcatgttatcagataaagtattgaacaaatattttagaaatagattttttgttagattatggaaatgtcttcagagaaaaaaaaacatgttgcattattacatattaattgacagaaaaagtatgttgcattattacctattaattaattaactgcgggaaaccatacatattaacaacattaaccataactacaatcctatggagtacatgaggcaaataaaaatcagaggtcattacttttggctgtgtgcactaaattatatatacagagcgtggagatataatcatattccataaactaattaaataataataatcacgcaaatcgtcacagactcacaatccacacaggctagctgaagactgatgcatctgaagatagcagtattaattaatttgcaaaagttataattatctcatgtctagtcaaattttaaattttagtaattaagtagctgcagtcattatggataaaaataacttctagttttactatggatcatactctctccatactcgtaaaaaaagtcgttaggacagtgacacggtttccaaaacacaacattgactttcttatttctacaaaaatatttattaaaaagtaatatatgtatacttttatgaaagtatttttcaagacaaatctatatatatgatttttacattttcaaactcaacaacttgagagttatttatgatttatattctcaaggtttgacttaaacattgttctaaacgacttcctttataagtacagagggagtatatgcaaactttatggagaacactgtagtttactgataccatgctaaaaaaaatagtttaacgaagtacaaccgttcaactgctctcaacctgatgccttgtatgagatcagaaagctagctagcttgtgttgacagctgttctaatgatttgagatatatcaaacttgtcaaaacagtacacttgtgctgatctaatcacatttcaactgtctatctaatcataggtgagctaaccgaggaagaacaatgcaacatattgggccacctctattaccacctgatgatctcttcttcctaaccaataattaacaaatccttgcagatggtttggaaggtcaacaaccagtgtcaagatctgaccatgcaattagctttgtgagctataaatgtatccatacattgctttgcatcaaacaacactgaatttattgcagtagttaattagaacactgaatatattagctgtgctaagtgtagctagctcagtgggcaaagcaagcaatatttcaatggcttccagctcgaacttgctcgcga

SEQ ID NO: 8040 - DNA, 1501 bp, Oryza sativa
acttaaaatagccggctaaacctttctatggatagggttttatgattttctccacataaaaccatattcttttgggctacttttaatattggaatcaaaagaaaacaattataaataggaactagagcatccctatcgcttgccccgtgcatggccccccgtgggctagggatgaaaacggtcggaaataatcggaaacggtacattattttattatttttttcgaaaacgaacggaaacggtctggaaattttcatatttatgaattcatctatttagtgtcaacttcaatgccacgcttacagaaataaaaaaaactaaaatttgaaaacggtaaccaacggtaaaattattattattatattagttttgcggaaacggtatcggtacgatcgggaagtttccataccgttttcacccctaccgtgggctgtgctcggctgggggcacatcggcccccggggtgcgatcccctatgggcggtgcttggggcacatccctcccaccctccctgtggtcggtgcccaagacacctctatcacctcttgggcatatttttttctttttaatccatgtgtgtttttattaagcttgggcctttttccatttttttttctatagcaggccaaatccaacaagatgcacacttggacttcgtaggccacatgcttttttttgttttttccagattgctatttgaatctattttaaaactggatgtacaaagtttataggtataaaattcacatgaacaaaattacataaagtttatatgttcaaagtatttatgcataaaattttcgcatataaattgtttctaggccaaaatgatatgctactaaatttctttcaaattaatatatacaaattttatctatacaaagtttctatatactagtacaaagtttacacgcaacaaaatgtctatttgtataatttatatatacaaatattttgatatacaatctatctataaaaggaaaaaaaaaagaggttagctattggttgtgacccgcataaaacaagaaacataagtgggctctttttctctataagggttcattagcttacctaggaagagaagagggagacctacctgggaagagaagagggaggcaggtagcgctaccacacgaagtagcactgattttatcatgcgatcgcacgtcctaggaggcacatgatcaattgcgaattagacgaagcctttgtaggagaagtaatcttgtgccaacaggtacttctctatgtccacctagactttaggaaagcactaggacttgggaaaccttgcccttcaagcaaataaaaaaagagccagattgaattcatgctaggaatccaccagtcagaccgtctgaacacctacaatcaggccataattcattgtacatttgcactatattaaaataaattttaaggtgtcttaagcatacaagtggactaggaatcaaaaaataaatcacctgtaacgataataagtagatatgcagatgcaaac

SEQ ID NO: 8041 - DNA, 1234 bp, Oryza sativa
cttgaaaaggagtactgttcccaaaaaaaaaaaaaccctccctccgtctcatttcaagagtagttgtgggtttcgtattcaacgtacagtggtggagccagcatcatcattaagcccatagtatttttcggtgatcgattaatttttatgggtgtcaatagctatcaatagtggtgacggtaatagcggagcccgcgcggctgcccgacttgcccgggaggtggatccgctgctgtcaacatgggttttcgtattcaacgtttcaccattcgttttatttgattttctttcgaaaaaaaataaaaatataagtcatgtataaaatattatttataataaaaatacaaccataaaaaagttttaaataagatgaacgattaaatattgaatctagaaacttacagctatatttaaaatgtgatggagggagtactcctggttgcattcaaaatttatcatacaactaacaaaatacctatacatcatagcggattctaattatattaggtaaactgatgaaaactaaattgtcaccctctgattaatgatgatagtaggataaacactaaaaaatacacataaagcaaatagattctcactgcagtagaatttaggttaacagtgatggtccataagatagatggtggtctccctcttatcgggtaggtgagtataccataacaccgctactaatatggtgtaaatatagaacttctccgtatattttcttacctcaatttctctacctactttcttattattctctcaacaatattaaacataggtcatttatcaggtaaaagaataaatatccccttttaattttaccactctcgtacttcttgtaaaaaaaaaacttcactagtccctgtattttttggacggaactactctttacttgtttatgcatgttagtttaaaggtgggagttttatggggtactcccttaaatatatcagtaaataaacatgtactccgtcccaaaatatactcctcgctacgttcaaaacttatagttcttagtacatagtacctacttttctcaaccaataaacgaacatccccatttctcaggtaaaagaataaatgtccctatttagttttatctctctagcttgttagataccattaaaaaattttataaaatgcttatattttgggacggaagaattactcctacttctctatgcaggttagattgaatgtgacaattttctgtgatactctttttagt

SEQ ID NO: 8042 - DNA, 1501 bp, Oryza sativa; identical to SEQ ID NO: 37

SEQ ID NO: 8043 - DNA, 724 bp, Oryza sativa
taattcccccccccccacttaattgcacgcgggggcggcgggatgcggcggattcggcggcggcggcggcggcgctcggcgcgggcggggcggcgagagcggcgggaggacggggatgacgggtgggccccacccgtaagcgagggtggcgggcaggcccgcccgtcagcggcacgcacgcggggagagaccgaatgggctgcgggggagaggagagagaggaagggagatgggtcggattcggcccatccgaggggagagagattttagggtttttctttttataaaaaccttttcaactttttttatttcttaataattattatttgtgctctgaaaatttaagtaaaatttgagggctctttttagaccaaggagaatttaacaaaaattctccgggtcacattcgaatttttcttgtacgcattttaatgtttgccaatttctttttgaattttaattaattttattattccttttagagaatgatttttatttcgggatgaatttattaggacgtgacaaatttgatcccaaaaataataaaaaccgtgggtcctacatgtcggtctcacatagaaaataataataaaaatagtgggacccacgtgggcctgagggcactcaaccgaggccgtagaaaccagaggagaactggagaaaaacaagatgccacgcctacgctcccggcacgggacgaacccgagaaacaaaggagagagag

SEQ ID NO: 8044 - DNA, 1501 bp, Oryza sativa
cctctcctcgtctcccaacgactcctctgacaccacggaggagtgaccaatgttgcgggatgaaggaggttggtggtatcatcctagatccatgttgcagtcactgccatattcagtgttgccctagatccacgctcatgttcggcacgtcaaggagtaggtagtggggagacatgatcggggctagccgcgcttcaagaaggagcacagccatacaacagatccacagtaggttgtcgcctcagtctctgtcgcaagcccataactgcctccacaaagtggtagaggagggagagggattgcctggggaatgatcggtagatcaggatcctctgcagtcaattgcactgtgcctttgtcactgacatgtgggtccgacgacacatcgtgtccatatgttagtgacaaaagcacggtgcagtcgattgcagaggatttttagcgatgattggtgggtctcatgtttttttttttcaattggattgcttgattcgaaaccactcacaatagtgtttgggattattcattcggtgtcaaaattttaagtgttgaattaaatgtttgggttttgtagttaagtgagaaaatttcgagggttgcaatagttcagaaggtattttgaacttttggcggacttcaaatttgtttagcattatcagtctgtaaacatgctaagaaaatatcattccgaagatattgattgtttaaaaaactgtaaccacagtatcacacatgtcaaaataccagtggaaaggtcagtgcatgggcatccaaagatgcgagcttgcagaaagaaaacaatgtggatcgatcgaagtcggctggcaatgcatgcatgcttgcgtgcctttgacagaaccattaattacatgtggacatgtgtccctgatttgattctttagggaagagaacaaaaataagtcaaatgaaggtactgacactacactagcctatccacgaaccgccggacagagccaaagtggtcgctcacgcactttggggaaagagatggagaagagaatcactgcactgctatggtcgctcacgcaattgacatatgagattattggtttcgctatttaaagattattagcgaagtggttttggtgatgaatagggactactgattgtcggtccggtcagaccgggcattggttgtcggtcagaccggcgtgcttcgagtggtcagactggccagcccgcggtctgaccggccgactctgtgttggtttcggttttaggttgtttcattgaatatctgtggattaattatatttatgacttctagatagatactatgcatatgaaattctgttgtttgctagcaatgagtcaaattggagatagcttgtgctcataatatggtttcttatttgattcatgtgtaggtgatcttgatgtctcgggagagtgttgccggtgatggatcgggagtcaacttggggataaggtgacgtctggacggtcatatatcatgcgagatgcttaggctaaagatcaa

SEQ ID NO: 8045 - DNA, 1501 bp, Oryza sativa
gcaacactctcccgagacatcaagatcacctacacatgaatcaaataagaaaccatattatgagcacaagctatctccaatttgactcattgctagcaaacaacagaatttcatatgcatagtatctatctagaagtcataaatataattaatccacagatattcaatgaaacaacctaaaaccgaaaccaacacagagtcggccggtcagaccgcgggctggccagtctgaccactcgaagcacgccggtctgaccgacaaccaatgcccggtctgaccggaccgacaatcagtagtccctattcatcaccaaaaccacttcgctaataatctttaaatagcgaaaccaataatctcatatgtcaattgcgtgagcgaccatagcagtgcagtgattctcttctccatctctttccccaaagtgcgtgagcgaccactttggctctgtccggcggttcgtggataggctagtgtagtgtcagtaccttcatttgacttatttttgttctcttccctaaagaatcaaatcagggacacatgtccacatgtaattaatggttctgtcaaaggcacgcaagcatgcatgcattgccagccgacttcgatcgatccacattgttttctttctgcaagctcgcatctttggatgcccatgcactgacctttccactggtattttgacatgtgtgatactgtggttacagttttttaaacaatcaatatcttcggaatgatattttcttagcatgtttacagactgataatgctaaacaaatttgaagtccgccaaaagttcaaaataccttctgaactattgcaaccctcgaaattttctcacttaactacaaaacccaaacatttaattcaacacttaaaattttgacaccgaatgaataatcccaaacactattgtgagtggtttcgaatcaagcaatccaattgaaaaaaaaaaacatgagacccaccaatcatcgctaaaaatcctctgcaatcgactgcaccgtgcttttgtcactaacatatggacacgatgtgtcgtcggacccacatgtcagtgacaaaggcacagtgcaattgactgcagaggatcctgatctaccgatcattccccaggcaatccctctccctcctctaccactttgtggaggcagttatgggcttgcgacagagactgaggcgacaacctactgtggatctgttgtatggctgtgctccttcttgaagcgcggctagccccgatcatgtctccccactacctactccttgacgtgccgaacatgagcgtggatctagggcaacactgaatatggcagtgactgcaacatggatctaggatgataccaccaacctccttcatcccgcaacattggtcactcctccgtggtgtcagaggagtcgttgggagacgaggagagggttggcatggcaagaggtccaaatctactccgtcgctcttttcctttccctatgtctcccctctcccatgaaggatgatgagcg

SEQ ID NO: 8046 - DNA, 1501 bp, Oryza sativa
cacaccacgtggaacgatgcgtagacatgctacgagccaaacgctgcgttcgaatgtgcgtgcacctccccgcatttttaagcaaacggttcacggtcttccatcaaaactcgcgcacgctgcgctacaacgaccatatctacgtcactgtatttgactgcaattgatggatatttagtttacctttttagattctataactatgtatattgtatttgtagaacgtagacaagaatttagactacagatgctagaacccctctaaacaggatctaccgtacgtctacaactcaatggtttgaacaattgaattttcttctcacgttccaaaaaaaatgttgaatttaatttgacgagtgatttttctcaacatttttaaagagtgaactccggaatacccaaaagagacctttgtttttctcttcaaaacctttttggttcttcgaaattcagtattttttaacaaaagattacatgggaacaagggatttaaccaatacagtaattttttaaaaaacaatatttttaatggtacacagtaaataatatgcgacaataatccgataaagcatctaaaaataatatggacctgtaaattgcacatttgtacatccaactgagcacataatttttttgcagtctaaaataccgggaaatacttaaatactactacctctttgtacaaatgtatgacgttggttagttctttttagctaaccaatgtcaaacaaaaaaaaatatggagggagtacttcctctgtttcatatttataagactttctagtattgcttatattcacatataagttaataaatctaccgtcttataatatgaaacggagggagtacttaaattttctgctgtctgaaatgcagtagtatttttttgagctgggtggacatgcatacatgcacccttatactcgtcgaacgtaatattatacaataattaactactccctccgtttcataatataagaatttctagcattgctcatattcatgtaagtctttcattaatatctctataaatatgagcaatacttgaaagacttacattatgaaacggatgaagtataatactattcattatctaaaaaactactttctccattttataatgtaagactttctagcattatccacattcatataaatattaatgaatctagacacatatatatacctaggtttattaaaatttatatgaatataagtaatgctagaaagtgttacattatgaaacggagtatagtataatactattttacatcattatactacatattttttaagacatgcatacatgcatcattatactagtcgtcgtcatataaatagcggagccagccgtgctgctgcctttcacttcacagattcacacacacacacacacacactctctctctctcctcgcgtctgcgtgtcaacgcctacacaaacagcttcctcctcctcctccatggcgtccatggcggcgagaagtagcaggaagcgcagg

SEQ ID NO: 8047 - DNA, 1501 bp, Oryza sativa
tgcacgacgaggccctccacccggcccaggtaccgcgacgccgcgtccgagccctcccggagctcgtcgtccagggcgcccacgctcccgaacgacgagttgctgccggcgacggcgagcggggacggcgccagggaggccgtggtggcgttgtcgcccgcgaacgtctcgtggatgtagaagtggaggtgcgtcgtcgtcgtcgtgccgtcgcccgtggcggcggcgaggacggcgaggaaggcgaggaggcagatgatcgtcgtcggcgtcggcatcatggaggtttgtgtacgttgcggtcggtataggagaaaaccatgtaagtggagtagtaattagtgcgtgagagtcagtagaaggagcagttgggcctcaactatcgtggggactggtcgtgggaatctttagagcaggtacaataagctattctgactggtgataatgcatccacggtggatttctttggtgagctggaagaaagattagaggagagagagtgtgagccggcgactaatttgtcgccgactacacacgcgctccaaggccgagcgaatgggaagctagtgagcagctattggacccacaagaactgtgcaggaacaaagcatggcaggacgccattgaggccgtgagctcggggtcgaggaacagtggccaggaggggagctcggtgagtgacgccatggtgactagagtggccagcttgaagcctagctagctgccatgaaggagaagttgagagcgttggcatgcctgattggaggaggatgaggtaggagtgaaggctgtcaccggcgtggcttgggcacggagagcggaattttttttatttttaattttttttattaaaagttttacaaaaataattttccattttgaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctgggggagggcgatttttgcctccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatctagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaagcacaa

SEQ ID NO: 8048 - DNA, 1501 bp, Oryza sativa
agtttagagggggttgaaggggattggaggggttctagggggaataatttcatactacaatagttgttgaataaatcccctccaatccccctccctattggggattaaccaaacatagccttaaaaaacatgaggccctgtgaagatccgctcccttctctcttgcaaaaaataaggcgctgagaggatgtagaaacccgtatctcttctcgaacaatcacatcacatgagacaatgaactcagatgtaggagtgaagttttatctttattatcaatgattttttgtacaatggatatttctgttgctttatttataggtagagagatacttaaaacggatttatctctaaaactgattcggattggaccacataaaagaatcttatctccatatatattgttcgcgtaacaacatccgcatgtctgtggaaatgcttcgatgggcccgagagtggtgttaatgttaaaacccatcgcaggtgaacatagaggcccgttgccccgttacaatccttgcccagcccacactggcgtacaaatgtggctggagaccagaccaatccaggctgcccgtgccaagtgaacttaaagagcagtaccaaaggcttgattagaaaaaataaactctacattacatcatttgcatcctgaactgatgggatcatactccaataataacagcgggaactgaaatacagtacgtaaactgatagtttttctctagaccacagtcatttggttcagagaaatctccatttccatcgatcttctttcaatccctttcagttactattgtaactgcgcacaatttacaccatccatttctcagtcaaaggttcaaatcggctgctacaatgatacagttatagtgccaagaagaatatactagcactgcttaacttacggtcacactagtaactgcatgagtcgaattcctcatgtttagactttagagtacgttgtatacacaaattagcacgactgctagcaaagaatccaatgctaaaccaagtaccggggtattcaaaagagaaaatatgatcaggcctactattattaatattaggagagaattctttatatatataccactgtaaccaggacggttttcttatttaccacttgaaatatcgcttatatacaaacctgccgagatttgcgactcctggagatttttgagctggcgtggccacctgcgcgtgccgacgcgtcagcgaggcgctggatggcgggtggttttcgtgagctctcgcacacccgtgtcgtcgttagtgattttgcaaaaacacccttcatttacttgataattatagatccctggtccttagttctaatgttgtgcgttcttacttagaggacctcttaagaaaacaatattctatatgaagaagcgaaaaaacggaaaattgaaccgcgctctgaaaactagaagtttaggggtgtttttgcaaaacaaaaacaaccctcacccctttccccaaaccctagccgccaccattc

SEQ ID NO: 8049 - DNA, 1501 bp, Oryza sativa
aagtatacttaccacctcctcgaagtatcttaaaaatattccttgtgttataaaatgaggaagaggagaaccgcagctcctcatttgcttccaaaagggcgcgcattgtgggcccctccgcgacttgctcgcctccctggccccacatgtcaccctcgcgcccccacgcccaccaaaacaaaacatttaatttaaccccccaaaaaaaaatcaaaacagaaaccaaaactcctccctctctcctccaagttcgtcgctctcctcctctcgccggattcgcggcgcggaatttcgatcccccccggaagattctcccgccggcggtcgcggcgcgctgcaccgcgtaggccgcgcgcgcgggcgtgttggcgccgccgccgccgacgacgacgaatgcccagcggcacgctccgagccgccgccccgcccccgccgcctcgctgcgacacgggcgcggggggcggtacaggacgctgagacggtgccttgggtgtgttcgggaggggaggggagctctcgcgtcgcctccgtaaggtggggtgtgtgtgtgttggccatcggtggcggccatcttctcgctcgatctcccgctcccgcggaacccgacgcaatgtgggggcgaggtctgtagatggtggttggcctgatcgatctcctgatatttcttaggtatattgcttggcattatttgattccgtcgggctgttgccatgttgccacactgaaggagtgtgtgtaaatatgtaattcacggttttttctatcgcctttcctgatggaatcacgtaactcaggaattaagtttgtagattgtttagggattgttgtgttgttgttcattatcacttttaggtattgtcatgtcacaatggctcttgaatgctcattaatccgttttccattttgttcttcatttacacagaaagatatatgttgctttcttgcaaacatggagagatatatttgtgtacagtaatagtctaggcgattaccttgttagatttgtcagtatatataaaacttacatttgttagagttccattatgctcctgctaactttttcattattattaataataattttatgggccatctatttatttgtcaagtgtctggctttttcttatctatcaataacacttttcaacactagattaatatccaacaaatcaaatttatgtgtttttttattgtagtgaatttctaatctaaattttaccaaaaaaaaaagctttgatgttggttgttaccagtatcaaacaacaacaaaaaaaaatattgcacaagtttagatgactgatagataagaaaagccaggcaactgataaatagcaaaactgctttcttgtgggtctataatcttgtatgtaatgcattaaattctggatagtttttgcattaatacgttctaatgtacgtcttaatttcttagatttttgttgcagcagatgaggatgcaagtatgaattgctcttttaggtggtaccattgcagcaaccca

SEQ ID NO: 8050 - DNA, 1501 bp, Oryza sativa
aaacggggtagaaataagcaattgtcccataagtaattggtatttaattgataattaaattagcttatacaatgtattttgggaaaattaaaaatatatcctataattcaattgaagtttggcattccacaacataagttatttttattgtaaatccccacccctacttaattttgttaaaaaatcgtcctagtatatgtgtgcttaaccgaatcgatatgttttcataaattgtgatgcgtctacgtggtatttaacaaaattaaatacttctaagaatataatcttaacagtttttggagattgcataaatagaatcgctgatgatggttaagcacgtgtgcactggggtagtttttgcaacaaaaccgagtatagtgatgagcatttgcaacaagatgacttatggagtgtaatgttaaacctcagatgacttctgggatgattttgtaatttttccatgtatttatttcatgctctcacacatactcataagtaacatataaaagataaactgtactgggaatagacatgatttttcatctctcactttattaatttcttatcacatcaataaaaatgttgacatgtcatgctatttaatgtgaatgaaactcttaccataggagtgacataagtagacagtgaagttgtattcactattaagggtttaatttaaatctcagtgcttacaaatattccgaatgtgatacgagtctcttctcggtttaaacaagtgtaaaagtgtatattcgtgagtgcatacgttgtgatgtgtgtacaagcatgttagatgtaggtgtgtacgttctccttctaatcatttcttttctttaccactggccatttactaaaacctctccatgatatttttaattcacgtaaagacatcagtgtagtgtgcacaccatgcatcaattatcttgatattgtaataattattatattttagtgcgtaccagcactcccattagtttcttacatttcaatgtgataaataattacataactctttcaatgtgacaaagtagtgtgtatatgactccatttattagagtttaaatttcgataactataattatgttttgtgggtgtgtttttatcttcttcatgataagtttattagagggtgagtactcataggcatgtgtgcgagcatatacacatggaatcatccgttcccaacatgcacggtgtgcacggaaaatggagcggttcattagtgcgtgattaattaagtattagctattttttaaaaaaatggatcaatatgatttttttaagcaactttcgtatagaaactttaaaaaaaaggttaattggatccatgccacgcgaattgtggcaaatcaaaaaaatgccacacctattctggaatccgggtgcatgccactactatttcgtcaaattggaaccatgccacaatgtacgccccgcgcgcgctttgccaccgttttagggtaccgtattttcgtatggacgtttttgccctcgtgttcac

SEQ ID NO: 8051 - DNA, 1501 bp, Oryza sativa
cgaagctccggccgacgcggcagtccgcctcagtgccgagccgcggctccgccgcctcctccggcaatgcgtggagcgtcgcgaggctccatcacctccgaggccacgcgcgactccgccggtcgcgtgcggctccgagtctccgacaccctccactggctgcccgcgaccccgccgagtcgacgtcgcgaccgcgtgcggtccgtcgcctccgcggccacgcgcagctccgcacctgacgcacggctcggactcctccgccggctaacgtatagcgatgccgcgtgcgcatccgccgcctccaccggccacgagcggctcgagccgcggccactttgcgcttccgccggccgtatgcggcttcgtcgcgtcagcggccccgcgcggccggcttcgccgcctccgccggccgcgtgcgccgccggtcgcgcgtggcttcgccgcctccggtcaccggcgccggcctccgttggctccgccacgccggccttcgcaccgtaggcaatgccgcacccgccttggccaaggccgcctccgcaggagggccgtgtgcggttgcctggtctcatgacggccattgctgcgccacacatcagctgcacgaagtgggctcactcgtgcgcactcggcgccagcaggccctgagcaaagggaaataggcggcaggtatgcatgcaaatgcatggttgcatgcatggtcctgttcacgtatagattagaaaagaaaacaaacaaaaaaaagaaaggagaaaaggagggcgtacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttccccaccctcgtgcgatccacgccgcagcatgtagccgcatgcggcttcgcagctccgcctccgaggccccatgcgcctcgccaccaccgcggacaggcgaggatccgccggccacgtgcagccccgagtggttccgcctgccgtatgcggcttcgtcaccacctctgcggcgaccgcggtttgccgcccccgcacggccccgcttgcttccgccgatcgcgccagccggctccttccgctcggtgtgcgtgcggccccgccgcctccacagcctggcgcgcagctgcgcccttctcgaatggtcgcgcatgcgaatgcatggcactgttcacgtgattctctctctctctctcca

SEQ ID NO: 8052 - DNA, 1501 bp, Oryza sativa
tggcagacacgtggcggccacgacgaacggctgagcggaggtggcgccgacgtggtgccacgagggcacccacacgaggtggcatagggaggccacgtggatggcccagatcggctagggcggccgattgggcgaccacgggcaggcatggcacggcaaaggggccgggcggccacgggcgagcagggcggcggcgcctgatggtcgccggcagcgggcggtggcggcgcacacgggaggaggcggggaagggagagggggctcatcgagaggacggggacggtgaggcgaagacggggaggcgaccgacgacgaggattggtggcggcgcttctcgggttggggtcggagatggcgctccagcgactccttaccgcggcggaggtgcggccgaggggagcaaagatgaggggttagaggagggagaggcgtcgcggcacggcgaggaacactggccgagcacggcgtttgcggcgggactcagcggggagacattacggcggctcctggcggcgaggaggtggtggccgagggtcttctcttccttgcgtggccgagggaagcgacggcgcaccgcgaggaggtcaggaactgcgggaatctgcgaccggaggcggcaaatgaggcggcggccttgggtcgatgacgaaagtggtgctccggcggtcggccttgctcttgcgacagcgaagccaatggtgcaagcagcgagcagtggcggtggttgaagcggcggtggagggcggccggaggcagcgaacggcggtgatggcttgggtacacggtgcggaggtggttccgatagggatacggggaggcagaccggatgccgaggtgcggctcggcgcggtgcggcgacggccaacacggcgggagccggcagctggagcacgccgacgagcggcggcgcgcgacgcggtgttgcgagagcgagggagagtgtgacaggttcgggaaaaatggggaaaagagagaggatgctccggggatcatttatatgggctcggagcggcgggatcggggccgagaggggcagtaaccggcacaacgtgggtggaatcgtcgcggggaagcggtggtggttttcatgggacggagtgggtgaggacagcggggacgtgggcggcgaggtcccacagccaggcaagagcgcgtggggtggaggaggtgggtgggggaagcggcgacgtggggcggctcgggcggccatggcggcaacgacaattgtaggcctgaggttggggatgacccatctgtcagcctgagtgagaggggagaccaggagggggcgatgtagacttttcaagggagagaggccgagcgggccgaaaagggagaagggaggagggaaggagggaggccggcccgagggagggaaaactgggccgagcccaaaagggaggggagggagagaaagagagaatttatttatttttctttttatttaaattgattaaatgaactttgtatcattataatattaccaaatattctcggccaa

SEQ ID NO: 8053 - DNA, 1501 bp, Oryza sativa
gaccaaagaagaatctcgtgcaggtggagcatacagggacacgcgcagcatggcaagaaatgaacgagaaagttcatcatcatcaacacccatgcaaatatatgaggtaggttgggaaccaattggggatgcacccggatggacccaagctccacgccacagcatcgaggtctcaagctgggcaagcaccagagaggaccggtggcatgcacctcatgacatacaatggggggacaaccaacctcccagatcaagtggaataccttcatctccaagtgtatggcgctcgagttcctcttgttggaacttgggtgaaatcacaaggagaatgaacacccttgatgtgcagacgggagagatgtagtacaacctcacggaatacatagcacaaacacaagaatggcaacagaatgctgatgctcagttcgccaacttcaacaacatgatgcaacaacagcacgatgaccttcaatcgtacttccgcttacagtgaattgggttgggtaaaattaggtaatactttgacagccaattaaaagcaatttttggattattttgctaaagctaagagttaatctatcgcaacaactagactaggtgaatttcatctacaatttaatttgttattctctaacttgatgtatggttcctcgatttgtttgcaatatttcacttctttatctaccccaacttcagtaaattcattgtaagctggcaaatttacatatccagttcgtgaaaatctcactattatacaaccataaagatataacattatacttacttgcctttaaattcctttcttttctaacaacaaaaaagaagagggcacctacatatatgatagctctagttatagtttaattacttatgtaactgcaaatgctacatgagtgaggtacatgcttgttgtcaaaagacaaccgcgtcacgtcgaaagacgtggttcactcggtagattgttggaatagtaaaagcaatatattaatcgataagataattttttaggatcccccattacacggccctagggggctatttatagtcttaatacaggctcataccctatagggtttagtttgtacaggagaatttatatggatacccttacgatagggactttagtgaggctacacagtgtcctttgtgtttacgggctattaagtgaactccttgggccagcccattaatggcgcaaggcctccatggggcgcggtgtctcccaagccctctgccgaagccgcttctaactcaagcaaaaccctcctgcttcgctttacggccttcgcccgtagtgatggctcgtcaggatagtgggcttggtggcaaacccttcggtctacatcatctagttttgcccagctgcttttccttatggctttgcctcttggacttagccaacacctcatggtccttgtggttttagtagacccagccgaaggccctcgtgacatgcctccaacaagcccctcacgggcaaggatgataatgtgaccatgac

SEQ ID NO: 8054 - DNA, 1501 bp, Oryza sativa
ttgacagttggcgcgtcaggtaggggttgcgccatgtttttcgccgactagtgcgatgggattcgtttcgggcatcaccgacttcactttccctcccgggcagacgtgctggttcggcggcccatggacctcatcagccacccgtacatgcatgcaaagaagacatcgtacgacagatcaatccatgattataaatcaagctaataatattatatagattgtgaaagaagttcttctgtatatgtgcagaatgaaggatcccttaaagcaaattgtttttgattggttgcaagctttatagttttatttaactccttcgactgtaactttgtaaatattttttgagttatataaaattacactgctcggcaaagccctggcagtatttcaggtcaaaaaagatttcatatagattgaaacgacaaaccaatcgacgtcagagattagaatcatcgatctcattgagattgccctcgagcaaaaacaatgcctttgattcctgaagttgtttccattgcacttcttgatggataattcgacgcttcccctacctgtcgcgccaactgtttaaactggaattcggcaatatgaaaaagagtatcgcacgagacataaaagtggatggatgtgaagacaagaatttagacaggttcaggccctctcgatgagaggtaaaaccctacacctgtttggggatttgtatccgccaggtggatattgatctgatgatctgattgtggttatccgtgctgatgcccttgtaggggctcattgcccgccttatataggttggggggcagggttacaaagtagaaaacaagccagacagcccactctagtacataatagatggatccggcccactcctatctctagtcgaatatggaggccgtgtcggtacccggtacgcatactctccacaagtttctctacaggaacaaggacgatcaataactaactatctgttttctcttttctattttggttcacacagctacacattgacatttatttttagcattaaatgcctagctctagccttgatgtttacttacatttttctattgtaattttatgtttttgttttagcattggtgtgaatcaggatactcctaataatatatcaacatattttggttgtcatctttttgtgtagtttgttttgaccagaaaaaggttgcttaaaataaaaagaaagattcatgcaagctgaaataattcacacgatagataaatttatttccgaaatttgataacaatgttacaaatgtggcgtgcatgcgatcaatgtgtgggaagcaagtatcacaattaattaattgaaatacaaaagtatgcacgatataatcgacggtggtgtgtatccaaaagaaatttagcgtaaggcctatatataagaaagaactgaggaattgtatgtatgaagttgaatgaaaaaatgatatataatgtagaattgagagttgggaatatatgaaatagaaaattgagaaaaacaatg

SEQ ID NO: 8055 - DNA, 542 bp, Oryza sativa
aatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcagg

SEQ ID NO: 8056 - DNA, 1142 bp, Oryza sativa
gtcgccgccgagctccggtccgccgctgtcgtcgccccggaccgcctcccacctcagcgccgcctccttcgacttcgccgtatcctcgccgacctcgtccacctctccgtttcggtcgccgaccgccagagcgccgtcgtccccgtcgacccgagccgcgccaccgcctccctccgctccggccgcctcccccgtcgccgccgtcgccccggggtgagccgtggaccgtcgcctcctttcccccttcccttccctctctcggccgccgctccgccgcgccggtggtcgccggcggcgaccatcggggcgtgggcgcgccgcctcccgccgaccgcgccagcatggccgccctcgggcatgccaagtggctgccgcgtggggcccggccgtcagccacccgcgccctcgggtgcgactgacatgtggggcccacggcgccggccggtgtgagcccgggtgcacctggtccaccgtggaccgtgaggctgccgcgtgggacccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcagaattggaccgttcaagtctctaatttttccttaagaagtcaagtcatatcatccttgaacatattgaatcccactttataaaattattttgatttaaattattgcattatcgctttatttaaattcccgcgttatcactgttttattcagccatgcctatttacctttgttatgaccttattattattgctattgttattattattactttgttcaccctagaataacaaaaccccaactagtggatactctattcatggtaccactagtatgaatttaggtagatgcttcgctggattaaataggcaacattaggtggttttacaactttagactttgggaataatcatatcacctggacactatggaatggttggattattgtggaattggattcacacctccccctctattcaaaaccctcaaaatggttttaggctgggctcggggtgcatggttttgatggtagcacctcggccatataaggaccggt

SEQ ID NO: 8057 - DNA, 1501 bp, Oryza sativa
tgcgtggagcgtcgcgaggctccatcacctccgaggccacgcgcgactccgccggtcgcgtgcggctccgagtctccgacaccctccactggctgcccgcgaccccgccgagtcgacgtcgcgaccgcgtgcggtccgtcgcctccgcggccacgcgcagctccgcacctgacgcacggctcggactcctccgccggctaacgtatagcgatgccgcgtgcgcatccgccgcctccaccggccacgagcggctcgagccgcggccactttgcgcttccgccggccgtatgcggcttcgtcgcgtcagcggccccgcgcggccggcttcgccgcctccgccggccgcgtgcgccgccggtcgcgcgtggcttcgccgcctccggtcaccggcgccggcctccgttggctccgccacgccggccttcgcaccgtaggcaatgccgcacccgccttggccaaggccgcctccgcaggagggccgtgtgcggttgcctggtctcatgacggccattgctgcgccacacatcagctgcacgaagtgggctcactcgtgcgcactcggcgccagcaggccctgagcaaagggaaataggcggcaggtatgcatgcaaatgcatggttgcatgcatggtcctgttcacgtatagattagaaaagaaaacaaacaaaaaaaagaaaggagaaaaggagggcgtacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttccccaccctcgtgcgatccacgccgcagcatgtagccgcatgcggcttcgcagctccgcctccgaggccccatgcgcctcgccaccaccgcggacaggcgaggatccgccggccacgtgcagccgcgagtggttccgcctgccgtatgcggcttcgtcaccacctctgcggcgaccgcggtttgccgcccccgcacggccccgcttgcttccgccgatcgcgccagccggctccttccgctcggtgtgcgtgcggccccgccgcctccacagcctggcgcgcagctgcgcccttctcgaatggtcgcgcatgcgaatgcatggcactgttcacgtgattctctctctctctctccatatatatatatatatatatatatatatatatatatatatatatatatatatatatatatatatatat

SEQ ID NO: 8058 - DNA, 817 bp, Oryza sativa
ccgtggggctgccgcgtgggccccacccccgtggatccggcccgcgtgccccttccctcgggtgacgcaataaatacgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtaaaagccttttcttttccattggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttatgaccttattattattgttattgttattattattaccttgttcaccctagaataaacaaaacctcaactagtggacactctactcatggcaccactagtttaattttaggtagatgcttcgcaatttaattaggtaacattaggtggtttttcaactatagactttgggaaatattcatatcacctggatactatggaatggtttggttattgtggaattggcttcacaccgctccttctattcaaaatccccaaaatggttttaggctgggcgcggggtgcatggttttgatagtagcacctcggccatataaggaccggt

SEQ ID NO: 8059 - DNA, 410 bp, Oryza sativa
tcgttagtatttttatgattaaaaaatttcatttggaaatagaaaaacttcatataagaaatttttgaacatggatacaaactttaactataaataaaacttcaacggaaaaacttccaatacgaaatattgagcatgagaaagttttgctataatttgagaaaccttttattttttagaaaacttcccattgtgttcagtgagctaatcttatgacttatgagacctatggagcggttggttatcctatgtgaagccacataacgagtgattatgcagaaggcaaaagaaaagccatgctgagttattacattaatatttctaggtaaaaattacacacataattatatcatatcgatctcacgtaaagggagaagttgtatcaggaaaattggttgtttaaccgatga

SEQ ID NO: 8060 - DNA, 1501 bp, Oryza sativa
cattgacgattgggcagaagtcatcttctccgttgtgcccacggaacccctccatggtcgcttgtcgctgcctctacctagtcctctgctgatttcaacccatcgtcgctcgatcacacaacaggagagaggaggtagggagctcaacggggatggagtaagggaggaggcggaggacgaggggagagagagcttgctaggagctgttgctcgtgtattatggagcttgtcgagagaggtagtagaggggagggtggggcgggggggaggaatagagagcatgggactaactagtgggatcgcatattgacgtggactacttgttgaggtggcatccatcgtggcttccaattataccaaaaatagccccaaaaatcatgctagggtgtaaaatatacgatattggtagtttaggagtgacatatacccggtttcgcagtttagagaacacaaaagtagagggggaataaaatgtacttatcaattttttaaacagaattaatgagtaatagggtgaaccgtaataattggcatagtttatgcaactttgaaaaacgaacccgaatattctcaacgatattattttcaccaaaaataaactgcagtcgagcatgtatacatggctcagaccaaacatcagttattttatatctaaatcttgattttttttctagaaaaaaagcggactaaaaaaaacatgattaataaaataactagccgttaacgccttcaattccagaatccccatcccaaacgtctcaaaacctcgtcaagaacctgaaaccaaaaattctctctcgcctcgcgcgaaatctcccgtcgatccaccgcggggacaagctctagatctctctcctacgatccaccacgcggagaagctctcgatctctctccttcgatcgatagtttcgtcgcgctaagtcggtggtgatctgatctccgcgttctttcgggggagtttcttgctaggtttttctgggccgagctcgcccatggaggcgccgggctccggctcggtcccaacggcgaagcgccgccggctcgtgccacggcctccgccggtgccgcttgaggtggccggcgcgaggggcccgtacatgccgccgctatgtattaaatccaagaacccgtccgcgaaatgctacgtgagttgctgcaaatgactccccttttcttagcttcttcccccaagttgaattcttggatggatttccgtccgctcgttcgggcctgatggaatgtgtggaaggaatccgttgatgccgcaattatggatgttttaggacttaggaggttctcgatgtcgttcttgataatccgagagatagatttgctctgactcaattttagatgattcgctgattcttgatgtctgcagagccaattatattggtctttgttggcttgttttagatgttgaaattttgtagaggaatctgtgatccgtgccccaatcctggaatgaggaaatgttaatgatgtgggaatataattgatcatg

SEQ ID NO: 8061 - DNA, 1501 bp, Oryza sativa
agcatcaacatagacaagagaacgcaataatattgcgaccgacagctgtaagaaacgaagaacaaacggtaatagtgaaacgttataccccgagaatggccatttgctggagtttgaggtagtattgcctctgttgctgttgacgggaggctccttctccttgtctccagtgttgttgttgtcgccggttatcgacatgttggtgaagatgatgcagagcagtcgcgcttgaagcgctacccaaaaacttgatcgcccgcctacccatgcagattctcaagcggacggagtttcggaggcacctgctcgttccgatcacccgtgcgcgcgggatgaacagaaccgggaaaaagagagacagcgtaggaacagaagaagagtatcgccaatgaacaatagcaggagaaagacacactcattgagagcctctaccttgcgttatttatatagagagagatctccattatcacacaaataaatctcatttgttgtgaaggttaccataaaataaatcttatttgttgtgaaggttaccacacaatgaatctttcatttgttgtgaaggttacaacaaataaatctctcatttgttgtggatgttacaacacaatggatctctcatttcactacaagatatgtgtggctttttgacgtatttaatatgacataggtcataatgtcactatatcatctaatttatgacattttattttaagcacttcaacttaatgacaataaaaaattgtgtgtcacaataagtgtcatatagttagtctaacgtcgtcccgtgacaatatttactatgtcataagacctatttatgggtcacaaattatttattgtactattttcaatatttttatccatgtaggcgagccttactgccacatcagtttttttattcattttcagatggtccaacctggtgctagcccaacagccgcgtacccaaaatgggccaacccgtgcgcctaactcagcaaaatagctaaaaattgttgggcgctgggagtcgaacccacgagatcctgattcagtggtggtgtgcaaaacactaagctgcacacgatgttttgtttgatattgcatattattttatatatcacgtttatatcttctaaagaaactaatctaacacgcctccaaccttcccacttggcccataccgcactcctagcgagtcaagaagttcattttgcctccctcctctcaatttatttcaaaatattaaaactttgaatcgaattttatcatactaaacaaacttatgtgaaaaagttgtcaaaaacaaagttgtgtaacttattgaaatctaccaattttattttggttatttctccatctgagtttgattgatctatataaaatttgaattttaaaatataagaaattcaaatatttttttgtgtggtaaatgatttcaaatgaaaaaattgtcaacaacaaagttgtatatcttatcatgatctacaacttatgttttgctcattttgctatatga

SEQ ID NO: 8062 - DNA, 1501 bp, Oryza sativa
gaacgacttcaactgaaaaagtcatcaacaacaaagttgtataatctatctggatctacaatttttattttggtcatatcttcatctggcaaagtaatagtaacattgttcacaaaatttacaaatctctcttatagtttataacaccatataagagatatgtaaattttatgaacaatcatactatcaatttgtcggattaataaatgaccaaaataaaaattgtagatccagatagattatacaactttgttattgatgactttttcagttgaaatcatttaatatttgaaaatgttatttgaagttgtcataatttgaaattcaaattcaaattattgaaacaaagtcatatagcaaaatgagcaaaacataagttgtagatcatgataagatatacaactttgttgttgacaattttttcatttgaaatcatttaccacacaaaaaaatatttgaatttcttatattttaaaattcaaattttatatagatcaatcaaactcagatggagaaataaccaaaataaaattggtagatttcaataagttacacaactttgtttttgacaactttttcacataagtttgtttagtatgataaaattcgattcaaagttttaatattttgaaataaattgagaggagggaggcaaaatgaacttcttgactcgctaggagtgcggtatgggccaagtgggaaggttggaggcgtgttagattagtttctttagaagatataaacgtgatatataaaataatatgcaatatcaaacaaaacatcgtgtgcagcttagtgttttgcacaccaccactgaatcaggatctcgtgggttcgactcccagcgcccaacaatttttagctattttgctgagttaggcgcacgggttggcccattttgggtacgcggctgttgggctagcaccaggttggaccatctgaaaatgaataaaaaaactgatgtggcagtaaggctcgcctacatggataaaaatattgaaaatagtacaataaataatttgtgacccataaataggtcttatgacatagtaaatattgtcacgggacgacgttagactaactatatgacacttattgtgacacacaattttttattgtcattaagttgaagtgcttaaaataaaatgtcataaattagatgatatagtgacattatgacctatgtcatattaaatacgtcaaaaagccacacatatcttgtagtgaaatgagagatccattgtgttgtaacatccacaacaaatgagagatttatttgttgtaaccttcacaacaaatgaaagattcattgtgtggtaaccttcacaacaaataagatttattttatggtaaccttcacaacaaatgagatttatttgtgtgataatggagatctctctctatataaataacgcaaggtagaggctctcaatgagtgtgtctttctcctgctattgttcattggcgatactcttcttctgttcctacgctgtctctcttt

SEQ ID NO: 8063 - DNA, 365 bp, Oryza sativa
attcctgcagcccatcttgagcttgatactcgaaatcctcgcactgcgggtcttcaggctccaaaactacacgcgaaatgggacaactcaacaaacggcgaaaataaagccctattattgacctctaagcatgccattagatagatctcgagatttgagaaatttttggaagttgaacggagtcaaacggatgtacggttgagaagatattgaatttctacgattattggatttttgtctaaagggaaaaggatttaattaaatcctttttgaaaaagaaagggaggagggaggggtattagacttccctcgggcagctagggcgcgacccgagagaaggggcgcggctcggccgagctaatggg

SEQ ID NO: 8064 - DNA, 1501 bp, Oryza sativa
gtacttactcagtagactaagggtataattcaaacgtttttcctttgggtttttaggagagggggtacgactttaaaaacaatttgacctgttacgactgtaataaggcttggacggctggctcggttttggtgcgtacatatgcacttttaagcctggttcagtttctaactttttcttcaaacttttaatttttctattacatcaaaactttcctacacatataaatttccaacttttccatcacatcgttccaatttcaatcaaactttcaattttagcgtgaactaaacacacccctactctctccgtttaaaaaaaaaacttaacttatagagtttaaattttcttccacacaaaatcaacttctattatcctacctatcttcaatatataaaatgagatgttttattccttagataccctttatctaccaattaccattactacttttttcaatgataaaggtcattttggtcattttcactcctcactaaatttatcttgcgatgataggaatggttttcttttttttttttttttgggcggagggagtattcggctaggagtaggcgtagcattcgatcgatttgttcactgaaaacgtccgttcgatgttctttcggacatcgatacgatacgcggcggaaagaagctactgctacacagccgacagcctacagagtccaaacatgtaaaaaaggggctcgtgaccgacaaggtttcctcggctttccacttgggcgagcgacgtcgtaggggaagaagaaaaaaaaaaggatcgatcaatgcgatgcccaggtgggtcccaccgacaggccgggggaaaaagggtgacgcgacgggtttggaagggggggtcgcgcgtggtccggggcaacacacatgttgtcaggttccgacccgtcgctgccgcggtggagcccgcacgcaccgtacccgtgcgtcgccgccacgccccctcgcgtgcacaatgcacatgcgcgtttttactgtactcgtgttgctgctcctcctccggggcgctgtatcgtcatgtgtatttacagttagggcatgttcaacgcggctctccaggccgtgtccctggctcacgtcgtccgtcctcgtccctttttcacgccgtgccgtgccccagccaggggcggaggtagaacgaaattgagggggttccactcatatattttagtctattttagattgagtttagcttgatacgggtgcctaagtttgaatcgaggaggtgtatatatggtgaaaattgataaactatagctaaaaaaatttctgaaccgggttcctgggcacccccttgatacacctagctccgcccctggccccagcaaaagcgcgcgcccctagtagaggggcgcggctctacgagtgcctggattgggagattgatagaggaggcgcgttgggtgggggagtagcccaaggacaccgctctgtcctccggtttttctccttccaccctcgtccccttccaccagcaacggca

SEQ ID NO: 8065 - DNA, 1501 bp, Oryza sativa
tcgcatgcttgacaggcgggggagtcgaggcggcgtaaatagcgattctgggcatggtctgaccaaacccccgattttcgcgccctaagtgcccccatcatcagcgtggtcagtggcggtcaaatcgccattttggctaatgtgccatcctggttgccgccggcaaccgtctggagtcctcgtcgggcccacaacctcggcacggtaagtcgtgaggcgccacgtcagactgccctcaggggaccaatgtccgacgtggtgccgggggctactgtcggagatatgggcccgggggtatgcaaagtgaggggaagttaccttcccatccagccacgtgactctacagtttggccctccccccgcgcctcgggagacgcaggggcagccagggggcctcggggtgccacatcacgcccctcgggcccccgcgctgactcgccctgaggccctcgcccaactgccatgtggcggggggagcgagcggggaggagacccaagccaagccgctatcaatgcgcgcggcgccccaactgcccctcaccgcatttaatgcggtaagggcagacatgcggtgccgcccgactgatgcacgtcagtcgggtctgaccagtctgtgaccggcctgtcgtcggtcacatctgactggacaggcggccgtgcccccacgtcgcctctgtatccggcggagtggaggtaggtatgtcctgtcacatcggagcatcatccggagttctctccccgtaaggagggcagccacaagtctccgcccatttaagagtgagtgacagggctgtcccccgtgtcaggtggggggcggcaccgggtgacactgaagggcggaccgctttttagcttccgggcgaaggcacgaatcgcggtccggtcaaggtagagtgggtccccctcccgtagaaagagtaggtagaagcggtgcatgtggtatccccttgaactataaaaggaggaccttgtccaccgggaaggggaacgccactcagtaggcctgaactctagggaaagaagagcgagagtgctctccggagttttggaacccttgtaacactcgaccataatctcacacacaggagtagggtattacgctcgatagcggcccgaacctgtataatcttatcgcccatacgcgattagcagcattcagggcggatacgcaatctcgaaaagcgagccttttccctcggccgaactcacaaaaggggatctcatgatctcccgctggagaggatcactcctcgacaaccggtaataaaaggtgacccaaagaaaaaattactctaaaaaaatgaaaaagaaaagaaaagaaaaaagaaggagaagagatcacagcagagcacgcacgtagcaacacagcaaagcaaaggcattcgatttcagagacgcatcttcgctttttgcctcggcgtcggtgctccacggcggcggcggcgggggcggcgccggagttccaccgcgcccgcctacatccgcgtgtgtgagagagagc

SEQ ID NO: 8066 - DNA, 1501 bp, Oryza sativa
ttagggaaattttatcatcaaataactgtttagtaggatcatcagctggattgttttgtcgacgcctctctgttcttgatctttccagattagatggaccagcagtttcattggttatttcaacattattaatcccacctggcatagtgcttgatctggggaggcccctgtcatctacaaaaacataatgatggtttgaaaaatatggatgacaacattccttttattttacactatcataacttactgaacaaagtgagattaaaatgtatcaacaaaagatatatttgcactatgatttgaggtttgctgcagtaaattatcctttaaaaaatgatacaactataaacaccactgcataatcctattgaacacaactcacaagccacatggtacaactaagcctagcagtgttaccctgagtagtgagtagagcatactttcacactgtgcaatggacctacaatattgtgtaataaccagagctgaagagcacaacctgcttgacagtgtaaacaaaattacaataagtttagttcattggggtttcgatgtaatctaaccctccaaaacggcttcgttttgtgaagagatttgagaaaaccattattcagaaaggtaaaatctaggagaaggcaggccatcacccactagtcgtggagtcaacgcctaaaattagcactcaacacagcaccaaacccccacaccaaaccctcacacgcagcattcccagcaaccagcgtgacacagacagtgaagcagccatcagagtgtccaccaacaaggcgaaggtgcgctcgcaactagcagccatccacatgagcggagatggcagaagccgccgcagatttgggggggcgaagctgaactagggaaggcaaagcaaccgccaccaatcccaacaccctaggttgcctctcgcagcaaagctacacgaacgaagacgaaaggagagaggcaggcggggtgtggggggtacggatggatggatcaccagcgggggaagacgacgaggccgcggccgcggcggaggcggaggcggtggcggtggcggggttgtcgccgccgttggcgctggctcctcctcctccttcctccacgcccttggcctcctcggcggcggaggccatttgtagccgctctctctcacacacgcggatgtaggcgggcgcggtggaactccggcgccgcccccgccgccgccgccgtggagcaccgacgccgaggcaaaaagcgaagatgcgtctctgaaatcgaatgcctttgctttgctgtgttgctacgtgcgtgctctgctgtgatctcttctccttcttttttcttttcttttctttttcatttttttagagtaattttttctttgggtcaccttttattaccggttgtcgaggagtgatcctctccagcgggagatcatgagatccccttttgtgagttcggccgagggaaaaggctcgcttttcgagattgcgtatccgccctgaatgctgctaatcgcgta

SEQ ID NO: 8067 - DNA, 1501 bp, Oryza sativa
tatcataaaccacattaatttacttaatctgatgttatctagctatcttacacgttattttttttatcatactaaattcccacagcaatgcgcggggattcatctagtttttattgtttatatgaccagatagagtagcttaggatgagtgatccaatcaataccgttaaataagtttttcaggaagaaaacgtgtttttataaaaccttcaagtaaataattcatgacgataattggacgaggtactccattattgctcgtttttttccccctcctcaggggatctcgtctgttccagcgaagttccggttcagacggctagttccgctacgttgcgtcgcgcgacctttgagacgtgagcccgtgaccccaaaccgcagcttaaccgaaggcgcctgacgcctcgcgcgcgtccgcgggctcgcgctgcctgctgtactgtacatatgtgcgtgtcgcgcgcgcgggggcggccggcagcatcagcatcgcgtgacgtggtgtggactgtggagctgatgccgcggggaaccacccaggccaactttggcaggcaggggcggcgaccaggtgctcccacgagaatctgtatcagagcaaacggcggcggcggcggcggcggcgatgccgtgctggtgtctcgttgcaatcaccagggcctcgaccgtcgtatgctcggctcgcacgactggaaactgagctgatccgtcccttactatactagttactggcagcttgacaagtttgacaccagcgaaataatcttgccttggatatgcctgtccatgcacaggaaaaatgaacggagtaggaatttattccctcaccataactagtgtgttcttttaagggcaacaccaatgtataaaattgaagtgagcattagtgtcaggttttgggtcacaggtagtagttgtacgcaggcagcacaatgtgtatgagattttaaggtggggtccaccaataaaatattctccacctgtttccaaaaaaaaccccccccattcataagtaaagatactttcatcctgaactctctgtgtctcgattgtgtaaacaacattatttattcccttgctatcggtagtaagcatactacccggtactacttatttactagttccacaatggctattaccaggttgtagaggagcattgaatgcctattacctgatttctcaacacattgtggatgccctaagacgatggaagtggaagagcatcccttagtgtataattcatgtgagatactagtaaagatgggacccatatcaaccatagtagatccttagcagcctgagaaaattgttccatcgtacaaaaggtcccatcgtttggcttattcgccaaacgatatatttgcaaacaaaaagtaatttataaataaaacttatatacgtgttcttagcgacctaaaagcaaaggctgaaaagtaaacttcgatgaaaaaaccctaaaatcaacgtcaaatttaaggttgaaaatttagattttagctaa

SEQ ID NO: 8068 - DNA, 1501 bp, Oryza sativa
gtgagactgagctatttaacctgttttaaaatagttgaattactaagtgaaagtccctaaacaagacagcattttttttttcaaattcgagcttcagtatgtactgtatttgttacttgtcaacacaaaattgaaagaatatcagtgtagatgatgccctttgccaatggtattagtctgatttccacggcaacgactttattttctctctgagaatataaatctaaagcaataagatgttgagaaaacaacaaagcaaagaattttattcctttcttcttactaagggcatgtttactttgatgaaaaaaaacattaccaaattttagcattgacaaaattttagcatatttaccaaaattttggcaagatttcttatatagttaccaaaattaatttggcagcaaattaaatacaaccactattttggtaactttaccaaaatttagtaaggttaaaaatggcattaaaatgaacatgctctaagatcatcggatgacttaatatattcgtgacagcttgaaacaacaaattagcaaggttcattgcatttgacaccgatggaacagtagaatcgtactggtacaatttttttaaaaaaggaactgagcaatggaaacctgccgaagaattacaaaagtaatgctacaaatgcaagatccaagatttgtgattggccgttggacaagcagaaacgttaaccttcttgggaattgaacaaccgggctgacagccaggctgatcacatcaacagatcaaatcgactttactgtatcagtaaaagaaaaaaaaatgtttttcgagtatggattaatcagaaatatttttacatatacagatatactccgtacatgtcgtagaggatatcaaacgaaaaatgatggagacattgagagcaactaatttctgtcgagataaatgaagtagactccaagcttacgtacagtgcaggccagctgatcgaaacgcctaatttccgatcgagcagcattcttatataaattgcgtacttttaaaatcttttgatattgatataatttgacgtataagttaggtatcgcgtatagagtaatagcaagcaccagctggagaaaaagctaaggtagttcttgcgtggcaaaagggtacgcaccagaagaactgaactaacttagttaattaacaacggatgtgcttttgttggagaagggtatcttaaccggttaattaattatgtgttggtgctgctatatgttgagacatagtaaaagatagtaggtacaatcgatagatcatcatgatggatcaatgcaatgggttgcagattagagcaacctaaaacgctagcaatcgattggtcaacgagagcttgggtgatgtacgtatgtacgtgctggagtaggagaggaaaataacaatatcatgtgtcgcgctgtttcaggatgattacatcagatggaaatattggactacatgaatgcatgactgatgacgaattaataaaatgaattaataaaatgga

SEQ ID NO: 8069 - DNA, 1501 bp, Oryza sativa
gaggggaagatgccaccgtgtcaacccaagtatgcataaaaatggcgagggctatcatgcacatgaaaagtcaaaaacacacttgcaatagcattatccgacacaactcatcactgattattcgttcaataatagcatcactcacaagcatacaagcatacgtttgttcctttaataatgtttgcataatcatagggtatgtttggctagccaatagagccgctgcacgcagccataactgttgcagctacagacacaaacagtacactgtttgtgttggctgcacaacagtgaagttaagtgcagccgaacagagccaaaatcaacaattaatagtatcattttttaaaagacccaattactccgtcagacagacagtagcatgaaacggaccaaaggaagcagacttgcagaatagtgacattagattgatgaaggccaggagcagaagtgcgtgtgcgtctgtggtccgtccgatcgggcatcggacggtccagatggcgcgggaggttatggctggcgtcttcgtgcggcggccgcaccacacccacccgttgcgttgcggcggcctctctctctctttctctcctctctctctgcggctgcgcggtctccacggcgcggcgaggcagcggcggtagggatggtgggctcggccgcgtactccgcggcgtcggccatcgtcgtggtgatggccaagggcaaggggcggggcggctagtatgcggcctcctctggcgccaacaaggtcagctcattcctcctcccctcaggtaccaacagtttgggtaatgggtacagtatgatcgaattcagcgcggggagtttggattgaactgaatgtgcctgtgaatgaacattgctgcaagggattagaggaattatcagttacgaatcattgcttcacaaaattctggggcacccacatggaaggggaaaaacggctgctgtgcgtgctcaaccatgcaaaaaaaaaagagttattcatgaggattgagttatgttttttttgttgttgtattaatcagaacatttagtgtggtacattctcaatttaatagcacatttgttggattatcaacaaatggaagatcttgtattggacccatgggtaacaggtcggctttatggctttgcgtcctcacacatgacacgctgcctatttatgtgtaggtttctgagcgacggcctcctaggataacttccaatgtgaagcagagcttgaggattctaaaattttggaaggtgcaagctttgttgcattaccttttctctcatatgctaaaatctgtgatctactctgctgcactttgtataaagtcgtagaacagcatgtaccgaattcatcaggtgggtatggccaaacaggggcacccgaagcatccaagattaatcttagttctaacagttatttacccttgtgtgtgccttttgtattcttaagcttagttctaacagttatgcccttgtcatcaggattatgaaaggaggcaaacaagtg

SEQ ID NO: 8070 - DNA, 1283 bp, Oryza sativa
gcataataaggggtggatattcaagatagtgctacctctaatcgctaaattttattttataaattttatcaaacctgagaagagtcaaaatgacttattatataaaacagagagggttctatagagtaatttaaagtcacatttgaaacagattgagagttaaatgatggatgacggagtaatagcttggaaaaagcaatgtaatcaatatcgataaagaaagttttagagagttaccataaatttggaagcgtgacacaaatgatatatccgctagataatcaacattctgttgctggcttagcatctaattatctgcttcatctgtttttaaatatatgatgctactgaattttggaggtaacatttaaccatttatattattcaaacatataatacaaaaaatgcaaagagaaaaagggcacatttaaatacatctaatggtaaaacaagtccataaaataaatgaaaaagggataaatgttgaaacatcatattcataaagtcaacatcacgatcttatgttcaaaaacggagatagtcttatcttatcgtatataggtaaagtagcctgtttggcacagctccagctccagctccacccctcctggagctggagctcaaccaaatagtttcagctctaccaaaactgggagtggagttgggtggagctctctcacaaaatatactagagttatggagctgggtttagacagctccacaactcctctccagtctcaactcctggagttttatttaggagttggagctgtaccaaacaggcccgaattgtcaaagtctccaaaggaattattaatgccgatctcgcatgaaacatgtgcgtaaaaaaatttcgtaggaggccgacgggcacgaaagaggcccggcccaccacgctgctaggtgggcccacacatgcatagaccatagcggtgacttgtgcggcgtcgtgcaccccgcaccaccggcccacgtgccgcgtcccaccccaatttcatttccgtatccaaatgctccgcctagtagtaggagtactagtttaggtggactcgccactcgcctctccgactccgaccatctccgcctccgccgatggacgcccacctcctcctcctcgcgcgcccgcgagccctagccctcgccgccgcgcgagcccccggtggcgtcgccggcttcaggcggcccgcctcggcgcgccgggtggccccgcgccgcgtcgtacttcgaccggtggcggcgctggggggtggtggtggatttgcggaggtgggggagctgttcgg

SEQ ID NO: 8071 - DNA, 522 bp, Oryza sativa
ccatcgactgattccgagatgctgcagccgataatgattctaagccgatgacgtctttgccgattaccaaatttcactgttaacagcgaggcgacatctatatcaaatttttacaaagcctgaatagttagttttactggttttggtttatttataggtgttgttaaagtgaggtttgcattaagagaatgactttagaccaacatcataatgtcctccaaagtccaaaggggaaatggtaaagggaaatagggaaaaaaaagagtaatatatgaaaatggggaaaaataggaaatttgtagcaaacaatagatggaccagacgggccgtgccgtgccggcccacggggggaggcgtcggaccaagcacggcccacaggccagcgtgccttgccatgactgggccggatacagtaccgtcgtggtcggcccggcccagcttagcacggtccatttagcctacaatacccctagccagttgccactcccgtcccaaacccttccccgaatcactccaccgaaa

SEQ ID NO: 8072 - DNA, 1501 bp, Oryza sativa
ttgtcaattggttgagatatagttcactagtgcatatattaatatttaacttcgcttaaaatacattgataacgggtcaaaacaagaggtgtacctagaaatttttctagtgcaaagataaaacacatataagctagcaatgcagactataaaacccttgggacaaagagctagcatttgaatctatcaaaggtgagccaataagcccaatagaatgtcaagggtcaccgagcagtagatctataaatgaaccaaatcatagagaactcaatgaataaacgcccacataaaaaccatcatgtatttgtgttcagcgtagtacagaataactaggataatcaaccaaagcaaagagatagttgccacatcaatagacaagcatcggggcatatgatatgggttgttacttctattgttgtgaattatggacctaaaaaaatccataatatccacagagataaaatgatgtagcatatttattaaaaaccatatggttccttttattcttttgttagcttgtatgtcctagcacacgtttatcttgtttccatgatggcatccagcactagtttaacatgtccctttcagggttgtcacggattgcaaacgatttaatcacttaatctcctcgaccattttttccctcatagttgtgatgattagttcaactttgatttatgcaatattcaccgtttatcctagaactaaagaaattattgtgtgtattttgtatatatatcccaactaataacatcctcacaagttgtttgcttgtttttcaacattttagtgaaatttagtcggattttagtatatgtatcaatttgatatgggagattcatgtcccggccatcttcttctcaaagtctctaactctaataagttcatcctcttttccggtgagcgactactggagcaaagtttgtaatgaagttagacttatacaatattaaaaggagacgccaaaccagctataagtacttgtaatattaaacggagcaattatatttgtggattatagctacaaaaagataatccgaattatatagtttcatcacaattaaatagaaatttaatagtactgctggattagcatagccagtactagtactgatgaaatcagtccgacaaggcatagacatctcttggggacatgtagcaatttccagtcatttgcccctttgaccttggtagctgtaacgcggcgcccagacatagtcgcactagctctcgcactcacatgcgcatccgcttcatcaaagcaaaaaagattaaattaattcggtgataagatcgattccgtctagtaatccaagctgcaattccgattgattaccttctataaatacctcaccccacccctgagccctcccaaatccgagcaaatcaacaacacacgatcaatcgatcgattaatcctctcgagtaatcgccttgaaatcatcggttgatttcttgcagagattaagtagcagcaggtgttcgtcgagccgagcggcga

SEQ ID NO: 8073 - DNA, 189 bp, Oryza sativa
aaagaattcatcaattctgccctgccgcagctgcgtcctataaataccctacacgcgtagccatcttctgcaatcatcaaaacacctgtaatcatcttctgaattcatcaattcagagttcagagcagagtgtccctgcttctgtgcaaggagagagatcgagctatagagctagcctggctgctgcca

SEQ ID NO: 8074 - DNA, 171 bp, Oryza sativa
ccgccccgcccggatcgctcgcgatcacgatctcctcctctcgatcgaacaagaacgccactcgcatcgatcaaggggatgatgattgatttatcaactggaaagccgcgtgcaatgcaacgccgcgcggcgaatcggcggtcaaccgcctcgatcgatcgcgctcgaagg

SEQ ID NO: 8075 - DNA, 938 bp, Oryza sativa
atgcgtaaatagtttattctcacatgcccttcactacatgcatattggataccactagaaaggataccggcccgggccttccgctcatctacttcttccctttcctgccaatcatcggcatcccctgaatgtactggtcggcgtcgcctactgcttctgcttgtgctactcttatgttcgggtttgcaataataatcttacttacctacttatagttattatctatgttactgttactgtatgattatgtaaacatctaccaataagacaataatactccctccgtttcaaaatgtttgacaccgttaactttttagcacatgtttgaccgttcgtcttattaaaaaaatttgtgaaatatgtaaaactatatgtgtacatgaaagtatatttaacaataaatcagatgatatgaaaggaataaataattacttaatttttttgaataagacgaatggtcaaacacgtgctaaaaagtcaacggtgtcaaacattttaaaacggagggagcagaagatatggcaccagttccaggcttccagaagctcaagagtgaacttttctttcttccggcaaattttaaagtgcaacaaaatgtggggaaatcgttgtaagctttcgaggaaatgtccctttatttgttcaaacactattcaaatagttgttaattttatttttaaaaaatgacaacattcataccatttgacaatgtttatctttctttttttagaaaaaaatacaagttcttaaaaatatgtcacattatataccagttgcatcatgtattcattttggtctaaccatttaaaaaatagtcaaagttaaaacggtaaaagtcagtgccaaataaatgcaaacgaggaggtaagcacaagtcaaaaatgccaaataaatgcaaacgaggttgtatgaggtcttgtttgctcaatgtataacta

SEQ ID NO: 8076 - DNA, 1501 bp, Oryza sativa
aattttagtaatggagtgaaatgcaaaatcctttaaatgtagtatgttgcatttgtcttggtggaaaccggtccaaatttcaatattttccggcttgttgaaaacacaaaccgcttggttttcggtctagttcaaaaattttcaaactgaattttaagttttgacatgatttatcttgatttcattttctttttgttatcaactgtttttacaaaatccaaagataccactcgtgagaggttttgatccaatatcaaaattgcgaatcccaactcccggagtggaatgaaatcatgcatcaataattccatcaaggtgctaaaggtgtgcattgtgctttcctataaatcattttttttgaacgaattataaatcattttttcaatcgatcactaatgtaccggaagtgttctcacctagacgctcaaaggcaactcgtcaccaagaaagccatcagagttaaacatgtagtcattccaagagagacggagtataacaaatatagtacctcatctgtctcaaaaaagaaattttacatggatgtgatagtatttgctagtactaggaagtgttatatcccttcaaaatctctcatactccctccgtttctaaatatttgataccgttgactttttagcacgtgtttgaccattcgtctcattcaaaacaattcagtaattatttattcctttcatatcatctgatttattgttaaatatactttcatgtacacatatagttttacatatttcacaaatttttttaataagacgaacggtcaaacatgtgctaaaaagttaacggtgtcaaacattttgaaacggagggagtattattgtcttattggtagatgtttacataatcatacagtaacagtaacatagataataactataagtaggtaagtaagattattattgcaaacccgaacataagagtagcacaagcagaagcagtaggcgacgccgaccagtacattcaggggatgccgatgattggcaggaaagggaagaagtagatgagcggaaggcccgggccggcgtagggcggaggggtggcgcgcccggcgcgcggcgtcgccctgcgcgcccgcggcggcgcggggctctggacgttaccggtggctgccgccgtcgacgacgctagggcgccgccgccgcacctcgtgaagacggcgaggctgcacgccagcgcgtacgagccgtgcttctcccggccgcccgcggcgaccacgggcgcgacggcgagcccccccggcgcgcagagctgctcggcgccgccgaggaccctcgccgcgcaccgcgggtggctccgccaactgtcgacgtcgtctccgccggccgccggcacggccacgtcgaagcccccgcgctcgtccgtctgcgccgcccgcagctgtccaacgccgccatcgccgccgccgcatctcaccgccaccaccacacctgcagccaccgcgcgcgacgtcacgatcgaccatgtctgcccggtgcgcgcgtga

SEQ ID NO: 8077 - DNA, 580 bp, Oryza sativa
gatctatgatgttgagagtataatgaacagcaacgcttgtgtgcatgtgttttttaaatatgggaagattaaagaccaattttttagaaggagctaagagaaaggacagtttaacattaaaatggtgcatgccggcacgcacatgctgcaaggcgaatgcgtatatacaacggcctcttgcagtaggcagaaaaatttaagctggtcaagctttcgaagtttggtcttaaaatttgacaatgggatcaatcaacggattcctttggcgtatcactgtctggaagtgaatctcaatttgattatacgaatttagacatgacaagacataatcaatttcacaataaactttaatttaaacaactcatttttgtaaaacagtaaagaaaccatataaaaagtgataagttgataagcaataagttgtacctgtacacaagaatagatctaattaacatgtgtactatgggctcccccccccaacccccacccccaccccaaaaaaaaattgggggatccgccccagttatacatgaaaaatgttttgagcttttgagttgataagttgagaacattgaacagg

SEQ ID NO: 8078 - DNA, 1501 bp, Oryza sativa
aatcacaaatcttggatcttgcatttgtagcattacttttgtaattcttcggcaggtttccattgctcagttccttttttaaaaaaattgtaccagtacgattctactgttccatcggtgtcaaatgcaatgaaccttgctaatttgttgtttcaagctgtcacgaatatattaagtcatccgatgatcttagagcatgttcattttaatgccatttttaaccttactaaattttggtaaagttaccaaaatagtggttgtatttaatttgctgccaaattaattttggtaactatataagaaatcttgccaaaattttggtaaatatgctaaaattttgtcaatgctaaaatttggtaatgttttttttcatcaaagtaaacatgcccttagtaagaagaaaggaataaaattctttgctttgttgttttctcaacatcttattgctttagatttatattctcagagagaaaataaagtcgttgccgtggaaatcagactaataccattggcaaagggcatcatctacactgatattctttcaattttgtgttgacaagtaacaaatacagtacatactgaagctcgaatttgaaaaaaaaaatgctgtcttgtttagggactttcacttagtaattcaactattttaaaacaggttaaatagctcagtctcacttttcccttacaagtacaatttaatggtatctcaataaatattaagggcttctttgatttggaggaaaaatatatgaattttgaaggatttcaatcttacatgaaaaattcatataaatcactttgaaccatatccaatcctattagcaagagcttaaagcccttagaaaattttcttcgagtctatctctctcatccgaattataatgtattttatatcaagagttatcaatgagaaaaaaaaacaaccattatcattgtaactaaaccctaaaattcgaagccaaaataaatcttagatcctcctaaatctaaaagattcatttcactgctagaacctagaaggtctgtcatctaaaataaaacagaaatggttgagcctttccttttggttaacggaggaatagggaaagaaaaccgctccaggtgagccgccgtgcggcagctagatcacagggccgcaaacaataattcgcgatatttccttcaagtgggccccaccaccttcgtcttccccctttcctcagcctcctccgcgtttatattccccgtccactccgccaaaagcccctcttccgatcttcttcttcttcccccaaaaatctaattaaaatcccctcccccaaaaacccctctcacccgaatttcctcatggactcggtgccggccgccggagtcggcgtcggcggcggcggcgcgggcgcgggctacccggagtccacggagtcatccccacgcagccggggcggcgactcgtgggacgagcccttcccttcctccgccgcggcggcggccgcggctgccgggggagggaggctccgcctca

SEQ ID NO: 8079 - DNA, 1208 bp, Oryza sativa
aaataagagaccatcgcagatccgactctggtctaggccagttgtgtgaccgtctaggacccagagcgaagggagctcatcactaccattccaccacccccagactcaacaagcctcagctagacccagacgcccaattaaatgcaaggtttgactgtgttgatttgttgcttctaagagcatctccaatcgtatctccaaattagactttccaaatacctatatggccaactcttcaactaatttgggtagtcaaactaggtgttcgctcaaacagactctctatttacatctccaaaatcataaagggacccacttgtcagcctccattcccttcttcttcttcttcttcttcttcttcttcttcttcttcttcttcttcttcttcttcttcttcttcttcttcttcttcttcctctttctctttctcttcctccttctcttctcccgcatcggcccatcgatccatcctcgaccgcctcgtggcggcgacggctcccaggtggcggcggcggcgacgtcttcccgcgcgtgccaagtgggaggcagtggcggcggtgacggctccctgcggcggcaacggctcatgcgtgaccgtggcgcggcggcaatgacgatgactgccgtggcagactgtggaccagacatcaacgacgccctcggttcacccctgcttgcagcttgctggtggagtggtgggtggatgggagagagaggaagtatggtgctgggagtggtggtcggacccatctttggccagtggaggaggctggctacatttggctagccgaaggagcaatttagctatctggatggagagtctgttgaagcttgttttttttcatgtattggctaaattttaacttggagagctaaatagagagtcttttggagaggctctaacccgggatactagggcaggtgacagaagtgtccatagtaccgcccctgaggaccgcgtggtggtggttttttttaggggggtggggggtggggcgaatgtgacccgagcactgtccacgggccatgctcaggggtaggtgatacaatgccctgaaatacccatttatctaaaaatgcctatgcctatgactaatgttaaatcatgcacaatgagaattcactaccgtacgcctcaaatatttctatgaaaattggtattgttctctccggtaaaaaagaatatcttgtactttatggtttgataa

SEQ ID NO: 8080 - DNA, 1347 bp, Oryza sativa
cccctcgaccaccggcgcaagcctcgtgttgcggaagaactgcctcagcacttgggcgatgagcttgtggagcgagacggggaggaagtgcagccactcgttgatccctccctgcggcctcgtcacacgctgcaagccaaaaaaaaaaacagagcaattcgttcaaaaaacggagagagagaaaaaatcaacagtagagcaggaacaactgcactggggtgagagagagagagaggggggaaactgacgtagagggtcaggtggtcggcgaggccgagggcgcggacgaggccgaggcactggttctcggcgccgggggagccgttgccgatgacgacggcgcggcggacgacgacggtggcggcggcggcgccggtgaagatctcgggcgtctccatgccgccgacgccggggggctccggcagccggatcggcctcatcggcctagggttcgccggccgcaggccgatcccccacgaaccaagccaccggatgctccggcgaggatctccttctcctccacttcgatgaggaggattcgctcgtggtcggggtaggattggaaggttcgataattcgatgtgttgcgagatgtttggggggtttggtgtcgattcggcggccacagcggttgcgtgtttctgtagggttctcgagtttcaggcagttgctgtcacccactctctcgaattctccagttttactgtactactacttcccagggtcaaaaatatttacagtaccgtttaacacaaaatttcgtcaaaacttttaaaattcaactaacaactaattctatgaaattctagcaactaattctatgttaaaacaaaagttaagtttaagatattaccatcgtactcttataaacaaacctatgtatattatttgttttggttttaaactatgcttttgagaaattataatggtcggaattttaaaggttttatcaaaccataaagtacaagatattcttttttaccggagagaacaataccaattttcatagaaatatttgaggcgtacggtagtgaattctcattgtgcatgatttaacattagtcataggcataggcatttttagataaatgggtatttcagggcattgtatcacctacccctgagcatggcccgtggacagtgctcgggtcacattcgccccaccccccacccccctaaaaaaaaccaccaccacgcggtcctcaggggcggtactatggacacttctgtcacctgccctagtatcccgggttagagcctctccaaaagactctctatttagctctccaagttaaaatttagccaatacatgaaaaaaaacaagcttcaacagactctccatccaga

SEQ ID NO: 8081 - DNA, 1501 bp, Oryza sativa
ttttataaataaacccttaaaaaaattatcccagaaatggttccttttgaacgcaagagtggctggcgccgccccttgccaccgtggcacaatacggcggccagatactgacgtagcagggggagcacgccaaatgatgctccctcccccagcaccctcccagcgcgagtcggagtgttgctcttgctctctctctctctcccctctccttaaatgcactaagatttatcggtgagagactttctgttctttgttgtttttgttttttctatagtcggaaaaaattagtagattcgatttccgtaatcctataaactcttgagccttttttttacatcctataaaaaaagttagggtttgttgagttcatttttacttgttatattcgagtgtccttccttaaaacatatataactttttcatattaactcggaatcaggcaaattatatatctacggacatctatataaaaagttcatcctattctctctgcttcgtcgggttcagcgaaatcagaatctcaaaattccacttggaagattttgttttcgaggtaagaagcttttcgatacaactttgaaaaattctacaagtaacatatttcgtctgtttgaactaattttttctatggtttgttcctatgtgctcctaagtgtgaaaaaaatatcaaaaaattttaaaaaacttggacctctctttcctctacactagtgggtggcgccgtgggtgggaggggagccgacaccaacatggcgcgctccactgccacgtcagcgcggaccgccacggtggcaaggggtggtgccagagaggccgacgccgtcccgttggatagcagtgccagcgactctgacgctcaaaaatgattatttctgggataagttttttagggatctatttgtaaaataagttttcgaaaatgaccaaattatgaaaacatccaggcaatggatctgaacaaaccaagcacaagaacacaacaaaacaaggcgattcttttcttctttttgtcctctccacagatgcaatattcacaatttgcagcctctctctcacacacactgatgactgaccccgccaccttctcgtaattgcacatggctggtctcactgtcaaactggccccacgcgaccagtttgctctgccgtccgtgcacacgtacagcacaccgaataaaatggcagcaacctatacacacacaagagagaaccccattgccatagacaaatagtggcggcaggttcagcatagggcagtgatactagctagtagtggcactactcctttccttttctttttccctccttgagattcttctcactttcatgccgtctcccttccatcgccacaaaggcagtacgaaatttcgagttcctggtctcctggagagggcagcagaaagggagagagtatggagatggcgctaactccattgccgctcctgtgttcgtccgtcttgttcttggtgctatcttcgtgctcgttggccaatgggaggga

SEQ ID NO: 8082 - DNA, 934 bp, Oryza sativa
tccattttacatgccggagaggatgggtttccaaatcctccttctaaactcgccctagccagtcctaattcctaaacatgtgcattcctcactgttttttttttctttttacaataaatcacattcccggaccagtttggccactggacaatcaattaagagatttgaatagttttatttgtgttttctatctttttcgctccattcccttttaaacaggaacatatcatatacacacaagttttctcatgtacacatcatgtacaacaaataacaaactttaccaaattaaattttagaaaaaaatatatatgtacttttagtagcatcacatttatatgtaaaatcttatcttcaaatccattctatatatatggagcacaaaaaagataaaattctgatcgatttataaccttaaaactgtcaatttttttttgttatagctaaaatatgatgaatttgatgttaagactttacccatgagtgtaatgatattaaaaaacacatgtatattttttttctagattcttcggtgaaacttattagttggtgtgtcctatgtgtatacgaaaagcttaggtgtacatgatacattaaacacatagcgatttttattttcaactgggcttgaagcccccaatttttttacacaaagttaatttcttggtatttcatagctttatagaaataattcatggttaaatatccatttctcattatatcccaaagataacatatccggtgaaaatgagttaagcgttggaaacttgtgaaaatcatattttataaataaacccttaaaaaaattatcccagaaatggttccttttgaacgcaagagtggctggcgccgccccttgccaccgtggcacaatacggcggccagatactgacgtagcagggggagcacgccaaatgatgctccctcccccagc

SEQ ID NO: 8083 - DNA, 1501 bp, Oryza sativa
tcacactattttcctttaatatcttacctatctcatcttctcaacccatcacagctatcatttgtttaattttaccaattttcttaatacataaacatgttcaattctagaaaaaatcttttattttgaaccaaaaaacttattttttgtgcaaatgttctttaactagctactagctggaatctgctgcgtgtatacgtgccaatttggccgcggtttctggctcgaacgaacgttcagtacgggcatgtattgggctgagctactgcatgctggagcctggaaaagaataaaaaaataggataatgctgcgtaatttgacatgcttcccgttattcatggaaaataattaatgttacaaccaactggcaatatcagcctggaggtagcgcggcgcagtcgacgtgctcacgaagtcaacgggaaggaggcgccgctgtacgtggcagtatccgagagcacacgcgtgagtcgcatcgacgacgtacgtagcaacggactcggcgcggatcgagctcgtcgcatgggctgctgcttgcgactttgccgacctcattaccttgcgagccggccgggccccagtactgggcctgtggaccagcccaagctgggccggctctagcatctccatgattttaggagattattaggggcaaggaataagttcatccgaggtcccttaaattgtcaacgaatccgattttcgtccttcaaccagaaaaccagatacaatgtgtccctcaactatcaaaaccagtgcaggtgaggtccctcggcggttttgatggcggttttggctgacgtggtgcctacgtggctaatttgtctgggtctttatctgatgtggcaatgacgtggcattgacgtgacgcttacgtggcaattcgatacagaaaaataataaattttgtgggacccgcatgccagtttcacacatgaattaaatataaaatagtggggcccgcgtgggcccacatgtcagctaaaaaaataaagatggtggggcccacatgtccctctcggctctccctcgtccccgcggaggagcggcggcaggagcggaggggcggagcggcagcggcggcaagccacaggcggcggaggtggtcggaggaggaggtcgccgccacatgtgagcagacacagaacgaggagagaatgagagaacagtgggactgggggagtcgggtcgacgagaaatgccgatggagggcaccggtgctggcgcaacaagacggacggcgagaggcggcgtagggagctcgtccccttgcatcctggtgagggcgccgggccggcggaggtggagacgggttcagtacccatcggcggcatggtgtggggaggtcggcggcgtcgtggcgggcggcggagtcgaggaggtggtgggcggcgagcgcaggtcgacgggcggccggtggagggtgccgaggccagtgccccgttagccaggtggcagcgctgtggcggagaagtcgaggacaccgtggctggcggcaga

SEQ ID NO: 8084 - DNA, 402 bp, Oryza sativa
ggactactagaaagtaaaaaataaaaaataaaccccattgataatcatattcaatttttaaatctcaatggcaataaaaatgagaagcagtgggcggggtgtatagtagtatagtttcagagccgctgatgtttgacgtgacttctagaaaataaaaaatgaattccaccgatagttatgctcaatttttagaatcacaatgataataaagaaagagtaggcggcggacgaaccatagaggagcatagtggcatcgtttgacgagacttctaaaaaattataaaaaatgaaacccaacgagacaataaactctaaaaactacaaggttcaatttttaaaggttccgaacttctaaaaagtaaaaaaaaacaatgataatcatgttcgattttaaaatctcaa

SEQ ID NO: 8085 - DNA, 1501 bp, Oryza sativa
tcctgtaatgtaatctttaggtcttattgaatctttctactgaacaaatatatatatgtgcgtaacattcttcttacgtgtgtatttatataacatcctaattaacacttgaattagcaagattagccttattttggttttggttcgcgcatgccctcgacaagtttgcataccaaaataagtgttttacaagtttatatactatattgcacccatctgataagttcttgtatcgctaatataatttactcttttattatttttgtaattctgaccacataactcacttttctatcaatgtctagcatctattttggcaaagatatatcgtgcatatggatggggtaatttgtcggtgcatcggagccgatttgtttaaggttgttaatgtgcatttaggaagttgtttggagtagtctaaactataacgacggtaaaactactcggtctaagaaaaaaagattgacctaagggtggtttaaaatgaacatttagcaataaaatatgacctaaattgcaattcactctataaaatgctctgatctacattaaggctgtgtttagattcaggggtgaaaatttttgtcatgttgcatcggatatacgaacacacatttaaagtattaaacgtagtctaataacaaaacaaattacagaattcatcagtaaaccacgagacgaattgattaagcctaattaatctgtcattagtaaatgtttactgtagcaccacattgtcaaattatggagccattaggcttaaaaaattcgtctcgcaaattagtcacaatttgtataattagttatcttttagccaatatttaatacttcatgcaggtgtttaaggttcgatgtgacagggtaaaaaattttagggtagtatctaaacaaggcctaacacacacaatttgcatatatgggtcccttggcctttgccgtctaatcaaacgtaaaatgagaagaagcaagcatcaatcagaacaataattggcaacagtgccaggacacatacacatcaaacacatacagcaagtcccaatcagcagcagaagatgtcactgtttattttgagaggctttgcagtttgcatgcatcacattctccatgtgatgaagggtgacaaaagaagttacagctaaccatggccaacgtcgatcatccacacaccagggtcacaagcacaacaagcacacaacacagacacatcacaaaagctgtctgaatgattctccagagagccattggctctagctgcagcagagctgagttacctacctatacctagctagcaggcatgcagctaccacctactccattcatcccaaaataaatcaaattcttagagtttaaattttgttcgaaaataaattaattcttacctttttacctacccttgatccaaagatgagaagttttctcttcaacacttcttaacttcccactcaccaacaccaatactatttttctgttaatgaggacaagtattttttccctcgttaga

SEQ ID NO: 8086 - DNA, 1501 bp, Oryza sativa
aaaaaaggaaaaaccaaaattgagcaaagggataaactagattgaagttcctaaaattaaaagaggataaacaatattaaaactcccctaactcgaaaagagggaataaaatagattgaaatttcccgacaaaattcccaaaattcgaagaaccctaatttcaggttagaaccctaagagttaaaatccaaatcaattaacctaaaggtttgggttacttaacggacttaaagcccctaagttcaccggagctttctgggaagcggcaccgtcgcaccttcacctactcgcagtcgccttgggttccccgtgcgcgcgctgacctggagcacccctacactgtccttggcgtcggccctcccgccgacgaggtctaggccgagctttgaaaggagacaccacgttcgctgtggggctagaaattcccacattaattggagaaaagaaaaggagagtccaagtagaaatacaattcaaaaatagctgaattcgggattaaaaaaagcaatatggaaagaagagtccatataataacccaatatgagattaatcaaaattaataataaaaataaaataaaattggaaatttgaaaataaaaggagagtccaaataggaatacaatttaaaaataactgaaattagtaattaaaaataaggaatattgagaggagagtccatataagaacccaatacgatattagttaatatttggaataaaataaatattaaatccaaaattagcaaaaaaagaaaataagagttcaagtaggattacaatttaaaattaactgaaattcagaattaaaaataagcaatattgaaacaagaatccatataaaaacccaatacgagattaattaaaattcagaataaaaaaataaaataatatccaaaattagaaaaactaaaagagagttcaagtaggaatacaattttgaaacaacttaaattcaaaaaaataaaaaataaaaatattaaaagaacactatatggtattaattaaaatttggaaaaaataaattctgaaattagaaaaagaaataaatcaattaggaatacaatttataaataacaaaaattgatgataaaaaataaagactattgaaaaaagaccatctaaaacacacgacgagataaattaattaacaggcctataaaagagtaaagtgcggtggttaatacgacatataaaatttttagtaaaacaccaaacagaatcctaatgatgattaaaaggagggacgacaggcaggccgtgaagcaaacgggtaaggcggttgccgggacttttagaatgtaaaagaaaaaaaccccattgataatcctattcgatttttaaaatctcaatgacaataaaaaggagaagtagcgtgcggggtgtataggaggagtacagttgcatagccgccgacggttggcgagacttctagaaaataaaaaaatgaattccaacaatagttatattcaatttttaaacacgaaccgccgcaggaggctcat

SEQ ID NO: 8087 - DNA, 1501 bp, Oryza sativa
ctatcaattcggccggagaaggaaaggatcgaccgaatttggaaaggaacggcggcggcgcgaaactagggtttcgggcggcggcggctggaggtagacgacgaccctgacaggtgggccccacctgtcagcgggcggacgcgcgcgcgcgcggcggactgggccgacttgggccgaggagagagagagcggttttgggccgactttcggcccaaagccaaaagaagacttttaaaacctttttcaatttaaattatttcttaaatgtaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaccgtgccccagccgcgccgcctcgtggccgttcgatcggctttgggccgatccgggccgtcggttcccgtggaccggcggtgggccgcctcggtggtcccggtccacggtggaccgacgcccttgtgccgctgaccggtggggcccgcttgccggcgccgcccctcccctttgatgacgtcaacaaccctcttttcctttggaaaaataaataataattgcgcaataaatcgagtttaattctaagaattcatttaaatggctcaaaacttctaaaattcatatctaattcatacgaactccaaattgggccattcaacttgcaaaattcatctaaaattgagctctacatgtttgtttactttttatatactatttccttggtttttattagagtttttcctcgttttgcgtgccagcgtgtagaatccgtcgtttcggaagatcgcggtcgcaaggataagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgataggacaattacagtattagaccttttaatatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccaacgcatccaggcaagggtgggcgtga

SEQ ID NO: 8088 - DNA, 414 bp, Oryza sativa
acgtgcgcgtggaatacgatggagaggggctgattccaaacacagcctggcattttagtagtttcacaaaattaaaagggcattctcagcattccatcaagtcattatggccccgtacacagtgagccaatcgttctgatcccttcggtgtaaaggacgatggggaacagtcatagcaccctataaacattcacgggtctacattataacaattatagcaccctataaatacaccattgtctattcctaatctccatcacagagcagagaaactagctccagttggcattcaagctctctctccctctccttgctagctgctcatcaacaatttgctatacttcccatggctacttacagtagctctgcacttttcatcctcttcttgcttccaacattcctgagcatggctgc

SEQ ID NO: 8089 - DNA, 557 bp, Oryza sativa
aatctctattgtattggatatataaatacaatcaccctcccacgttgggttgtgaggcgttgtgaggcgtctcataattctctacatggtatcagataccagtttccttctaccctaattcaccgcttcctatggccttcgctttttccgcgttcgcttctcttccgctgcccacgcgacttccacgtccccaccaccgcgccgcgccccagcgatttcccctcacgatctcgccacgccccagccccactgcgccttccatgtccccaccgcgccacgacgcaccgcgccgcatcctcgctcgttccgtgccgcgccctgctacatcgcgccgcgccgcgctctgcccccatcgcgccacgccgtgccctgcccgcgccgcgccctgccctgctctgctcacgctgcgccgctttctgtcttcgccacgtcgtgattattctgcctctctgccatgtctaccgagtccacctcctcttccacaacctcgggaacaatggcatctacatcatccggctctactccatcttctgctgccagcaccggggattctaccg

SEQ ID NO: 8090 - DNA, 1032 bp, Oryza sativa
gagaaaatataaatgacgcatataagttttgtttaattttaaatcacacatataataaatgacgaaccaaataatgtgtattaaaacaatattgcattattacaatttccttaagaatatatattaatgaatgttaatttgttgtttgccacaagtgactggctgtttatgatttcccatgaatttacaggaacaattaataaccaccttaatttttgacagaagttaataatatgtcaggcatgtaccatgtaagaatcaaatcacgcaaaaaaacaccttcaaaccaaaaatttgagatgtcttttgaagttattctgatgttcatgttgctaatgtataattttggaccaagagttgaggaaccgcaaaatcagattttcccagggtatcttacttgaatgatgaactgcttcttcttttcactgataataacttcgtaaaacttagagaaaaaaaaacactgatagaattagctctatgcataatgcatggctgtctctagatgcattatcaatccttttaaataagcacctcaaaagaaatgatggataattagctccaaaaaaacaaaaatgtttactctcccatatacaaaccgtcatctttcgtgcacatttggactggactatttttttttcgcggcaaatccatatcactgccggttggtggactaaacctggaatgacaaacctccagggatatttttgtgtcaactccaactccatcactgcgccacatgcagcctgccgtttcgaaaactggcagggatctcttgttgtgtaccagtgaaaataaaggggaaaaaaatgttggatggctaatgcaagtgggggcaaaagaattagacatctgaccttgtttggttgtgacattattccatacttcttctaaatgctatagccagggaatgcaaacgagaaaatcgatgaagctctgagttggcctcatgaactagagtgctaccactacgctataaatacagctagccatacaccatctctgatcatcgacaccaagcaaagaatcaaa

SEQ ID NO: 8091 - DNA, 474 bp, Oryza sativa
tcatgagtacatgcttgttgggaaggttgcaacgatgtaatccattgcagtaggctgagtggagataaatgcacgcatatatcaggacagattgacataaacagtatcgatctataaggtgtaaactattttgcagggaagtaattagtaagtgtttgagatacagtataagtgaatggcctgactaatgggagaatagttacctggtttagagggatgttgtcatgtcttcttcagcgagcaaggtcgttgcggtagggttggcgagatgcggcggagaagacattgccggcgccgccgacgggagataggaggtcagcaacacatgcgatacgtggactgagacggaggcggggtttagaggcgactgctggttggggaagacgggaggaaatcgtggcctcgtgggcgagcgatccacgcggcgagactctcggagaggatgaggcgttagtcttgtgggtgagcgatcca

SEQ ID NO: 8092 - DNA, 1501 bp, Oryza sativa
cccctcggcgccgcctccttcggcttcgccgcgtcctcggtgacctcgtccacccctccgtttcactcgccgaccgccggaacgccgccgtccccgtcgacccgagccgcgccgccgccttcctccgctccggctgcctttccgtcgtcgccgtcgacctagggtgagccgtggaccgccgcttcttttcccccttccctccccctctctcggcagccgctccgccgtgcctatggccgccgccggcgaccataggggcgtgggcgcgccgcctcctgccgctgcgccggcgtggtcgccttcgggcgcaccgagcggctgccgcgtggggcccggctatcagccgcccgcgcccttaggtgcggctgacgcgtgggacccacggtgccggccggtgtgagcccgggtgcgcccggtccaccgtgggccgtggggctgccgcgtgggccccacccccgtggacccggtccgcgcgcccctcccctcggctgacgcaataaatccatttttttaaattaaaatttaaatgaagaaattcgcaaatattcatttaaatagcatataaccttcaaatggccataacttggccatttgaactcggaattggaccgttcaagtctctaatttttccttaagaagtcaagaacccatttttgtgctttgttcctgcttgttatatggagtttattagagtaaagccttttcttttccgttggtcgtgtagacgctgcagcttcggaagatccactcttcgtggaggttgaagccgacgtttgggaaagcgagcaaggcaagtcacatcatccttgaacatattgaatcctagtttataaaattattttgatttaaattattgcattatcgctttatttaaattcccgcgttatcactgttttatttagccatgcctatttacctttgttatgaccttgttattattgctattgttattattaccttgttattattaccttgttcaccctaggataaacaaaaccccaactagtgggtaccctattcatggttccactagtatgaatttacgtagatgcttcgctgattaataggacaacattaggtggtttttatagctttagactttgggaattctcacatcatttggacactatggaatggttggcttatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcaatcctgcctacctgtcccgg

SEQ ID NO: 8093 - DNA, 1501 bp, Oryza sativa
agtaatttctttgcagaattggttttggtcaggtgttcgtataatcgtttttcctatacaccaaactcagttttcgaattcatcaacaattttctttgcgaattccgttttgttggtgtttgcagaatcgttttgctacaccaaaatcaggtgttgagtttatcaataatttcttagcaggatttctttttattccggtgttcacaaaatcttttgcttatacaactaatttagctgtcaaattcatcagttatttttagaagaagatttcgtttttttcaggtgttcggagaatcgattttcttatatgctgaattcgatgataatcgcaattttatcaagattaatccgacgaaatcaatctgcggatttgatacctagagcgacgaacaagtccaatctagcacgccagaaatcaaaaccacagaaattcaagagcaacggttgtcgatcgtaaacatacctcgcagaaatccgggtctggcgagaattcgacgatcaccagcatcaaattcgatctctagagaacaaaaaaatcccccctcgatctcgccgccacgatatcgggagaactacgccgaagaacgaagagggaaggagtcgccgaaatccacgctcctcctcctcacgcgaaacagcctccctctctctatctctccctccccgtggtacccccgcgcggggttgcgatccggttcttatataggccgccccgccccgccccgccccgcgccgcaccgaccctgggcagcgcgcggccgcgtcggagggcgcgaggcggcgtcgtggtggtgggtggggccgcccccgcccccgcccaccggcgggggtggggggcatcgcggcgtcacggcggacggcggtggccgcggagcctccggcgggggagggggagctccccggagggcggcggcgacggcatcggcgtggctagggcttccggaatggcgcgcggaggcgagaggaggccctgaagaggcgtgggcgtttaggctttcgttgcggtctcgtgttgctttcagtttcaggttcggggagggacggtcggctataacttttacgggctgggctgaaagtgggcccgtgagtattcctcgaggcccgtatatcagtgaaagattgagtcgttcccagggattcaaaaaccggcaaccgcgcggttaccgccgtaccgcgggggtacggttacccgtaccgcgcggtacggtttgccgaatttcatccgaattcaaaaattcaaaaaaaaaaaagaaaaaaaatcaaaaaaaatggtaacggtagtgcttgatttgtagtgttttatggtgaagaaatttgtcgaaaaagatcaatatttatttaaatttgagagcaaaacggatgaaaaacttgaaaattggaaaaagaaaaaaaaatgggccagcccgatactgtgcacacggcccattgaggcccaaacgaggtgaccctaaccctaaccccatctctaccgtccccccgtgcgttccatctctcctctgtc

SEQ ID NO: 8094 - DNA, 1177 bp, Oryza sativa
aactattcattattccccacgagggccattagctgagtgcttgtgctagtcgggattcaattatcacatctactttggtattctccatgagggataattactcggatcagaagccactcagatgagatatgcatgatctacatcacccaagatatttatcactcggggtcatattaattgtcgtgttctatacgtcatatttaagggtatcggtagacatactttaggtctaggcctaatatgtctgcagcccatatttttaggtgtggcctgtcacgttcttttagggacttaggcattttttgcttaggcaaaagtgcacgtgattatatgcccaataccttcaaatccttttataccgcagttactcaactttttaggagttggtgtaatgcattttaaaaggtgccaaccagtaaagctttaaataactgcccgctgacttttttatatagtcaggcggctgttttgttttatcaagcaattgataggatacaatattgttgctttttgccatgtaagtgtgcatttttattgaccaatattatggcttaggctgattatatatttggtcattttccaagcagtagatatatcacttggatcatgttattcgtggattcacaccgcatatgctattaatattaagttacttggttgactataattataaaaaccgctcggttggttggattatttactccttgactatatgtttagtttgttcaactaatcacatagtcgtgggctacacctattaggtgcatctagtcgatgcacctaagtctatattcaatttttttcagccctccacagtcttcagatttggtaaaagtactcgggagaccattgcaaagatgattgaagcactcggctttagagtaatctggttcaagagaagattatcttttcgactgtgaaggtctcaggggctactgtggagattataggtaccccatacccacacggcatggttatccgactagttataggggataacttatatctatggaatatgtaacagatcatgacttgggtattacgtttccttgtatattatggaacggcctaaagtcctgatttgataatattgtaaagtagatttaggaaactgataccatattagttaatgtttctatcctatataaggtgggcaggaggccctgtaggtggcaga

SEQ ID NO: 8095 - DNA, 1058 bp, Oryza sativa
ctttattgatttattcattcttcgatttcgggtatctcaagcaagtccaacacctttgaccaactcttgttatattttcgtatttgcaatctatatgtatcaccttgcattaattatattttctgcaattaaaataaatatgttgaaggattcgattggttgttggagcagttggtcatattatggatgtattctaaacttgtcattgtggtgggggctcagttgcatatatttatcatcataaggttaaaaaaacaactggtatatggcatgcaagtgtcgtagcgatcgtgtcgactatgtaacagcccaggtaaccacgtacctagagtgccacaccaaaaacactcaaaaccactaactcccaaaattattagaaatttcgacagtctcccctataaatacgaacatccacgacaggcagttataagataaatcaataatgaaataattcgcacaatccaaaccatcctagttccataaatcccacataagaatacgaaccataactttaattgacatttacaaattctacgcaaaacttatgctaagcaggatcataatctaaaaccaaatttttttagtgctataaatgtgtaatccaagggtgctacttcccgcccatgcatgtcgatctcaatgtgtatctaaaatcaaataaacagaagagtgagtacagaaatactttttttatagtagtacagaaatactcagcaagtataatatggaactagaaaacacgtatacacatcatgcgcaataaagcctgaacagaaaactttctttctttgaaaagaatcatatttcaaacaccaagttaaagacaatagtagttcccatcccagacaaatatgaattgaaatagtagtttccatcccggacaattgtgaatacatcctagcatttgccggcaaagctgagtaagcgtgatcagcacttacccacaggaatataaatagaaaaccaagtagcacatccatgactcacatggaacatgaataactgaaaccggaaacaaagaaccaaattgaaaccatattgcacatccatggcaagca

SEQ ID NO: 8096 - DNA, 1501 bp, Oryza sativa
aaagaatggaggagagagggaggataagggaagtcgggggaaaacgagaagatgaggagacaggaaggatcgagaggcgccgctcgctccgcttgctctctcggtgataagtatcagatctgacgggcctttctttttaaaaaaaagagcactctgtattttaaaaaaacaacacaagtataccatataatcggcacatatagggatttataggggttggtttttaatttttttcggtttaaagtctaatgggtctttcttttacaacttttttatttctataaggaatatttttttaagggctcatatcataaaaactaaatcctaatcatctactatttttatatttgttataattttagtttacccgtagcaacgcacgggtatctatttattaaaattgtttaaataataaaaaaattcttggcctgtccgtctgctctctttttcctatgtccttgtccttttattttgtcccctcattgtctaatcttctttcattttttatgtcaacttattaatatttgacctcaaatacaatttgtaaataaaaaaacaatactcactctcacaaaattaataagatttatttttaagatttgttaaactccacacatttttattaggtaacaatacacaggtacattcgcataaatgtaaagtgagtatagtttaacttgataggtttcttgtggtggaaccagtcaacctgcattcaaatatttgatttgacacgggtgctcgaggcgttcgtggtaacttcgtcaatctaaatactcgtgttgtgagtgcgtttgcactatgtgtttctaaaaatatatatattctcgcaattcaaagtacattgagtacaaaaattccactcgtgttctacataaaaaaaaatatttccgttcatgatacaaattttcatccgtcgccttttgggcaaagacagtcgcattattcgtccatccattttctctcatgctacaaatcatccaaactaaacatcatttctacaaatatagagcagattatttatctaaaagcaaacaatttttttagcagattagttgactaaaccaaacaacaccttttgtcactgtacacattccgtaatcacccggtgcaacgcacgggcacttttgctagttaaatggataaaatttagaaatttattcgtgtcgttttccgaacgcaaattgcagattgttgactccatctggtcttctcccccaatttcttgctcagttttttctacacccagttgtacgcaggttacttattggatcgatcatgcatatcaatgtgttgaccagttcttgatgcatatacaattgtgtgtcatctcctaccttacaataacaactaatctggcctgttgcattgcaatcagagcttccgaccttgcaaagaatgagctgctaaaagcatttcagtgacagctcgagagtgtgtccaaacatgggggtttctccatggattatcatcttcttgttgagtgttattgtgctggttt

SEQ ID NO: 8097 - DNA, 209 bp, Oryza sativa
gagcaaggctattcgaatagttttactctggccagaggtgcacaactgtacccacaagacacaatccaccggcatgtcaccatgcctgcgtagacacgtgaccatgtcgagtgattgtgacaagacccttcgcataactctcctctaaccatccacaccacgctgaggtttcacccccacccctaccccgagagtgggcagtcccccca

SEQ ID NO: 8098 - DNA, 1501 bp, Oryza sativa
aaacccccaattttggcccgttcccatttcccctccgtcccaaatcctcgaacattttacattccccaaagcctacgccaccaaccgttcgcagcaatttaccaatcggcctcaaattctcccataacaagattagggtaatcgtaagactacgaacgaatcgaacctgggattgggctgaggaagctgaagatgtgcatgaggcagccgtcgtccaggctgttgaccggcgcctcccccgacggccccgccgccgaccgctgccgcttcggaggcatctctccgaatccctctcccccccagtacggcgtgcggcgccggcggcgagcggcggcgcggtggcctgcggcgagcgcgaggtcggcaacggcagctgcacgcgcggcacgggggatatctcgccgcctcgacggatccacgattttttccgccatcgcgggccccacctgtcagatggcggttggtcgggcctgtccacgtggctgcctccgctgcgtcggatgggcttggactagaattaagccaggcccatattgggccataaaagtggacgaattacagtctttaggcccagttaactgtttgggtttttaatccttttctttttttggctgattaaaatgcagatttcacatagatttctgtcggtatattttttaaattgttgaattttctgcaaaagtattttttataaaaaaatttattcgcacgtgtcaaacaaacgcatgtgaatgcacggtgttttcgactgaaaaacatacttcttccgtttcacaatgtaagtcattctagcatttctcacattcatattgatgttaatgaatctagatgtagattcattaatatcaatataaatatggaaaatgctataatgacttacattgtgaaacggagggagtatatagtatacttcgtacgattgtgtgtgagtgcgaaaaatgtggttacggaaagctttactccccttttgtgttgctcccccacttgcatttgttgtgatccgattatttgtaattaatcatgcttgtgagatgcttgtgcaaagtgcaaataccatctttgcggactaatgtgataatcagcatatgtgcattggtgcgattattctactgcccttgctttacaaactcgatacacgtacaggttgattctttgctattgtcgcgaagaattagagtatgttttatatataaaagctttgctaaagcttgggacaaaacaatagtaatgcagatcacgagttcttgaatgaaattttgtaggaaagcttaatgcctaaggaagttagctgtgcagcacatatattcatcagtgatttgtcatttgtgcaaagtgctgcaaatgtgcccataactttgcaagtttttctccagctctttcgaaaaatccctgctctttataattcctagtactagcttgactgtccatttgtccgtgtaatctcgtgtcgtgtgttcgccaccattgccactcagagcgcagagaagagatcgatcgatca

SEQ ID NO: 8099 - DNA, 1002 bp, Oryza sativa
ctggtgagacaaacacgtcatctcacgggtgaatccattcattgatagtgtggttttgtaaaactacactaataaaatatatgtacttatagtgttaaagtgtgtgtggttttctacaacttggaccataaaatgtgtagttttgtgaaatttactctatttttaaattcgaatccacatcaatttaccgtttcctgggcctttaatgtgctgtgtttgtgttgtgtttcatctctagatacatattacacacgatttttccgtctcacggatcgatttgtccatacactggagttgctgtaagtgctatacttggatttatagatggccataatgtccgatgtccgacggcccagcccacggcacgatattttagcccggcccatgaccgccgggccatgcatgggcctccccaccggcacgttgggccggtccggcatgactgggccagcatggcacaatgggtcggcaggccggacccgacacataaacaatagggagtaaaattgacatattatatgtcacggtccaaagaatgagatgaaaaatagatttattttagctatatacgtgtcagcccaaagagaagagagggaaaatagacttattttagctatatatatgtcacagcccaaagaggagatggaaaataggtttattttaagaaggcacgatgggccacacgttccttcgggccggcactgcacggcctgacagctgatgggtcgtgcctaggctggaggtgcagaccatgagctggcacggcctagcacgaagtgccgatcgggccgtgacgacccgattgctggtggaccgtgcctagccgtgtctgggccgggccgtgccaggcgggtcttatagtcatctatactgggattcgatttcacacgcgagggaaacctattcgcgcgcatgagggatgtatatagaaatatcacgttatatatccgatcagttcccattaaaaaaaggtaatatatccgatcagtttccataaaaaaa

SEQ ID NO: 8100 - DNA, 1134 bp, Oryza sativa
ttgaggatggtttaaaatgtcacaaagataaaattatctaatctaaaatgaaaacattggttgaagggtgatccaaagagaaacattgataataaaaggtgacttaaagtaaaatttactcttttttatttacaacagttgtggtattactactaccttgtacatttgcattggtatttggcaggccttcaaagcatacaccaatcaaggaaaaaatatcatgttagttgatttaagcatcttgatgcaatagcgttttatggtagtaatatagctcaacttaaaatttacaatgactgctaggtaagcagtctgaaacctgaactttcggctcagctgctcaggggaggttaacagagagtaggattaaagttggtttgcatgtctactcaactgcaacttgcttttggtaatgatgatactggttggaaccgaatgtgcacccatgttagtttaagaaatcatttcacctaatcacctttttccttaggtatgttccaatcataaacaatcacacttgactaagctaagacgaccctgaccgtttttattcaggtaaagcctcaatcagtcgccacagagccaatggtttctcatgtccgtttggtcgttttgtacatacgtggatgtcccgtagcgttggtgatggatcgccaaagcaaagctatcacgattagtttaattagggacgctgccacggtggttttagtggttaattcggtgttttattggcctgtgcccattgattcgtacgaacgtacccaccgaatctttggtccattctgttggagtttacacgcatgacgcattagggagaagaaaatggctcgtagaacatcagctgcttactcagcgattcatcttgttcttattattattttacatgatcaggtcttccattccaagcttctaatgcacggggcaataaatctggttatcacacagcagcactaaaactttggagttattttcctgattaattattaattcatcaggaacaataatatacgtgatcatcaatcgatcgaacaatcacgcaccagtttccgcgagaggagattggattgggttttgggggttttggccacgttagtgcccatgcagaatatttctcgacgcttgggttgaacggca

SEQ ID NO: 8101 - DNA, 1179 bp, Oryza sativa
ctattatttcctaattgtatttctatatggattctatactctacttcttatattccttatttttaattccgaatttcagttatttcctaattgtatttctatatggactctaatctcctcttctaatattccttatttttaattccgaatttcaactatttctaaattgtatttctatatggactctagtctcctcttctaatattccttatttttaattctaaatttctattatttcctaattgtatttctatatgaactctatactctacttctaatattccttatttttatactctacttctaatattccttatttttaattctgaatttcagttattttctaattgtatttctatatggactctagtctcctcttctaatattccttattttttaattccgaatttcaactatttctaaattgtatttctatatggactctagtctcctcttttaatattccttattttttaattccgaatttagctatttctaaattgtatttctatatggactctgtttttctttttctccgattaatgtgagaatttctaggctatgagagcgaacgtggaggctcctttttctattcctttaataatataatagatttggtatctctagtaactaagtacctcaaggtaccaaaaagtttagtttaaaatttagatatctcaagatactttcttaagaaccgtagaggtacgatctacttcctccgtttcaaactataagttgttttgatttttttttcgggttaaacttctttagatttgaccaagtttaaaaaaaattagcaatactacaacatcaaatagtatcattaaatgtagattgaatatattttttaataatatgcttgttttgtgttgaaaatatttttaataaatttaattaaacttaaaaggttttactagaaaaaattcaaaataacttataacataatgaagcagagagagtattaaattaggagaaaaaaaagcttagattgattctactatcagcacaacaaaaaccaatataaaacatgtctaattttttacgattacaaagaaaatgatcaatgagtgtgttcctttaccacgtgataaaaagctggaagcgcgcaggggcggagctacatgattccctggtattcctaggaatacccaactttttttttatcaaaaaacaagt

SEQ ID NO: 8102 - DNA, 696 bp, Oryza sativa
ctacacattttagtaacaaaaacatgatgtttctgctgtcaactgctggcttactatatctgctcaaaccatatatgtttaacagttcaatgtgttatatatactctagttgtcctttgaaattgcaatacattaactatgcgaatattttgttgccaacaggaactttgttcaatcaggttttgatatgaaccttgctttctgtaatcaggagaagaagcaaaggaatgaggttagctaaagattttcccttaatcttctatgcttaaatttacgacaacagaagttggaaaatacagaaccaaccaattagctgatgttagctcattttctcattgcgctatcattatggtgtgcttaaggtgtaaaatgccccaattattttttgtgctatatttccaacctttccatatggttgactgtgctcatccaatgtttcaattgctaggtatagctcgaatgatacaaactcctagtagattatgccaaaatttaatatccatgcatcacaattgtttggcccaaccatagtcacaggaaacggcggtggcagcgatcctcgacccgggaacgccgtccctgtcccgaaaacacggggtcattttcgtccccaccttgtaaaaacctctcgcaagtagcgtatcacgttcctcgatcccgttcctcgatcccattgacccaggaactttgtgacta

SEQ ID NO: 8103 - DNA, 1501 bp, Oryza sativa
ttcggtagtagctcgagtagcctccccgtagctagccggcgccgccccgaccgttgccatcgctcgccgagtgctcgccgccgtcgccgcccgtgctccgtagcacccgctcgtcgccggcctcgctcggcgtagctccgcccaatccgacgctagcaacggattcccgcggccgcataaatgctctcgccgccgggaattggcccctcgtgacctcgtcgccttttcccccttcttccgcggccgcttgccgccgccgcaattcgtcgccgtcaagttccctccgacgaatccgagccgttggctcgtctccccttgtcctgtgcaaccacccggtgttctcgctttcgcctgtatcgccgtggttcgctccgccgctcgccgctgtcgtccgccgtccgttccggccagcgtcgtcgtctacctcccgccggcccgcgtggcagccacgtaggcgccacgtaggcgccacgaaggcgccacatcggcgccagctcggccaagaccgggtcgagccgaccccggtcagcccttcaccgtgcgcgcgttccaccgcgagccgtgaggctgcgcgtgggcccgccgcatccgttcctccgcgaaccgcgcgcgtgcaccgcgtgcaccgcgtcccagccccgcccgcacgcgtgcgccgcgtgctccctccgcacggtgagtcgagccgctgacaagcgggtcccactcgggaccgcgcgcggtgagcccggtccaccggctctctctctctcctccctcccgcgcgcgcgctccctgggtcgccttgggccgcccggcccatttaagctcggccgagccgccccaattctctcgggcagcgccctagccgcccgaggaaagtctaatttccctccctcttctcttttcttttcttttcttttccaaaaaggatttaattaaatccttttcccttagaccaaaaatccaataatcttagaaattcaatatcttcccaaccgtaaatccgtttgactccgtccaacttccaaaattcctcaaatctcgagatctacctaatggcacgcttagaggtcattaatagggctttattttctccatttgttgagttgtcccgtttcgcgtgtagtttcggagcccgaagacccgcagtgcgaggatttcgaggatcaagctccagatctcgagcaaggcaagccacctttgaacatcttgaggctatatttgaaatttaattatgttgcttgaaaaatattatgcattgttaggatcgcacttaatctgtttgtcccgtctacaaggcagattggcggacctacctaatttgttacatttgacccttcctttgttatttgttatatcatgtcccccttgtatccatctagttgcgtcatgatattcgtgcacccagtgcgagtatcgacggacgccttcaaacttaaaatctgaaaaaaacaacttgggtaaacttgggttttacaaagacttggaaaacccgacacctgggtcggtgcttgcgaat

SEQ ID NO: 8104 - DNA, 1059 bp, Oryza sativa
gttgcccatcacaaccagcactgtcggtagccgctgtgtgcgagcctcgcgcggccgttgacgttgttgctcggcccgctgccaccagggccggcggcaccgcaaccgtcgctcaccccgggcggcgcgagcaccgccgcccgcgtgcatctcgccatcgtggcggccgccaccagatgccacgccgtcaccgctgccgcgtccccgcgccgtcactgccgcctccgctgcggacaccgtgccgtcgccgccgcccttgtcgcgtcgccgcgccgcggcctcctccgccaccagcacccactccggccggatccggccaggggatggccagatccggcgaaggtgacgccggatctgccgtctcctcgccgggatcggccgccgctgttgctccccaactgccgccgttcgccgcctctcgcgcgctgggaagggtcaccgccatgaaggaggccccgccgccgccatcatggctcgcccgccggctttccggcggcgaggtggggggaggggggagaggaaaggcggcggcgccgctagggtttcgccccccgtgtcgccagcgcgtgggcgatgcgggggggggggaatccgggggataggttattaattggcggtagctcattgatggcacgaaaaatgaaaaaaaaatcaatggcgcatgattatttatggttaaaggacttccatataaaatatttcaagttgctgaaaagaaattaaagcacgcaaggtctaagcatcagtggttatggtgatgtttaataatctagtcggtacatcaaaagctgattgcctacaatgattgcccgcccactaagcaggagatgctttgagactgtgtaatttaatatcactataaaatttatataattattccgaaattctttgtgcaccaacgcaagctttacagacgcagatagctcaactaccaaatggagctgttgtatgaagtagtggggagctttcttcttcctccagtctcacaaatagctcaccagttctgacaacggcgtgagcagacatcacctgatctcaccaagaacatggccgccggcg

SEQ ID NO: 8105 - DNA, 1221 bp, Oryza sativa
cgccttgctcaatccactactcctcggaattgggtcaacaattcatcccgaggatcacatccaaatccttggtgtctataaggatcagatccgagggaaaaggaattccctggatctctataggtacggccgggctataatactttgctgtcatagctcctccaggggtggtgatgagcagtgagttcctaagcctttctaaccccagctgatttctccccacgaattgcacagatataaacgagtgggaagctccagagtcaaacaaaatggtagcggggatggaatgaatgaagaacgtaccgatgatgacatctggagttgtctgcacatcctctgcagtaacatggttcacacgaccccgagtggcatcctttccaccattgttggggcggggaggcgcttggccttcctaacgcctcggctttgggaatttatccgcgaagtgcccaggctctaaacagttgaagcacaaacgcggctgaccttgaacatccctgcgtccatgactaggctgcacggccggtgcagggggacggggtgcacggttcccttgctgattctgctgttgctgcggctgtggaacgcgtaccacaaattgaggtcatggcactgggcgaggttgttgctgctgttgttgtgaggaggatccccctggatagggattggtgtagcggatcctttggttagccccctgttgattacggaaattcgccaagcgacgtttgtgtgactccagttccttgtgcttggcctccaggcggatgctcttgtccactacgagctggaaatcagggtaatccccggagaccagacgcacagaaagttcagggtccattcctactagaaacttctcctgcttttcttcatcttcacgaacatcctccagggcgtaccaggccaggttattgaactcatgcaaatactccataacagagcggttgccttgcttcaactcccgaaattccctcttcttaagggccatgactccagctggcacatgggtcctttggaaagcggcggtgaagcgggcccaggtgattggctgtccttctggctgcatagcctggaagtggtcccaccatagtgatgcgggcccttgcagctgatgggttgcgaagataactttttcctcatcattgcactggacggtgtccaactttttcccaacggcatgcaaccagtccaaggcatcaacggggttattggagctagagaagg

SEQ ID NO: 8106 - DNA, 1501 bp, Oryza sativa
atggtcgcgcgccctccccccgcgcggcgcagccacgtggcgcgcgtggagagggggaggggcggcaggagggcacgggaggactcgtgagcgtggttttttttttttttggttttttcgtttctctttcggttttctttggttaattcccggttttgtcgtttccttcgttttttaagtatatacttaacttttgatttttgacctacatacttatacaaagtttgtatacgtgtgtatatattacaaactttgtatatgttgtatacaaagtttatatacgtcatatacaaatacaaactttgcatacgatatatacaaagtagacgtatacaaactttatatacgatgtatacaaactttgtatatgtgtgtatacgcacatatataaagtttgtatacgtgagtatacgtacgtatatatttgtatacacacgtatataaactttgtatatgtcgtatataaagtttgtatacgtcatatagaaatacaaactttatatactatatatacaaagttatacaaagtttgcatatgcacttatacaaagagagaattcactcagtgccactgagttttcaccacttctacaatataccattgactttgtcaagttgaataatatgccatcatgttttcccgaacgtctactgcataccatcacagtccagaagttgttagttgggcatctgttagagctgtaaaaaaacctatttgcccctaactcattgtacatggttttttttttttttgccgatggacatatgaatacatatagataaactgattgaatcatataacagcctatgattgctagcttcacgcgttggtagagacgtagtgatctgttgactttgaaatgggacatatcggaaaaaaataaatgtacataatgaaaaaatatcaaccccatacagttagatataaaacaagtttgaacatggtgcatggcactgagctcatatagatatagaaatgaataccaaaatattttactaaaattagccaaatccatacagtttagtaagacagcataaatatttaattacattagccaaccccatacagtttagagatgaatcacaagggtccatggatcataaggatcagtacatgttcagccatatgcataccaaaatagaagttcaacacatgatctgcaccgcaaaagttacaagcatatagatggggatgacatagatggccacaaatataaaagagaacatcagcgcagttggcggctggttgcggcgacaactgcggaggtggttgcatcagagatggggccggaagcaccaggacgccggcggtggatgcgaggttggcggcttgtcgcggttgcggcagagttggggacggaagcgccaggacgccggtggtggaggcaaggtcagcgggtggtcgccgtgatgctgggggaggtggtcacgtcggaggggatggtagcgccaagatgctgcccgcggggtcgtagtcggcggccggttgcgcccacgatgc

SEQ ID NO: 8107 - DNA, 1501 bp, Oryza sativa
tgtgtagaaaccatgtctcatgcaagatattgtttacttctctttcctcatttattcactttccataaactccacatcagatactactcttccaatgcaaacactactattccatacttaaatttaatgctacttatctcacataatgtcttggatgttgtgtagaaaccatgtctcatgcaagatattgtttacttctctttcctcatttattcactttccataaactccacatcagatactactcttccaatgcaaacactactattccatacttaaatttaatgctacttatctcacataatgtcttggatgttgtgtagaaaccatgtctcatgcaagatattgtttacttctctttcctcatttattcacttgtcacatcatttttcaatctaggtggcagcttatttaatgctatggacaccatcctagtcattgagttgggaatgcccttaaggctagcaccgtttttagtttcctggaagaggaatcaggctaagagcaagtataatagctagctataaacctactataaacttagatggaggagagatataacaaaaaatcaaggatgttggctctcatgcaagagctagattaacacaagctcctaggtaaatacattaaatgcataggtgagaaatagagagaagaagaaagttgtagccaaccttataactaatctattatatatgttggctttaaaatgggctaatagtaagaagtaagctctactattatccttgctctaatggcttactcaaaacgctaaaactttagagggttttcacggaattttgtttaactttttttaaaaaaatccttccgtttcgaaattgagaggagtacttagagcaactttagtattctaaattatctatagtcaatttaatagccaatttatacaatagctatctataaatatatactgtataattaatgtctggtcctcacctgtaatacacacgcgtatcttaaagtccgtgttgcaactggttataaatttgtagcccatactgttatagttcgtgctgtaactggttataaatctgtagcccgtacttttatttttgctcttttattgttttaaattatatttatagcttggcttatagtttgctattatcctgctcttaacgagatgtgcgggcggattagcgataggctgtctggctaaacgtggtttttaaaaattaaagaagccgttgcaattccacgctattactactagtcatttccacacccgttattcccaaccgcatcgcgtcgcgtcgccggctcaagcaaacgcaccggcgcctctcgccgtcgccgtcgccgccatctaccagcgccttcttctccggcgcatccgtttcacgccctctcacttcctcgccggtttccacggaggagggagcgatccaatcctccgaggaggcggcggcggctgcgggatcgcgggattcgtcgttcgatctgtgtggctgcgggtgcgggggggagtggtcgatggcgg

SEQ ID NO: 8108 - DNA, 1235 bp, Oryza sativa
accattcatgtacaattaacatcattctttttaatggatcaagtgttttcatcggaatgagttgcatcgggatgaagctctctgcacagcagacatattctgcagaccaagattatggacctaaatcctaaggagtggtttaaataacagtgagctgaaacagtagtgaagatcgatgcagaagttgagaagcatgtgacaaagaagatgccaaagcttaattagttggggtattgtgatgatctatcttatgcggttcctagtagaaatggactgcataaggattatctgtttcctgtttcttgagcacaaggggatcaatcgaccctccataattcttctcgtgtgtgaaaaactaaaggattgcagtcctcccataaatctgagttcatttcttgaggttcccaacgtcaactccttaatttcctagctaggcatacgcttcctggactactaagcgattcattttttataaaaaagaaatatatgaaagttattgtaaaaatttatattaatctactttttaagtttttttactaatacttgattaatcatgtgctaataaataatattgttttcaatgcatggaagaatattttcaatctctcctcccaaacatagcaagtactactctagtccgaaaaattaaggggcggagtcaagacccagccaccacgggcgagtgccagagctccgcccactgcattattacgtaccctgtttgattaacaaggaaattagtaaagttgtggagattatggataccccatatctatatgacggttgtaatttagtcggatatacggtaccaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgtgtgcctcttggggggcgattctttttccaatttatacaatcaataacacactaggcggaatcatccccagacaggagtagggtattacttcttgaataagaaggcctgaacctgtataaaattccttgtctccaaacccatccactttcctagcttgatagccacccccttttattattgccgaaatcttgcttcgacagttggcgcgccaggtaggggtagcgtcaagttctcgccgactaagtgcga

SEQ ID NO: 8109 - DNA, 1501 bp, Oryza sativa
ctcccttggattcgtttggaaatcctcccctaatcccgccgacgccattgatggaacccgagaacgccgcgctggtttccttcccctccggccgctctctcccccttccaaccctatttaaaccctccccgcacctcctccgtccgtttccgcctctcaccgcccttcctcctcgccggaatcgagctcgcgccgtcgctctctctctcctccgtcgctgacgacctccggccggctttctccgctcgccgggaccgtctcccgcctcagcgctgcctccttcggcttcgccgcatcctcgccgacctcgtccacctctccgtttcggtcgccgaccaccggagctccgccgtccccgacaacccgagccgcgccaccgcctccctctgctccggccgcctcctccgtcgccgccgtcgccccggggtgagccgtggaccgtcgcctcctttcccccttccctcccctctctcggccgccgctccgccgcgtctatggccgccgccggcgaccatcggggcgcgggcgcgccgcctcccgccgaccgcgccggcgtggccgccctcgtgcgcgccgagtggctgccgcgtggggcccggccgtcagccgcccgcgccctcgggtgcggctgacgcgtggggcccacggcgccggccggtgtgagcccgggtgcacccggtccaccgtggaccgtgaggctgccacgtgggccccactcccgtggacccggtccgcgcgcccctccccctcggctgatgcaataaacccctttttaaattaaaatttaaatgaagaaattcgcaaatattcatttaaatagcatataaacttcaaatggccataacttggccatttgaactcggaattggaccgttcaagtctctaatttttccttaagaagtcaagaacccatttttgtgctttgttcctgcttgttatgtggagtttgttagagtaaaagccttttcttttccgttggtcgtgtagacgctgcagcttcggaagatccgctcttcgtggaggttgaagccgacgtttgggaaagtgagcaaggcaagtcacatcatccttgagaatattgaatcccagtttataaaattattttgatttaaattattgcattatcgctttacttaaattcccgcgttatcactgttttatctagccatgcctatttacctttgttatgaccttattattgttattgttattattaccttgttcaccctagaataaacaaaaccccaactagtggacactctactcatggtaccactagtatgaatttaggtagatgcttcgccgcttaattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggaccggt

SEQ ID NO: 8110 - DNA, 1501 bp, Oryza sativa
gctgttgctaattctttcatcaatattttggttgctagttggtacaaaagatatcgcactacctgaaaaatataaatacatgctagctagcttagagaactgggggtctggaaaacattatgatcgtctccagtactgccactcttcatatttcaccaacatatgagctcttataaactatagcatgatgaagagtggaggtgctgtacacttgagttctaataaaggtcgaggcccccatcatttggcttattaagtgaataagaaacggcatatttacaaataaaaattaatctgtaacctttctttcgtcttctccgacgagaagaaaagtcgtgcagtcctcaaattatcccaacacgattgatatttgttcatttctaatagattcttgattagtttttgggacaattgcttatttgaccctattttaaagcccaactaccaatttgaccttactttttcaggtttgcttatttgaccctcttttttgaaattgaagtttccgtttgactctgtttagacttcaccgttggaacaacatttagaaaaaagaaaaaaaaaacatactaccccaaagtgacaaaaatacccccatattactaattaaccctatccccacctctccatcccaaattcccaatccccacatcttcagtttttagtcgccggcgatggcgagtgctgcggccgacggaggaagcggtggcatcggcgcgcaggaggaaggagcggtgtcggcggcagctgccgtgcttgaagcggacagagggagcggcggcgccggtggctgccgggctcggagcagagggagggagtggcgacggtggcgcgagggccctcctcatcgccgacccaacgcttccccttgttaacgaccaaatttggtaatatcagcatcggaaaagaggattagatcgaagtggagtcgaaggcggagatcgattcgagaatagagcaagaatcggctggagtccagatcggctacgattaggatcggctggatccgagtcggactgagtaagttgatatagccgattctgataatacgacttggtatacgatatcaggttgaattaagatgcttcaagatggttgccgcacatggatagagtcttgagaaggcaattgtatctattaattaggacattttatgtaatttccttagagatatgtttagggaaaaagtctgccgcaaagacttatggtatcttagagtttgttagagataagagtcgtgtccgatatggacatagtttgtaattttcgggtataaatagaccccgaactatcacgcccagaaattcccgaatagaattctaagtagaatgtgcattaaaatccccgtccattaccggccggggtacacaaacgacaaagttaacatatagatccacgtcttacaaatattataaaagtcttacataaatgcagcggaaaattaaaagataactggagctaagccttgacttggactgcagcgggaacaccactccacagg

SEQ ID NO: 8111 - DNA, 1501 bp, Oryza sativa
acaccacgaaaacggcactgatgagaagactccaagatgccggtttaggaaccaacacctttgatgtatacgatttgtaaagaaaagagtaaatttcactttgggcctgatttattggccaaagtttcaccataccaggtataactctaccttttcagttaacaccaggtatgattaccttcttttgcagtttggactgggtttcaatacttttgggccaccatgttggcttgagcctggtgaactcagttcagcgcagagagttatcaagggagactagcgcacgggaaaggaggaagatagtgtcgtggaggtgggggtggaggtggacttgctcaacgcctcgatctccaccctcgccaccggcggctcccggccaagtctccggagcagcacggcgtggcggcggcgtgaccttctccggctccgaattggcatggcggcgtgctcttcagcttcgtgtggtgttggtggaatgaatctgtgttgtttctaaatgtgtatgcaagtaagatagagctgtcaattttgccactaaaaacatggaaagaggttccaagttccatatgtacatgtacctgatcatgaggtacttgtgataatttccctttccagtgccttctctttagtggtacttatttacaatacaattagctaataattcctactctaacttggtgaggcttttggaatcctcccattctgccgtgagctgaaggagcagtgcgtgcaccccgttgccggcaccgcggtcgagcagaagaagagcatgccgccgtcctgccgcgccggagccgaagaagagcatgcacggccgctgcgccatgcctcgccagaaccggagatgtgcacacggccaccgcatcgtgccgctccgcaggcgtagaagccaccggtggcgagggtggagaccgaggcgttgagcatgtccgcctccgcctccacgacactatcttccttctctcccatacactagttttcctcgataatttctcttccccgaactgagttcactaggctcagatcaagccagcgtggtggcccaaagtcttaaaacccggtccaaactgcaaaagaaggtaatcatacctagtgttaactgaaaaggtcgagttaggcctggtttcatggtgaaactttggttaataaatcacgcccaaagtgaaatttactcaaaaagaaaaaaccaggagccgagccgatgcttgaaagccaccaaacataaattaaaaatctaaaaaaaggaacaagtacacatcacacaatcaacaagttcatagatcacaataaacaagttcatcaatacatcaagaacacggtctaaaaaaacaacatcaagaacacagatcaagaagtactctacccctgccgccgtcgccagatagaaaggaggatagggggaggggcgagcctccttctccccttccactacagccgccgctgcctctgctttggcgaaggtgtgggtgctaccattgccgtcgtggaaggccgctttttc

SEQ ID NO: 8112 - DNA, 1501 bp, Oryza sativa
caggacggccgcagcgcgctgacgccccgatctagtccccgtcgaagctcgatggccagcctcgaggtcgtcaccggaaggggaggtgaaggtggtggcagctgggagagggacggaaagccatcctcggcttgctcgccagccgcgatctgtgctcgttggtgaggccagccttgatctctgcaagctaacaattctaatttttccaccgctgccccgtggcgaatgtacttcaaatatgataacaagactgaaccagaactataccacattgcatgagcctgcaaaaaagcaccatcaacattaatcttggcccaaccagttctggcaattcccatgagctgcaacccacgcccaaagttctatttatcttcgggtttggggaattaatttatactgcactcaaaactgccttacctttttaccaggttcttgtaccacggcttgtgcaaaagagtcatggtaactctgtaagaacattgcagatcttgccaccatctcctcacctttgccatggacaatatcattacgtaaatactataagctccccaaaacagcacaaggatatgacaagagttagttggtacagagctaagaaggataagaaggatagacaacctttccagcaatcacgccaaaaaaattaaaagagctttcccctaggagagcccaaatcctgcacagagcatgtcgcagagctttcgctttttgtacatctaaccattgtgtgaaaattctcaatttcaaatccacaaatcgtgcacttttcttatgtcactaattgcctttgaaacttattggcctaagtagggagattgtctcgtgcgatgcggtaggcgaacactctaactttctagggcacgtttgctgtccaaaccatgtaccagcaatgtctactcccatcagtagcattgctacaagaacttccatcttttagttctctttctgctagcaccaatttataagcactgcatattgaaaagataccatttttctcgtaatgccaggtaacaaaatcttcagatattctcggtgaaggcttgacttttaggatttaatcagcatcatgattgtagaagtgtaaaatcaaagtgtgtttgattcttattctgtgatgaacaattggcatataagattattggttttaatatttggagattattggcaaagtgatttgcaggtgatgaacagatactgctagattgtcgggtccggtcaaactgggcaggtgctaccggtcagaccggccagcccacgatctgactggtcgaattggagggtgtctaaatttggtacaattggagtttgtaaagttagtttcttgtacgagaaggtttcctagaggattagaacatcttgtacaagtttggttcgtggctttaggctgcctacctcgtgtatatatagagagggagggtgtggcctcctggtatcgtttaagagagcattgagttgagaggatagctagggtttcgagtttagccgagatttcgtgaggagt

SEQ ID NO: 8113 - DNA, 1501 bp, Oryza sativa
gggatggtgacaaggtgtatatttggagagatcaatggatcccaaaggctgctgggttaaaggcaacaggcaagaaagagaaatcgagattaaagtgggtatctccactaatctttttctaggatcgaacagcaagaactaagccaaccagggagggtcaatggttgtagtatccaaaaccaaaacttttagcgaaattaaaagttaccctcgaatcgatgacacgtggtctgactagggtaaatgcgctggtctaaccgcctggacaccattggtctaaccgtagtagtcactccagctgtctgaccgctgtaatcagccgccatcgcctatagccgccgccggtctgaccgccgttaacctgccggtctaaccagtccgacgccatcggtcttgccagttggaccgctgagcctgagcaaacacaaatcgaagaactctcaaagtagatcacaactttattacttctatctgtgtttacaaagtgcaacaacagtactcctcacgaaatctcggctaaactcgaaaccctagctatcctctcaactcaatgctctcttaaacgataccaggaggccacaccctccctctctatatatacacgaggtaggcagcctaaagccacgaaccaaacttgtacaagatgttctaatcctctaggaaaccttctcgtacaagaaactaactttacaaactccaattgtaccaaatttagacaccctccaattcgaccagtcagatcgtgggctggccggtctgaccggtagcacctgcccagtttgaccggacccgacaatctagcagtatctgttcatcacctgcaaatcactttgccaataatctccaaatattaaaaccaataatcttatatgccaattgttcatcacagaataagaatcaaacacactttgattttacacttctacaatcatgatgctgattaaatcctaaaagtcaagccttcaccgagaatatctgaagattttgttacctggcattacgagaaaaatggtatcttttcaatatgcagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggaga

SEQ ID NO: 8114 - DNA, 1459 bp, Oryza sativa
  unsure (1)..(1459): unsure at all n locations
agggggccggtcgggggggcctagccggcgccgttgacaccttttggccggccggcgaggtcgggcggtggtgcgctggggcagcggcgacagtggcggaggcgggtgggaagcgctgagcaagggnncccggnggncgggcgtgtttgaaggaatcgggagaggagagaggatttttaaggttttgttgcctgcacgaatcttaaagcaatcgggtggtcaaaaatttacaagatttgtgagggggttttctgtcaaatgatctatagacattccctaattaattagggtccacaaattgctctcgtgtactgtacaactactagttattagagcaagtttaatagtatagcccactactagctccaattcatctaatagccaatctaatagctaattcatataataattgcttactatactattagtatatggtcctacctgtcatacacatattgcatcttggagtctttgctgtagctggctatagatctgtagcccgctgctattctctcttatcttttatcttattaaaatatgttggtacctggctaatagttacatgctcttagtataataatttactgaatacactatgcgcggggcactcctgcctgcgcgcgcagcatctacaaccatgtgcaggcaaggctgcggcatatgctccacgtttctaggttggcgccctattcatgtccatgcaagaccaagcgccgtctggagggacacgataaagacgaggtaaaacagacacgcctcttgtactggttgatacacagtgttttactgcaggttatatgaattaatacattttatacgttatagaaatagtgtgtgtatatgagaataatgtgaagataacaatttgatatcactcgcatattgagctctaaaaatacaactgtaactgatatattatgtttgcatgatatttaaaatattctagataataattgctagtgggtgatgatgtggcgcaattgcatgtaatttaaaatactctagataataattgctagtaaatgatgatgtgtcaaacttgtatgtgatttaaaatactctagataataattgctagtaaaggtgatgatgtgacacacttgcatgttaagttttaaaagttatttagcatcaacttttatagtaagataggatatgcaactattatcatatttttccactcatttttaagtacgtggagctaaatttaaatgttgtttacgtttatataactgtatacatatatgtcttatatatccatgtatacaaccatatcattccatttattctttttataaatacaattgtattttaatctaaacccaccatgcatgattaaacacagtaaatatacattaatttctccttttctcctactcacttagtaatattttaaatctccagagtgaacacgtggctcttcaattgttaataatacaaaacaacttacatatgcagg

SEQ ID NO: 8115 - DNA, 1140 bp, Oryza sativa
cgagccccgcgcgccgccccgagccccgcgcagccatcccgtcaccgcagccgcgtcgccgcccctccccctcctctctttcccctcttattcttcccctcttcccctcttccctcttccctcctcctccttcccccttatctctctcccttcccctataaaagcctcactattcccccccttctccccgtctccaccacccactcctccacgccgtcgcgccgccatcgtagtgccgccgcaccgccgccgtcgtgctgccgcgccgaccgtttccgtgcccgcaccgccgttctcgcgccaccgtgcgccgccgtcgctgccgccgtcatcgccgctgccgccgccggtgagtcgccctccgtttccctcgagtccgccgccgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaatttagggggaaatttaaaatatttgcaaatattagaatttaattgtaggattaatgaaaatatagttagataaactcttactaattaaatacctaaaatactagcatttaaatataggattaatgaaaatataatgggataaattcctatagattatagataacttttagtactctccataagaaatcaattcgcggtattaatttagatgtaattaataattaaacaaatgtatgaattctcgtaaattattgtggattatttctgggtaatctctataaataatcgatcaacggtagcgattcggatttaattactagagtgttaaccgtgtattatatttaatcatagactaaattaagtcgtataatattataagataattttaggattccgctcgacatttagctcgcgataagaaatttctaacctaatatacggatataatgctagggtagattaaattaaaaacatacgacaacaaaatattgtaaccgcaaaataatttaaaccaaaattggggtttgccatagttcgcggatagtaaaattaataaaaaggaattgactttcgcgttcgacttc

SEQ ID NO: 8116 - DNA, 1501 bp, Oryza sativa
attacagaggttggttagcagacaatctttcatttcatttgttatggatggcttgattttccctgaagaatgataacagcctcaggaggtggaaggaacagctaggtttgagtgtgggaaaaaaacattgaatgcgattagtagtacctgctaaaggttttctactttcaggcagatgaagtaagggtttagggtttagggttaaatcagctgagaattattttttttaacaaacaagatacaattgtgttctctgttctagtttagggtatatatataaactgaatgatggcaacctcgcaagaattatttccagataattagactgatgcattgttccctgcgtgccttgagaggtcagcatgttgaactagttgtactatactactacctgctgcttgtgacaacattcttgtttagggggtaagttttggcttgtcacactgggtattgtataggatgtcgcatggaatgtttgggcactaataaaaaaactaattatagaatctgttagtaaaccgcaatgaatttattaagcctaattaatccgttattagcacatgtttattggagcaccatattgtcaaatcatggagcaagtgcttcattgttgaatcatggagcaattaggtctaaaagattcagtcttgtaaattagtcgcaatcgtgcaattagttgttttttagcctatatttaatacttcatgcagatgttcaaacgttcgatatgacaaggtgtaaaattctaggagggatctaaacaggccttaggctgtgtttggaaccatgggttcccaacacgcacagtgcgcataaaaaacggagtggtccattagcacatgattaattaagtattagctatattttttttcaaaaatgtatcgatatgattttttaaagcaactttcgtatagaaactttttttaaaaaaaacgcaccgtttatcagtttgaaaagcgtgtgtgtagaaaaagaggcggaggaacacgaaattagcttttttattcgtgtccgaaaacccattccgacgtccagtgaaacatccgatagtaacttagcttcaatgcttcttctttcctttcctgtactagaatagttcttgtgttgactggaaagttggcttgtgtttgcttctcatgtatgaacaagtacgtgtattctaattgtcgtgtagtagtatatgagccaaaaatttgataggatttcttatatagttaccaaaatttggtagcaaactaaatgtagccactttttttatatctttattaaaatttggtaaggttgaaaatggtatcaaagtgaacatgcccgaaaagaaaagagtaaatgaaagaaaagagtgaatggacggcccagcagcatagtcagcccaagcccaatgcgtaccaaccaacggctgtgatgacgtgaagcgccgagcgcggcatcggacggccagggctcgcccggtgcccttttaaaacccgtatcacttctctcgcattcccaatcccctcacagc

SEQ ID NO: 8117 - DNA, 1501 bp, Oryza sativa
tcataacccaaaagggggaatttaccaaaccaaaaaaatgaaactgcaaacctttttcagaagtctgtctctctgccggacacgttcaacatctttttctagttcagcattgagggcctttagattattcaaagtctgctccttttgctttacagcctaacaaacgagataaatttatcgtgaatcgataccatagggttgacatctaaacaagatatgcaaggaaatgggaatagctttcactggtccaagcaagcataaggaaagagtgaatagtgaatgattcagctttaccacttgaagaatcttcaattccttactcctgtctataagctgacggtgctggataggtagattaggatctccaacagccttttcagtctcttccagtaattggataggtgtcaacttcgcaaattcacatactcggtcttgaggaagaaactgaacagagttgagcacaaaagcaacagaaatcaggaatagattcacgataaaagggtaagtgagtggctcctctggattacaatatcatggcatgcaaaggaaaatgataaggaatggatcatgtaaaagagctgaatctaaaatggactggaggtgcacctgggtcaagttgttgacttgaatattgaatttcttgatgagatcaatgacttcctttttggggacagtggtgcctgcaggaaacaaatgttagtgatgcaggaatcatcgcctcaaatccaatccatttgctgaataaaaaggatagtgaaagaaataagcatcggtttgtgtaatgaggagtaaggagagcatgtaccatcgagctgccactcagacttgttgttggtatcgaccttcctagtgatgcagagcttgtggtcgggtgtattgccgcggagggaaatcttgacatggccggagtcctctcccctcttgacgaaggcagcgacgctggatgccctcccgagaatctgcagtgcattggtatgtagtattagagtagcatggaatcaatcgtacaggagaggagaggagaggagaggagaagagagagtacggcggggtcggcggcgagggcgagggcgatggcgcagacgagggagctcttgccggagccgttggggccgacgacgaggttgaggcggggaccggggcggcaggtgaggtggtcgtaggtcatgaagttgcagagctcgatctccacgatgttgcccggcacgtagtcgtcgtccccacgctgcgggggcgggggcggcggcggcggcgcggaggaggaggaagagggatccaccttggggcgcttggcggcgcgggagctcgccatgctcgctctctactccagtactcctcctccagtaggttggttggggttagggatttcaatcaaggttcttcttcttctactgctactgctaaacccctttcctccgcggctgagggcaacaaaataaaataaaatccccttccgattcatattaggccgggcagtaggttaatgggcctgaaacccatt

SEQ ID NO: 8118 - DNA, 1501 bp, Oryza sativa
tcaaacccagcctgcagcgaaatggggtgtcacaggatctgaaaataaatcattgaaacaattaaatgaccaagacaagaatgagatgcaaagcttacattgtgtctggtgcaatgatacttctcaccagggttaccaagaccaacaaagagccatggctgtatcgcggatcatgatgagcaggatgaagataatgaggtctgagaggttgaaatatgacgcttggatatgaaaggggcaagtcttgtccacggctttcctcgcatggctaattacaaacatccacagatccaaaaacagatgcagcagtctgcagcagaaaaccagattattcttccagatacacaacaaaaacaatagtacatatagtaataaaaaatatgataagactcgctcatttattgattttaagggcaatgatgtttcagcaataaatttctttgagtctccaatttgtaggcattgacagcttgattgttagatgatatgtacaaaggaatatctaaatgtgcacaacacctttctaccctaacaacatatagagaacagttgatttattatgcactagtataaattccaaacagggcatggaagtcttcactcaagcctgcttcctcttttgaagatgaggtgagtttctaaaaaatgaaatagctcagaaaaattaagttgtttaattaatcaatgacatacctaacaaaagtagcttgatctcacatcaggatcaccgtagcacgtactccgtagtaactataatattgttgaccgaaagtgaaaataaaagttaaggatgtgttgggtatgactttagaacttggatgcaaattgtgtgaagtgaaacttatgcactagtggagggagcacgattatttgaggagaaatgaagaaacggcagcactagctgaatgagcaaaaatccactccatgagaggagaagataataaaaaggggagagtagagttggagggagaagaaatcacgtgtggctggaatgaagggcggaggcggagtgggatccccgggcagggcagcgtaacgaaggaagcaggagaagaggcggctggacctcacctagctatatataggacgacggcagatccacacaggtgcccgctggtggtggaggcgccggcgccggggaaggcgaacgaggtgggatgcgggaggctgcgagcgatggagaatagtagtgggcttccccttcgaggccggcctttttaattaggcctgaatgggtttcaggcccattaacctactgcccggcctaatatgaatcggaaggggattttattttattttgttgccctcagccgcggaggaaaggggtttagcagtagcagtagaagaagaagaaccttgattgaaatccctaaccccaaccaacctactggaggaggagtactggagtagagagcgagcatggcgagctcccgcgccgccaagcgccccaaggtggatccctcttcctcctcctccgcgccgccgccgccgcccccgcccc

SEQ ID NO: 8119 - DNA, 1501 bp, Oryza sativa
gtaataggacccatcccacgtgacattgtaaaagaatgcgacatttaatagaaatgcgggacatttgtaaattgggtacaatatgatcaattgtaatgcatgacctgccttgctctcgcactgatgagaccacagcaacgttttcgagaaaccgcggatcgacgaaacggccgaaatctacgcgacaaacaaagcacacaagcaaaacatgctataggactactgaaacaggaaacaaaaccatttttaatggattccttgaatttttatgaatttactgagacttgaatggacttaaacggagcttggatgaattacttatgaattttagaagataaactgtgtttttactaataaagaaaagtccttaatcaatttattgcgcaataatacccagtgccggacagagggaaggaggaaggagaggagctcctcaccgtgagcacggcagccggcgcgaaggatgaagacggcggcgatgaccggtgatgcggaggcacggacgggcggcggcgacaccctaggagaagatggagaggcgttaggagaggagacgacgaccacagcggcttgaattgccggccggagatggaggggagggaaaaactcaccggctcgcgaggggagaggcgctccggtgggattccggcaacgtgaggcggtggccgggaaagctcttgtggcggcgaagctaacggcggtggcgggttggcgcggcggcaactctatcagcggcggcgcgcaaccaaaggcggcggctagcggcggcgctagcagcgagcggcgcgagcgcgataggaggcacgggagagcgcggtgaatgagggaaatgggagaggaggtttgggggagcgtttttatgggcgagggaggggcggaaacggccggggatggcccctatttggctgacgatgtggggagtggagggagagagagagagaggtggattcgaatgcgaatcccgtccatttttgggcgggcgcgagagcgggaagaggtgggggaggggcagcgacgtgggcgcagggcgcgattgaggcgcaggaggcggggaaggtgggcggcgtggggagcggcggtttcggcggtggttggcgccggggcgtgggcggctagaggtaggggacgaccccgacaggtgggccccacctatcggcgcccgaaagagaaagggagggagggaggacttcggggaggggaaaggaggagcgggctggcccaggaaggggcactgagcgcggggagagagatgggccgacggcccatctagagaaaaaggaaggaaaagaaaagaaaaagaggaaaaggattttcctgggattaaatattgcactttggtgatttttaattggttaaaattctttccaaggctctgaaaattccactaaaaatcctctgttaatgtattgtgacatgcggaaaccaagaaaaatcccacaatgccatttccaattattaattgcatttattaattagggattcaactctaggttaattagaa

SEQ ID NO: 8120 - DNA, 1501 bp, Oryza sativa
atttctggacgtgacacaggtcctaatacttgtgaggtatcatgtcctgatacctaaccagtatcatctcgtaccaactggattatgttgtatagcagctccaataaaaaagcagaacgaaattcttcgcctcgggcgaccggcgcgggggagcaaaatcgcccccccccccagcgcgacgtggatgcctcctgggccccaccatttgtcatgcctccacctaccacgtgtccttaccaaacatgtttcacctagtgtactcacaatgttcactatgtacagatctaatgttgcaatgaattgaaacattcttttgcaacaaatcacccacatattttgaaaaccctctattaaggaattcgttttaatttttgttccataaaaaatgtttcacctagtgtactcacaatgttttactacgtatagatccaatattgcagtgaacgaaacattcttttgcaacaaatcacccacatattttgaaaaccctctattgagggaattcgtttcattttttgttccaccaaaaatgtttcacctagtgtaatcagaatgtttcactatttatagatctaatattgcggtggattgaaacattcttttactattcgctgaaacattgtttttatataaggtgaaacaatgcccgatttaaacgattgaaatatttttgatctacttagtgaaataattccgatatacttggtggaacatagtgcaatatttaaaaataattcaataataagctaaaaaaattcgtcggaatatatccatgtgtggtcttgttttgaagctttaattttaacgaatttaatggtacaatcgaatcatgatttggataaataatttaagagaaaaattagtttaaagtggttttacacgcatccggtggcgctgacgtcttttttttttgcccgatcggtagtggatttggatcgtctgacttcaccctgtgaaggcacgggcgtgccgtcatcacttatccaccgtccatgcaatccaacagctcccgagcacagagacctatgtcagcccaacaagaagcacgttctccagactttaggggttgtttggcaggactcctctccaagaaaatagctccatctccaagttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggtcacaaaaaaaacgattcgcttctatttcactgtaccgccccgttcccgttcctcattcgtgaaaaaattgattccaccagagcgccgcccaagtctgcaggcagatcgccgccgccgccaaccctagagccgccgccgccgagatggccggatccgcctctgtccaagatggatccggcctagaggaggaagtcccggccgccgagatgaccatgggcgccggactggagca

SEQ ID NO: 8121 - DNA, 1501 bp, Oryza sativa
gcgaacgagcgcggggagcggcagcgagggatggggagacggagagcgagggagaggagggggagatgggccgagcgagattcggcccatcgacctcgggggaggccaaatagacttttgcggagaaatttgatttggaaggaattggattcagaattgaacttgacgatagatcggggattgagatcttgagatggcatggacactagacaacaagcaaggaaacaaatttcgcaattagggtttttaagagataattttcccgctaggcgccacgacggaacgggcgctacagtgatgcgtgagataaaatggcgacacgaggaagaggtgagattagaagtgagaacatgaaacaacgcattgcgtcatgtcctcgaggcctcgatcgactcattgagatcggcgacagccacacgaccgcgtctccctgcctccctcattcttccctcaaggcaccgagaatagtagcggtattgggtgacctgcctcggtgcccagcagcaatattgggtgacctgcattgggcaggtgtggtgatgatggccccctgctgacctaggccctaagcggtcgcacaactcgtcttgacccatagtcccctgctcgtactgcttgctacagagcacagagtagaggccgacgacgatgagcacgccgttgagtagatttccaagatgcatcttctcgttgaggagggagcccagcacgggccaccaccaccagcatcagcatgagcgggttgaacagcgggccgcattgcttcacacatcacgatagcaccaccagcatgatgtcgaaatagttggagaaggagagggaaatgccacagctcgccgatgagctcctccgtgaccgtcacccctctccccgtcgaccaccgcctttctctccgtcgcacgcctcccccctcccgacttggagcgagagatggggaatgagaggggagaggaggagtccgggagagaaatagatgaggaagaagggttggcggttgacatgtggatcccactcatcccgtcaaccaaaaccagctactataccgccgggggatgggcctagtgaattgagggatttatagtgaacttactccttatcttttcagttcttgttccaattccgattacggtggtggcccatgtaattaaaaggcccatatatatataagctggcaaggccgcaagactgaagaggagaggcaatgccatgcatgcagatgaagatcgcttctcttgtatgtaagtatgtatgtagaaggaaaataagggggaatatatatagtaaaatagtaattcaggagtggtgggtgttcctgaaagagctcatggccacagggcttaacatagaatcatcttaattgtgcggaagaaacaaagcatgcacgcgcaggaggatggagtagtagaatggatggatggatggatggatgagggtagctagctaattggcaaattaaacaaagaagaagaggaaaggaaggaaggaagcgaaggatcgatga

SEQ ID NO: 8122 - DNA, 1501 bp, Oryza sativa
aaatgaggggagaagtgatatcaccaacaatgaagttcaccgagttgtttccggagttcaaatccttgagggattctactctccgttgaggagctcactaagagccgggtctttgctaaccctttcctcaagaggttgcactaagcactcctccttccactaaggggtatctctttccttgctgaggcgagatccggccttcacaaacttctcccggccaaccacacgtagatcggtggctcggaagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagagagagctcaaagatccaaagcaccttagcaccaagctcaacccaaagtgaatgagaatgaaatgagttgggtaaccctagaaaagggttaggtggggggtatttatagatgcccctaaaatgtggccgttgggagagaatcttttcatcccacctcggaaagtccgaggtgacatcggatagtccgatgtttttgacacccaagcaggccagagacaaagaacgaaattctggagaatttcggacaatccgatcgatcggatagtctgatgtcatatcggatattccgttatttttgaaccaagaatttcatcctctcacagagactcaagttccattgaatttcggagtctttgggtcatcggatactccgatcacatcggatagtctgatttgaaactcactcaagaggaataaaaagcaatttaaaacagagagtgaagttctgggaaatttcagatagtccaaagtatcggatagtccgaccttatattggatagtccgatatttttagccaacactcagaccaaagacagagagcaaagttctgtgaaatttcggatagtctgagcatcggatagtctgatcaagatcggatagtccgacaggaataaaacaggaacacttcaaataaatgattttgagcactagtgttctaccaaatatatgcatgtggtatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcaatatgaaatggggaagtacctcttttgatcgagatggtatgatgttgggtcgtatctaaaaaagtttcaatatgcggagactgagaaagcggcttgatatgcatgtagtcctaggcaaagtggggcaaacccagcccagccgagcaggtaagagggcctcaatctcccctccaacggggattgataggcccg

SEQ ID NO: 8123 - DNA, 642 bp, Oryza sativa
gtcgggatcgaaagtgtgcttatgatcaatattgccagttcgtatttcagtttgccccctagccgaatttacaacatttgaactctgtgcgtgtttgaaaatatacatagtactatttgattgacattttgaagatggaactactagtggaacgactattaattcggctataatcgctactagtatatgaagccgaattatttccactagatattatgtagtgcgacccataagactgagatataacatgtgactgaccgatacttggcatggcatgcaatgatctaatagaatcaactgaattataaataccgccatagccatacatatctttcatcggcaaattttgttgtgtagtaataggttccgaaataatcgccgatgaattaaaaggtgcgcctacatattgtttattgctaccattattaaaatttaaagcatgtgaattattttgcataggctgtgacttgttattctcataatttaaagatcttgaacattgatttaaagcatatctagcaacattgacatgagtgttgatggcacttgaagaattattttgtggaacgagcaatgtgtctgtagagtgtacctcacaactggcatagcaaggtgaccacgtagcactccagtacgcatcca

SEQ ID NO: 8124 - DNA, 771 bp, Oryza sativa
gacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatt

SEQ ID NO: 8125 - DNA, 765 bp, Oryza sativa
ttgttaataactctgctttgatagaaatatcattttgagtaattaaggtttgctgagtgagaattacttcttgtttagttgctaattagcatacgggatcattgttcactatagtctatttatttatagtgattgctttagtgtttgatcggcactagagtagttattaattgcgtagacgcggtgtctgggtaattaatctccagtggttactgcgtatcccaaagtacgtttgaggtgggtgtagaggtggtgacagccctcaagagcacttaagtcctccctatccgggtatgtagtagagcgacatctgggaacagcgggttgccagtgcctgaagtattgcgttaggattaaacataagctttccctagacactgtttctcattaggaaatcctctttgccctctgcccacattagctttgtgtccttggatgaacctgacgaggagataaccacacacgttcccttggattcgatacccatggaatactctgtataggaagtgctacatcgttatatccgtgcgcttgcggattctatctgtgatcgtatgaaataccaacaagcatttctggcaccattgccggggaatggttgctgatcatttccgaaccctgttcatcctcgcatcctttttactttttttttaccttcacccctgctatcctagagaagtattcctgtcaaactcttctcgaccatggagcaactgctttttgagctgtctgctcctcggggcgaattctatgaaccacctcctt

SEQ ID NO: 8126 - DNA, 1501 bp, Oryza sativa
agataactgtggatcctgcacgcaaaacaaacattgatcaatgctaactgacaccagagtgggtgaagaatgcaacaagttttgggccgcaactggctgctggccactttttgggccagaacgttagccagtcacttcaggcccattttatctgggctgaaactgtacagagacgaaaatgcggcccattatatacgtgccggataaacaggctataaatggaaggaaggcccatggaatataattgcatgggcctagaggaaccgggagttcgcaccaccactgcactcttcctttttctatctcttcatcactgcaaaagataacacaaaatcacccatcgacaaaaataaaaaatgctttacttcaattcaggtactctaacagatggacttactacgctttatttagtttgaaaactggggacttacaaagttacaccggccggtgaatggggatgacgtaacagctgttttgcaaccactcaatctaatcattcgaattaataatagcgaaatctttcgctaatacatgcactaatcatgaatggagaggaggctacacgacgacaagtaggatatttttttataatccggcagtttgcgctctcaaacaagttcataaccaccgattacgagagtgacaaatgaccgtaacaccgcaccaaccttcttctcgccgtccaagttcaaccgctctgtgcacctggaccatacggagtagtagaaatttggaatagactacaaacaattttttccaactacggcatgtggtgcacaaagtcgtattcttattaattaattataggtaggagccttggtattcaatcaagacgaaagaaatgtccacaaataggtatgttttgcagatgatttctcaagtgtacatcaacagaagttgaacataaatggattgatgcctgaatggtttttcaaacgtatcctctatttgaactagattctctgtttttttttctattattactatatatatcgtctggtgtactactactaaccaaaaacggtatataagaaaccaagtcataaattatggaccaaacttttctgtttgtgttttctgcggtttaaaagttagtgttgaataaaaaaaatcctaaatttaactcaaaaccaaagttttataatttaaattttaacaacggcttataaactgtgaggcaaatgattggaagcttttacctccctgttttcaataaggatttggaaaaacctttttaaaaaccacatctagaagaagggatatttaaaaacaatcacaaaaaagttcttaatcgttaaatcgaactatatgaggagcaggagttatacaaaaatctaaatttacttgtaccatgccacttcagcgtttgtaagatttttttttcttgaagaaaattgtacgaatcgacttttccactttcaaattcactgttcaagccgccgtgcaaaattcgtcaacacccttttttttctccaaattttctccgtctcattccctaaac

SEQ ID NO: 8127 - DNA, 1228 bp, Oryza sativa
ttacatacaagttacactgtagttacatacaagttacagtgtaattacatacaagttacagtgtaattacattacgattgtactataattacatctgtcaaatttttagtagaaaatttgtcgacaaatgtatagttggtcccatagctaaatcggatatgaaaattttcaactgaccgagaattgttgagttttttttcgaacgcgcaaaagaattgcatgccaatatattagtagaaaaaaagagtgctacgcactcaggccccgtttagttctccaatttttttttctaaaaacatcacatcgaatctttggacacatgcataaaacattaaatatggataaatgaaaaaactaattgcacaattaggagaaaaatcgcgagacgaatcttttgagtctaataagtccatgattagctgtaagtgctacagtaacccacatatactaatgacggattaattaggctcaaaagattcgtcttgcggttttcaagcgagttctgaaattaattttttcattcgtgtccgaaaaatccttccaacatccggtcaaatatctgatgtgatacctaaaaattttcttttcacaaactaaacatactcagtcaattgttgagtagaaatgctatccttccgaccgttttcatccctgaacgcatgtacgtctggtgcggtgcgttgctctgctcgtgtggccagaggcaagaggcacgcatcgcgaaccgtgtgtacagggctagctagcttagcgaggtggtacaagttgaggaaagcttaacgcacaaggagagtatatctcgctgcgtcaggcgcgggctccaccggcggccgcccgccaccttccattccttccttcctcgcgcctccgtctatatatagcagctatgccaagctcgctcgcctagcctagccggtccacgacgaaaaccaacacatcaccaactgctcaggcataattgctttgccgccctccaggtcggactgactgctacgtctctgtctacgtataccccagcctcctcgtcgtcgtctcgtactaggatcttgctacaaatagccggctgcttgctagctttagcttcttccttctcccgagagagacgatcgagatcacgcgcccacagaaactgcagattaagcggcagagattgtagatagcgcgaggttattaaggccagcagtctgaccgcgcgcggcatgcccttctgctgctgcaaccgaccaaa

SEQ ID NO: 8128 - DNA, 215 bp, Oryza sativa
cagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaagg

SEQ ID NO: 8129 - DNA, 1094 bp, Oryza sativa
cagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaaggactcgagccagttgttgcctccttgatccgtcctcgaactccagccatcatcgcctctggccccgaaaacgagccgccaccaccatcttcaccccctaaccccaagcaccggccaccaccttagagatgccagatccaacctccctgatatcggagacactgaatatgctctccttaacatcatataggtggctagatccaatgcaagccaccatcccctaagccccgagtgctagtgagcctctggacatggtagtgagatgtgcccgcttgtatctcggtggcctagtagtatgacgggcacaaagatgggcttcggaggtgtgtagctatatgggcatggcatccggatctggccacccccatcttggtgaccttggtggcgcagtaccgctggggtctggcaaagatgacaaggaccatgatgacgagcacaacaacaacaatgggcttcggagggggcatgcgatatatagtggcacctttgaatgggcatagggcataaatgaccaacatgtataggcatcgactggcttgtcgagatcgtcaaaaagtacaagatcatctccagaacgctcagcctggcctcaaccaccaattcctatatcccttccttctcctgaaccgttgggccagagccaaacaaaaccccttccccctccccttcctcctcctcctcccactctcacgccccttcctcacctcgcctgagctgacaaacaatagtagcagcttccctacaaacaaagatggggtatatacgcacacgccaagtactactcaggcctatagaacaatatcacgcccttttgcaagtctattttgctcatcataggcttcagggtcagccgctgtatcacccccaactatagatggtca

SEQ ID NO: 8130 - DNA, 1501 bp, Oryza sativa
tatgactatcaatacctgcatataatggaataaaatatggtattcaacttagtggtagggtttataactaatcatttctattagtgttggtatatatttggatgcaggtgacaaactaacaaagttgagaggaaatatacatgaaggaggataatcaaacacatataccaacttatggagttttggacccaaaaacccaattaaacgcctccagatggcccaatcctccatgccaatgggctaagggcctcaaaattagtgtccacgaggaaaaatgagccgaacggagccatcccgggttcggttgaaccaccagtttagccaaacccatttggaggccgttgatcgcctgattttacatcgatggccctgattacatcctaatggcggttccggggcattttggacatttggcataggctctaaccgtcatacctgcctataaaaggaggagctaactcttatttccaacacacaactttgagctgaattacaagaggctctgttgtatcttttgtacattaaaaataggtagagagtgaggggaagctctggaggaatgcccggaagtttggtgctcatccgacttctaccacgatgagtgtagcttcatagtaggaattctggaggagtaccggagttgtcggtacactttactccgggttcgcagaaacttcttctataaagtaagcatttgggatcctttcttttttattatttaattatttagtctaagtgagatatatttccatctttgtgggttcattatttagtattcgtactaagtgctctagtactaggactccggatagagaaggaagttcctacgcaagtattagagtagtaattgtttattgtgtatcccacagatttgtcagaggtagacggcaggtggtgacagccctgaatcccgtcccagtaatcctccgcattcggataaatcatagagctatagccggaaccacgttggcagaccagcaggggtcggtgtccggagcatcatacaggaaattatgttttactcagcttagataattaaaaacatagaaagtcctctctagcctgcctagcctaccttcagttgttgttcttggatagtcttagccttagatagattatacacgttccctgagttcgatatccgtttggggttacccgaatgtcacgcctagaaattcatgaaccagaatttctaagctgaatgtgcattaaactaaactaggggtgagactaatcacagtgaatctggttgatcgcccataaccgcgagcacgactattcgaatagttttactctggccagaggtgtacaactgtacccacaagatatgattccacacatgtcgccatgccccgaagtatcaccatgatactgcaaagggggaaatcgtgacaagaccctccgcataaccctcccctaaccattcacaccacgctaaggtttcacccccacccctcaaaaggcagtgggcggtcccctcttgcgccgcggtgaatccggc

SEQ ID NO: 8131 - DNA, 219 bp, Oryza sativa
  unsure (1)..(219): unsure at all n locations
cgccaaggggcggggggaagccttatccgcgattccgaacaccatccactcgccgggccaaacaccacaagtcctagccaccgcggcgcccccaatgcgctctcctcttggttatcccgtcgccacctcgccccatcaccctctccctccaccacantacaccccgctccactctcaggcaggcaatcagcggcgaggcaccagcccaccggccggcaa

SEQ ID NO: 8132 - DNA, 1501 bp, Oryza sativa
tggggatatcttgttccaccaaaaaaagttttgtagtgaagttttaagtatgtttttttaatattgttctatgaattatgttgatggtcatcttgtaccttattattgttctgtggattgctttcgtgggttactttgtcgtcatgaggaatactacaaaggatttaatatcaacatctcttattgtacaagtggagtcatccatcttccatcccctctcacagcgcataccgcacgtccttccgcttcttctcacgtcatgtgcataaccaccatacgaatcaatgctttattctcaatccaccttctcattctatatatcccaattttatttatatgggcctagcttgttacaactacagacataatcttaataaagaagcaaatatagcttcttttgcaatattaaattaggggagatggtaagcatttccttcaaaatggcttgagcacaggctggtggctagctcttggcagtagggttaaaaataaacaatgaaaatcgcttggttttgatgaaatttcgaggcttcgagtcaacttgagttaacaaaccatttggtaaaccagttaaattcaaatttatatttttaaatcaaattactcgtgtatttgtacaagacatatgtcattagaaagggattgccctaaataatactccctccgatcatgaatatttgacgctgtcgaggagtaatcctctctagcgggagatcgtgagatccccttttgtgagttcggccggaggaggaggtgcactctgggaggtcgattatccgcggttaaagccactaaagcttacacaagcacaaggattatatagattcgggccgctacgaagcgtaataccctactcctgtgtgtgggaatatagatcggaagtacaagagttcctctagctccagagagcttgtctctcctattctactttgatcgactctagaactgcaccaaggacatcaccaacttgaggctagagcttgccttggcttcattcaagaaaaccatccccccttgtttagtgggcacggtcctccttttatagtctaaggggataccacatgcaccgcctctacctactcttccatggagaagggaggggggcaccctcccgtggccaatccgcggcccgtgcctttgcccggaggttaaaccgcggttggccctttggtggggcccagcgccatcctccacctgacacgggggacagccctgccattcactcttaaacgagcgaatgccttcgcccggaagccaagccacggttggccctttggtggggcccggcgccgtcctccacctgacacgggggggggggggtgggggggcagccctgtcattcgctcttaaatgagcgcagaccggtggctgccctcctctcgtggagaggagtccagatgatgcccctgatgtgacaatacatagctacctccactccaccggggacaaaggagacgtggggcatggccgcgcgtcaatcggatgtgaccggtgacaggcc

SEQ ID NO: 8133 - DNA, 388 bp, Oryza sativa
aaaaaaaaaacttccctagtccgtgttttttttgaacggaaatattcttaacttgtttatgcatgttagtttaaaggtgggagttttatggggtactcccttaaatatatcagtaaataaacatgtactccgtcccaaaatatactcctcgctacgttcaaaacttatagttcttagtacatagtacctacttttctcaaccaataaacgaacatccccatttctcaggtaaaagaataaatgtccctatttagttttatctctctagcttgttagataccattaaaaaattttataaaatgcttatattttgggacggaagaattactcctacttctctatgcaggttagattgaatgtgacaattttctgtgatactctttttagt

SEQ ID NO: 8134 - DNA, 583 bp, Oryza sativa
gccggcacggcccgagtatccgtcccgtgcgtgggccgctggcagagcccgcgggccggcacggcacggcacggctactgtagcgggccagcacggcacggcccgcggcacgacacgccggcggcccgagcggcgcactgacagggcgggcagcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 8135 - DNA, 394 bp, Oryza sativa
taaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagc

SEQ ID NO: 8136 - DNA, 1077 bp, Oryza sativa
gtgagatcgccctttttgtgagttcggtcgggggaaagagcttgcctctagagatcgcgtatccgcccttaatgctactaagtcacgtatgagcgacaagattatacatgttcgggccgctatggagcgtaatacctactcctgtgtgtgggattaaggttgagtgttacaaaggctcctaaactccggagagggctctcgctcttcttctcctaaagttcaggcttgctgagagtcgtcccttttttcggtgggcaaggtcctccttttatagctcaaggggataccacatgcaccgcctctacctactttttcatgggagggggacccacttcaccttgtccgtgccacgatccgcgccttcgctcggaagctaagcagcagcctgtccttgagcgcgacccagcgccgcccctcgcctgacacgagggacaaccctgccatcccctcataaatgggtgaagacttgtggtggtcctcctctcgtggagggagctccgaatgacgctccgatgggacgggtcatacctacctccactccaccggatacagaggcgacgtgggggcacggccgcctgtccaatcggtcttgaccggcgatgggccggtcacatacttggtcagtcctgactgacgtgcgtcagtcaaatggcactgcaagtctgcccctaccgcattaaatgcggtgaggggcagttggggcgccgcgcgcattgatagcggttcagcctgggtcccctccccgctcgctccccctaccacatggcagttgggcgagggcctcggggcaaggcagcgcgagggcccgaggggcatgacgtggcaccccgagccccccctcctcggccacttctgcaattcgtgaggcgtgggggtagggccaggctgtagggccacgtggctggatgggccactttgcatacccctgggcccatatctccgacaccctttatcctaaattgtactcctatttttttgaatggacatgattgtcgacgtttgatgtctcgactacggtatttggacagtatggggatcgtcggtgctaggatatacgcgagactgaggtaaaagaga

SEQ ID NO: 8137 - DNA, 1501 bp, Oryza sativa
accacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatggtattgcggacttggcaaaaccgctgaatgtacgagcgaagcgactcatcatcgccccgctgtactgcatgcaagtccgcttcttcgcctgggcgaggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccggccgggggcacggagggctgatcctcacgtccatgtcgaggtgacactctggacgaggaggcgccctccgttgcacggggagtacgccggttattgcgccggcgctcgatgtcgaggcgggcatccggctccccacgctgatcctcccgagtcgacggtgtcgacgagggagtggcagccgaatgacgtgcagccgccgccgctcgccgcgccctccgccttgacgacacggagccggtggtagcggcgccggaggtgttggtggtggcgatccgtccaccagcacccaggcgctgctgtgcagtcatgaccaagttggccacatcttccagccatcgttgggctggagactccgggtcatggacgacaggtgggtgtcgtaggagcgcgccagcagcctgaagcgcaccctgaggcgtgctgccgtcgccgtagacgaggaggcggcgctccccatcttgccgtcctcctgcaccacctgcgactggtgatgccatggacttgtcgaccttctcaagcgcctccccctgcttagggcttcggcgcggaggagatgggggagtacgagctcgacggcgtggattcggctccccgtcgtcgccactcacactcggagagaggtcgtgcgcctttgcttgctcggccattaggctgaacaagggaaacttggcgcctacggaagagtctgagagctcagaaaacacacgctgagcccccctacctgg

SEQ ID NO: 8138 - DNA, 1501 bp, Oryza sativa
tcaaagcaaagcgaaacaagcctccgctgtcataaccttttccaacaaaagtctcatatttagatacgacacatttattggactcaaacacaagtctaaaaccttctctacacaatagagagccgctaacaagattcttctttatatatgaagggacatgctgcacgttcttcagctgcacggtatttcccgaagtaaacttcagatcgatcgtaccaacaccatgaacagccgcaagcgacccgtttcccatcaacaaggaggaacctctcccgacctgataagaagaaaacagagaaatgtcagcacatacatgaatattagcacagtatccacccaccaatcaggtgagtgaaaaacagagagaactgtaggtaatattttaccgtaccccgatgttcctccgccctcgctaatgaccatgttagcagacttcctgtctttgcgctcaggacaatccttggcccaatgcccagacttgccacacacaaagcagtctccctttgcctttcccttgcctttcttcttaaagttggttgcagccttgggtttgacatcaggcttgactttcttgttgttgtgggatgcttgagtgtcacgcccggaaattcacaagtaatttccgaacttatttgtgcataaaatcctcgtccaagaatcagccgaggtacacaaactgacaatttaatatacagattcatcaaattaactaaaccgataaatacttacttaagaggcacttagtcctcaccaagaagaaaactgcagcggaaagaaaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggattccaaaggatggcataatatagggttcatttgcgaaagcagcatttagcaaagatttaagataagtaaaacagtagagtaattaatcagaaattttaatcaacactgaacagcacacccatgctgcacaggcccaaccaaacctgaacaaccaaccccggtcgtacagatcaaacctccaaaccaggaattatccattccaaaccaggagtcaaattaattatcacattattaccattaatgagtagtgtgggactaatcacgaaaaacattgctcaactcgcccataaccgcgggcacggctattcgaatagttttactctggccagaggtgtaccactgtacccacaagacacgattccacacatgttgccatgccccgaagtaccaccatggcactgcaaaggaggaaatcgtgacaataccctttgcacaacacaactcaaaatagtgcaccgttcctggatcataatctccccctcaaaaccagaggaaatggactccccagcgacccccacggacttctcgccgcttcatagtctggcacaccataa

SEQ ID NO: 8139 - DNA, 1501 bp, Oryza sativa
ggcgattccatacgttttgccaccatcatttctgtgatggttaatttggtcctaggcatgttctgatttctgacgaagtcttcttgctctgatcggctatcattcttgctgcatgggtggagtttatgtacatgtttcgctagtttattcattataaactgaatcatctatctatcttaaatttggtgctactggagctattcagttcagtttatctggagtaaacgatcttatgtgtgcgaccctatatactttgctggacgagatctatatcttaatattgatgctgctcttgattcaactagagattagggtgtacatatatatatattctcgctgcattagaaaggacacatttatcccataccaagttgtacactcaacatagttatgtttacatcccaattttaagagatcaaaagcatttcaagaacaattgatagaacgtagacctccaatataaccaaagaaacagaaaggatggctggagttcagacaaaatttgggctaaatttaaacaaaatttgttgaatccaaagcccaatataaattgaagaaatcatttgaattttttttgcttaaagttcaataactattcttaagaacacgaatttcttaaagtttagaactccaaaacgaagatttgatatgtattaaaaatgacatttcataggaaccaacttcatttttgcgacataatactttcctataattaaagatttcatgtttgtaagtaattttagtttagaatttatgtgttgcaaggataattagcattcaaaatattcacaaacaaaatattgacaaaaaaacaggttgccaatagaatcaggaacaatcacgcatatacaaacattatattcacatgtgtagagtaatatttcaagcacattaaattagatgcccgcgcatatgcgcgggcttcctttttagttgttctaattttagaaaaactatagtggcatccatccgatttcatgaatagtaatattatttttgcaatgcgttgtatttgcagtggcattgatccaattaatttttttattacctatcattgattaattaattaattaattacctatattgattaattaattaattaacatacttttttaagaaaacaacgaattaattaactgagccgaccctatccaagcgagccgaattaaaaaaagaaaaaaaaagaacaaaaaagaacatacgctgatcctatatccatccgccctctcgctctctggtccgcctcgaccgcgcgggtgcctcgattcttccgcctcatcttatctcccctcctccgttcacatttccaccccctcaccctccttttcacactcgccagcgtcaccctccatcctcagctcctcccctccccccacaaaactctcactctccccacctctccttcgatctgccccgtctcgcctccctcgccggcagtggctccctacatcccgtctcgcctccctcgccccctcctcctctccctctcacctccctccca

SEQ ID NO: 8140 - DNA, 535 bp, Oryza sativa
ggggccgcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 8141 - DNA, 1458 bp, Oryza sativa
tttactgctgtcatttccttcctacgaaattcctcatcaaacaattgccaccaaaattcaatctggcaatcttttctttcaggccatgtgctgtgcatagaactggaaatgtataaaattttcaattatcaaagaagaaacctatgttcactactactactacagagcacctaatcgaggacggcatcatacgttttgttttatctattccaaccgaggcattttctcttcgaatataaaagagtacagaactcgttttatggtaaagcgttaaaggtacaacatttaattagcattgcctcttgttgacaattatatatgaggtgatacgtggtcacacgaataacaagcagtgaagcgtgcacaaatatgtaaacttaccctttttctttcccaaaatcatttttgtacaacgtactaaatttttcgaccaattagatctgacaagcactaaaccgcgtgtaaatataaagaactaaagtcccccaagaaacaaattaaaaaaatactaaaactacttgcgaatgtatatgtatatatatatatactccatccatactcgtaaagaaaatcgtttatgacaatatttaagtcaaatcttaggaatataaatcatgaatagctctcaagtttgtcgagtttgaaaatgtaaaaatttatatgaatagatttgtcttgaaaaatactatcataaaagtatacatatattatttttcaataaatatctttatagaaacaagaagtcaaattgtattttgaagaccgtgtcgctatccaaaacgacttcctttccaatccgagtacggagggagtaattcagtacttattcccctaaaattcagtaattactaaacattcctacgagcagtttcatccaaagtacttagcatcttcacaccaaaagtcctgttggtaataaatattcaacacggctataactttcgttcttcgttaaataaacccataatttcaccaccaaacacatccatgtgcattggaaacttcatggctaaaggcgtgaagcatcttcggaatcttcaccaaacgagaacgaaactctcttggattgccataacacgaccgcgaaagaccaaaatcattttagtcattgcccaatgaaaaacatcaacttgaccaagcgctcacttatcattgacgtacagcatctatgtcagtcaccagcgacctcattaccagaagtcccccagcacgcattgcacaagttaattaatgtgtggaccagtaagtaaaccactaggcactagctccaaaaaaaaaaaaagctttagaaaacgacctgatctcacaccaaacgcatgtcaatccgtctatataagtagccgttgctagaagctgccatgtatatagtcctaaccaacagtcaggaacagcaacaaaagtaagccaagaatctctctgcctcccaccaacaaccacacacactcacagctttggtca

SEQ ID NO: 8142 - DNA, 1501 bp, Oryza sativa
cgtgtgcacggcggtaatgatgagaaatcgagctgagctattgagtaaggggattggccgattgggtgtagctagctagccgtctagaggaattacaggtagaagagagaagggaaaagtacaaattaccctatgaactatcacggtcggccaaatttcccacatgaactcgaaaaccggacattactcaccctaaactttcaataccgaacgaattacctccctcgacccaatccagagcagttttgtcctacgtgacgtacgcgtggcaacctagtcagcattttctttttttaaatatggtggggcccacctgtcattctctcctatcttctccttttcctcttcccctcttcccccctctctctctctcgcgacgtcaggcgtggtcggcacgcgagggccgcgatgggcggcagcgggttgtcaagcgtggacgcgcgcgggcggtcggcacgcgagggcagcggtgggcagcagcgcgtcgtcaagcgtggccgcgcaggcgatcggtgcgcacggcgccgctcgagggcaggtggtgggccgagaagatcgatccggatcctctccagcggccccgtctttttcgttcttggtcatcaggagagatcgatctccttggttttgtcattgtcaagcagcagcaacggcacctcgctagctaggtcaggggcgaagcccaatagaggcccgtgggtgcagatgaacaccccttaaaaaaaaatttagttattacccccatatctctgccctaacaacagtccagttaacgttgtaaacccatgaggagagtcaaatccagatcaatcttttctcttctcgacttctcgtatgccgcgtcccgtcgctgctaatcttgacgactctgcctcgcgtctgtttggcttccacgccgctgctctgcaatcagccaatcccagtctcccagacagcacttgcccatctcggcaccacgacgcgctgccgtcggccatcgccctcggcagctcgccgtcgccgtagcccctgcttgcttagcgcctgcattgcttgctccagccgcaggagccgggaaggcaggaagccggtcgccaggcaaccagctaaccaggagcaagcgtcagaccacactttcacaagccatgaagccaacaacgacatcatccatctccatcaactgatcagcacacagccacattgtgcattagtagagacaaggtaagaaagcatgcttcatctatttcttttttaatcaatttgatttattagatacaaaggcctaaaatttttattggttgtttttttttacattgtagaattaggaggccagtagggttcaatttggaatccttcagaattggaataaaattgcagattgggggaaaatttgagaatttgagttgaaggtgctatttggatgtaagtcatatcaattttcaatctacttctgtacttgaacgaatgataaaatcagtatatatttacatcctcctgaatcatctaatgataggttaattga

SEQ ID NO: 8143 - DNA, 1501 bp, Oryza sativa
tgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataaagttcagaaattactagtgaatttccgggcgtgacaatcaggcgcctcttgctctccatgcttggtccagcaggtatatttcttcatgaatccattcattatcaaatgagcatgcacttcatcgctatcttcgatcatctgttcattcttacagtccctacatggacacaacatgtgcatgctcatcctactttttctgtcattatccgcaaatgtgacaaattcagtgaccccttctctatactcggtagacgaacgatgtgcatagtacatccatctacgatccatctgaaatcaacaacatatgaagaaaaatatatgatgatcaatatattgagaaggaatggagaataatgtgttttttaccttaaattttagcaaaaaatcgccccccttgccctcccaaccgatttgtgaacagtgaactggtcgggatggaaagcagttggcggtttggggggtatttatagacccaacacacctcaaacgggttagattaaaaaagcccatcaaaggtgttggtcatacctttgacgggcttcaattgagttgcccgtcaaaggtattaacctacctatgacgggccgtaaaaaaaatccgtcacaggtggcggactaccacctgtgacggctcataatgccacggcccgtcacaggtgaggggataccctcacctgtgacgggttgggaggaaaacccatcacttcctcacctgtgacggcttttccttccggcccatcacaggtgagggaatacctgtgacgggctacgcccggatgcctcaccgatgacggcaaacctagcgacccgtcaaaggtgacggtcatctatgaccaattcataggcccgtcactggtatgccgtcacagatgtagggttctggcgtagtgtgccatcgccgttagggttccgttagtagccctccattaagagctataggctgaacaatacatttaatggggcgggatgggtggaaccctaatgacgatggcatttataggacaaagtcgctgtagaatggcaaattgcacttgtcgatggtatttcttgtaattgggcaattgtcaatgtcatttcgaattttctatgtatggtattgattcaaacaaatattagactattgcataatatcaaaaaatatgaagaactaatttgtaaaaaatgcaaagttagtgttgttggcagagccacaccaccacgccggcccattgtttcgcactgcaagtccaccttgcgtcc

SEQ ID NO: 8144 - DNA, 508 bp, Oryza sativa
agaggaggacacaacgatccttaccactacttacacgaagacggacagtgaagggagaagccggtggcgagctttggaaggcagaggtcttcgggacatgccgacgacggtgctccgactatcctcggtgaagaagagagagcaactgaggttctccttggcggtgtgataccgacggtggcttcggcatggtcgggcggtgatgggatcagcggttggagatgcggcaacggcggactgcctcgggtgaatggcgacgaaggccttcctggggcctttgttggacgggaaatggaggcagggctttggcttgctgttgcagtacctacagtggaagtagcgcagcttggagatgcccgaggtgacgacgtgacacgaccgaaaatcggcggtggcggcggacagagaagacaagcgccgcggcggctctagagcacgggaaaaactcgtgttagggttggaaaagagagaggaggtctggggcatgctatttatagccaaaggagga

SEQ ID NO: 8145 - DNA, 1501 bp, Oryza sativa
gttaccacggtatttatatcaccatactccgcggtaagcccggtaaccgcggtaaccccgcggttaccggcggtaaggtaaaccctgctcccggccacgtccaactccccaccaccagcagcaggaatccgaaacgctctcgcatttgggatttgggagtccgtcgcagactgcgcgacacgatggatccactgcctactactatacggtgtgtgtggttcgacacacacatagcacatagcagcagcttgtctctacaatcatgtcgtcgcttgcgcatctcgccaagatagtctctctcgatgctgtcttgcgttcagattgcgtcgtgctattcgtgctattagaaacagactcgatgacaaggacgtattcaatgtgagcaaaaatattgggtgccgaatctctgaaaacagtcttgacgataaggacgtactcggaataattaaaaaaaaagagttcaaataaatgttgaaaattctcttggttatgtttgtgatggatctaatttgagaaagagtaatattgcaataggtttatatataggggctattctttcaacctatgtgcttgtgaatatgttgcattataaatcgtttgaaatcatgaatctttattgctaatttgagcttaattgtaatatatttgattcatgtttatactacgatgcatgcttgttaactagctaatgaatttatctctcttgtattccaaaacatgaccttgaattgctttaggtacacttcaaagctctcggaaaaaaaatagaaaatagaaaataaaaaaaattggttattacaagtggcaatcatgacatcattgcatttattcttggtgaaattattgtcaaagggagtgaaatatacaaaatgtatgcttcttgaaaggggagaattgaattgttttgattttaaaaatagccgattttgtactttgattgcaaaattgatgggagaaattctttcttttaaaaagggggagagtttttctttttcacttttgtgatttttgtttttatttttcaagaacacaaaattatattttggtgccaatgtgttcatcaagggggagattgtgaaatcattgtcatgattaatattttgtgatgaacaattggctatgcaaatgatttaatcaatgaagtggtttgaaaagatgtgtggatgttggtgtgagtgcgtgtgactaatgtggatcaggttgtgatatctgtgctcagaaatggttgttttgtctgattgtgtgcaggtgacttgaggtcagccttggtcaatggtgaggaccaggactatgctcagagtagtgcagaggtctagtgcagtcgggataccacgtgagaaggtgactagagttaggattcttggggtcaacttcggtcaacggtgggatcgagactagactcagggaggaattgagatgcagacggtcaaggatactggatgacgaagttggatacgagatggcacatggtggatgaatatcatgtgggagagattttcgt

SEQ ID NO: 8146 - DNA, 1501 bp, Oryza sativa
ggcgtgggcaagaggcaaccccagtagttgatgctctagacggggaaaaagtacgctgaaggtcccttaacttgtcatcgagttacaaaatcgtcccccaatcacaaaaccggatacaacacatcctctaacttataaaatcagtgcaaactagatccctcggcggttttgactccggttttgaccgacgtggcagctgactcagcgtgggacccacgtgaggccccacatgtcagcgtggccacctcagcctcctctcttccccgtattctctcccttcctcctctgtccctctctctcacttcgccgaacaacagaccgatgccggcggcggtccagagcagcagccgtgcctccgcacccaccaccgcggtggcgcccgcttctaccttcgcgcccaccgccgcggaggtcgagcggtccacgtggtggcgcaacgttgagcggcccgggacagcggcgtggcgccgtggcggtcgagcggcctgggctgccaccatcgtcgtccatatgcaaccaatcgcaaatttggggatgaatctattgatgggagatgggagagggagacgacgaggcacgttgctgcatcaagacagagacaaggagcaccggtcaccaaggacatcgggctagcagtaggcggcggtgcatcgtgtgtcttttcatcactgaagtcttgtggagatgaagagttgaatacacagaagataagcgtgcgctgtggggcagcaaggacggcgtgcagctgccaccgactttcgcccccacaacgcttgtcgcgctgcctcggcaggcctctgccgccgctgaccgtgcgctgtagcctataggtggcctccatgccgtctggatcgaggtgcaccgccgctcgccgctcgccggacccgtgttgtcatcgtcgctgtcgctgtccgcttccacccaccaaacgtgtccctctcctctgacggtgggcacgtcgtgcgcgcatgcggggtgggaggaacggcgtgacaagacggatggcaaagagtatatgggcacggcggacgcgggcggctgccgatgagggaggagatgccaccggcagcggcgactctccgccggttagcttccagcccgcggcgacgacgacggccgcacgccgcactcccccacacaccccgcgcgcggcgcccgacgcctccgacatgccgccgcccacgaccgtgaaccgcccgtagcaacccggccctcagcccctcgtccgcctccttcgccgacgataacgccgcccgacgcacacgcgaccgagactgcctgctagcccctgcctggttttgcagttttcaccaactcgccgggagctcgctgcagaggatgaagacgacgccgacgccgcacacgaacgaaagcgaggtcgccgcccgcctcgctcgcctgctccgcggttctcctgcgaaggcggcgaacagctccgcggtcggggcacccgccgagtccatcgccgccgcgtggcccgttctcccgtgtcgccccttct

SEQ ID NO: 8147 - DNA, 1501 bp, Oryza sativa
atacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgtgtcgtcctccgcttgctcattatccgaatcttccctctccatttcatcaacaattataccgactctctccccctcatccgccatgcccatggcctgctcctccctttgttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccattggcattagttcccaaaaataaccttctattgaacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttgacaggggaggggctgggcttt

SEQ ID NO: 8148 - DNA, 567 bp, Oryza sativa
cgccctccgctagggcgattttgctctgtgcggggggccgcctgcaaatgggcggcgagggggcatggaattttgcaggcggcccccttgccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 8149 - DNA, 1501 bp, Oryza sativa
gagtgacggctagggtttctcacgtgaagcaatacctccgccggtcacacccctcacgaatatataggatccatcactcgggcctccaaggcccgtaggactcctattcagatccctatccgaattaagcttattttggatctccatccaatccccttattccggcccattaagcgtgcgaccctgtaggttcatgtacactcagctgtaacctgaaaactccttttcgatccacgcatcaacagcggcccctagcagaacgcattgacccaccgggcatacataaagatcatatcggctgaacctctagtgtatatttgtataaacccctttgcctcacgatatcaattaagctcaaggctagatatgtgccatcctctaatagctcaatcattcattcgaatatgttgatagattatataacttgtgattgactcctcaatcacctttggcatggctatgcacttccataatctacaacattgaggggcccaaagatatctctccataggaggggcaaatcccatcttaattattcatatctcactacatgtttcatagcatacccgaaaactacttttataactacccaattacggagtagcgtttagcagtccctaagtaagctactacacatgttggaaaccatgataatctcaggtctaaggattcaacaccaacactaaatgagatcactgatgacacaacacatatggctcttacagtatctcatgttgggtctatccaacaacatgttcactaacatgtgtccacattattaatttggtatctctataccatgatccatgagacatgatcgtcaattaatacatatgctgatcatctaaacatatttgttccacatatgatatttgatcagtgatcctttagaaatagcaacacacaacataaagagtctcatgaaagaatcacatattcattaaccaataattagttatctatttcaaggaacaaagtcggataaatatgtaaacatagtatgtgatacaatcatctctatgattgcctctagggcatatcactagcaggagagatatagagtaagaagacacacataagaaataaaaaaaacaggcgccgtcagatatcctctttagacaatttgaaccgatggatcattgaattggagaaatctctttaagatcctttaggaaactttattttacgagaaggtccttccacgtccctgctgtaaaagaaatccctcgattcccctcgactcctcttgtaaatttgaatttatctatagcatcgggaatcgtttccataacccgcgggtaggggtggcaattttccccatggggccggggacccgcccctatggggacgggggcgggtgctaatttcaacccgcggggagtcggggccggggtcccagccatgggcgggggcgggggaggacagccacccacgaggccccggggtatgtgtattagactattcacagtaacatattataccaaaacgcccagctagccca

SEQ ID NO: 8150 - DNA, 1501 bp, Oryza sativa; identical to SEQ ID NO: 1999

SEQ ID NO: 8151 - DNA, 1501 bp, Oryza sativa
tgaattttgaaccgcgaatacaaatttatctataaattattcctttttttatacgtcgttttatggcttatcagttttaggccaaacgatcacctgtgtttgtggtactacttcgtaccattgccactccactccaaactccagtgtcccaaagtccagagtagtcgcgctcacgcggctgtgataagttgtgatgcaaattgaccaccaaaacgtcgttgcatacgtacaatcattggtagcgtggatggaagcaggagaacccacaggatgcccattattcgctagaaatacggcaaaatcatgcgacaatgacatgctaatcttgtcgatcgcttcgtcatccggacgcgtttttggcttcaaagatcgtcgagatttcttgtatcggaagaaacggcgcgatctctccgctggccgccacacacgtcccacgcgcaatccaaatcaacagcaaaccaagcatgcaaatccaaatcgttggcaacttcgcgaatcataggaggagagttcgtatgggaaaactgctagccccacaccccatgtgtaccaaccaatatagtccttactttataaattctccattttctttcataaatatataaagcaaggagataataaatgtatagaaaaaactatatatacagagtaatcatatatacattcccatataaaacggtattccacaatcataacatataattttgcgatcggcatatatccgtcatatgatatcatagtacctatgtctcagaataaatgaaatattaggatttaaatttgtctctaaataagtacttctacattactaatagagtactagttgtcacttcgatgaatcctatctcattcaaattttcctcattttacccctaactactctctcacttacattcacatgccatataataattctcatataggtcattttatttgtcttaatttgctccataataacctctataactgaaaatgttattttggacaaagataatactatctttgattagttttggatctggacaaagcgtcacatcttcatatagattaaactttttttagacggaaggatcctaataaggattggatgcttttctaggtggtgtcacatcttcctataaatttgtttttttatagagatcttaagaaggattaaatgtgacgtagtctagtacaacgaatttaaatatttatttttttacaaagagaatatccaaattatagtcaagaactagtttattttgtgatgaagtattcaagtagcactataccaccgtcccaaatatgcggatcacaaaattatgaaaacggactcacacaatgggagctccaccctttgggttcacatgataaatcggcccttcctaggaccctcaacggtgggacccaccagtcacctcaaatcatccatgaaagcagtggacgctctctttatttagctgccccccctccattccttccttcctccacctccgctttattctcgccaccaccaccactc

SEQ ID NO: 8152 - DNA, 735 bp, Oryza sativa
agatccacccagcccccgagccgctcgccctcgccctcgccctccggccttggatggtggtggtggtggtggtgggcggagctgcttggatatgcgcttcctcttcgtttcggctcgacttgtttttgggttgcggtggtgtggtttttgcggtgtttgaaatgcgggggcgctgtggtgtggcgaattcggtttggatggatggatcgggtatgtatgatttgggagctgcgggccaatgcgatctcagttctgtcactggtggatgtcggatgtgatttagtagggaggttgagttggccggtctgagaggaggcatggatcatctcagtttgtgcattcttgaatgaatcatcagttggccactgcatggctgtcatttccatttcctttttaatagcgagagtttgtgaatttgtacaggcaaaatggaccgattgtaggatcagattcatgattcactagctattttcaacataaactgttcagccccaaccgatttacgcaccccagcactttttcatgtagttaaccccttttgttttgcaggagagcgatgctggctgaaagcgacttggggtgcttccaacagtgtttctgaactcagattgctgtctcccctgcacacgatatggacgagtaatgatcgtttcagaataggtattatagatcagtatatgcatgttcaattgtgagctaagctttttctatatatcaacttaaccagagaaaatg

SEQ ID NO: 8153 - DNA, 1501 bp, Oryza sativa
aactatttcttctttgctatttacaacttctacagatatgttaggtgctaataataagttctcttaaactaacatttggcatagcgttctgatttttttagtatggtcgtgttactcgtgtaaccatgtactgttaggactgtaaatatcacaggctgaaaacacaaaaggccattaatacaagaaaagcatatgccaaaacgaggaaaaagttcactttagatcccttatgttatcattgagtttcaaaaacatcctgaaccacggatctcgtgtgcgctagttttgtaagttaggggatgcgttgtgtccggttttgtggttcagggatgtttttaaactcgacgacaagatgagagacccaatgtgaacttttttttcccaaaacgatgatcatgtgggcccatgggccgttgtactttgctcccacggcccagggcatcacggtctactaccatcatcaatggcgggaaagcatgggagaaatggagggaaaacgagctcccattccccacccagaggccgccgccgccaccgccgccgccgccgcagagcggagctgacgatggcgaagcgcaaggcaccgtccggcccctcctcctcgccgtctcccgccgccgctggcgccgacgcgtccccgcccgtcgaccccgtcagttcacctctccctcgaatctcacgctagttttgatttctcttccttttgttgaggtttcgtattctagctcgcagggtggatccgccggcgggaggaatcgcaagggcgcagcggcggcggccaagcggaagcctaggaagccgcaggtttgcgtcctcccaaatcccaatcgcagcaaatccttgcatcctgctctcttttttgattcgtttgaggctgtaattttgccactgaatgtgtggttactgttctgcccccaaatacaacattggcctgatgcaataattctgtcacttttgcgtaggttcacgagaaaaattacgcgcatgtgtactatggatgtagaaatgttttatatgatgggaatgatttctactatggacatagatatacagaagaatttcgtaaggtggaggcacatgatttgtatggatgtccacacttgattgccgagctaccaccacaaccacggttaatgtcattgctggatttacagctctggattatcaagttgtttagactccatccagaaacacaagacctctcaattaagggcttcttcgaagaagaagacagttggcagtacttaggttcagcgggctggaagacctatgattttctatctgataaaagttggcagtcctttgtcaagaaagtaaagggtagaaaggggatggaatttttcaagttgtatgtggactcctctgaaatcaagcactacgacagtttgctaaaagcaacaaatgatgattattgtcagtcggcaactgtcttgttgcccgagcaagatgatctgacatggtattttccttgggatcacatttcccgacgcctcacggaaga

SEQ ID NO: 8154 - DNA, 1501 bp, Oryza sativa
aaccattgacaccaggggcacaatcttggaggctagagctggagatgagaaaagtaatagagatgcggcgtcctcagaggtttcatacatcaaatacgatgtactggggcaaagtgcgaagcaggatggctgtgatgaggatgatcgaaggagtgaaacggaggaacatgttgaggaggacgaagttcttgatcctgaagaatatactgtgaacaacatacttccaaaaagtagacaccgtgatggctctatatatagggacatcatggacacaccgtggaaaagggagtttcatattgcagaccgtaatgagagtaagctatcttttctctatctttatttgctatattattttttattagagataatttgtttccttgaacataacgaatctctttccatatctataaatattttattgcgatcctagagatcattgtatatgtggtgctatgcagcactgccataattttacccgccttacactcttttcagctatgagataattgtactggaggtccttaaacgtggatgagagtaacacttccaccccaagccttgtactttacttttactggcccttcagcttagcaccatttgcatacatagcaatctgcgccacagcctgatgggagggactgaggttgcatgcagagttctgatgacatggactaggaccttattccatgccatttaattacataaatgtccaaagtactttatccctgaactttgcaacacggtgatcacacagcctttgagcatgtatttcaatagcagaatacacaagaaaatgacaactataagtgcaaataataatctaaatatcgcatccacactgttgtaattgccattaggtttaaattctccatacatgcagccacaaactgtcagtaatagtacaagttttccaagcatgcagggagcaacaacaagcaataatagaaagtactcaggcagttcacatactatatataacctaaaggactactaggtgttcaaggggccaaccaaacattcaaatgcccctgtttaatatgaggagcgggttgccagtttccaaaatatagaccacttcccaaaacacgtggttttctgtagaggtaaaaggctggtacaggaaagaatatacctggctttctgaagaggtagtctgcccttgagttttttttttcttgtagttgatactaggatagatgttgctctcctagtaaaaagaacataggttgtttctactttgtagatgaaaaggaaaaaaaaatccaataaggccatataatcatcaaatatcacatgtacttttcaaatgtcaagtgtttgttcactgtattaatttccggtcacaaacttacattatgactttactttttttgaagctcggttggaggcaatgaggttttcgaatcccacaaattgtgtcattcgcagtaatggaacttgcatgtcacatgttcattgcaacatgctgcaaattttatcattggagttggctaaaattaca

SEQ ID NO: 8155 - DNA, 1501 bp, Oryza sativa
atgcatttgtttgggaagattaacaattttttgctgattatggcatggaagagattagctctgcagttctgcctggtgctgaggtcgcacgtctgcgggattagatatggccttcgttcccgatgtggcccgggttcgcgaaggtggccgctcgccggctacgtcgaggtggaagacgctggaaatttcttctccgagttgcccaacgattctgcggtgtggagggcggccgcgacgtctgcggctggccccgcctcgtgcgtctcggctcgcccgtttcgatcggctgctgctttgcgagattacaagacgactggttcctgacatccacaccggaatctgagctcgagcccctctagagcgcagcccacgccggcgccggtgacgagcgtgacgaggtggagaagacgacggaaaagctggcgttggggacggacggacggatcggcgacggagtggcacggaataaaggaattcgctatcgcagtgacaaaatctgaaaggaatgtgtattgagtggcttgccctgaaaggcctgcgaattggatgtcaaataatgaaatttctccaattatgtccatccacatgatgcccgtttctgatgatgacagaaatcccccacgcagccacagcacggctattccccctaacccccgccgccgcccagatgcgaattctccgccgctttccgcgtctgctccgacgctctaacgccgccgcccgatctcctgccccgatgcaccgcctcatctcttctccctctctcatggcatctgcagcggctagctggtgctggtggtcaccattgcttgctcgaggaggacctgtcgtccgtcgtgtttcccggtgtgttttcttgtgctgatcgatgctaaagtctgcgcctttacttggttattactacagttttggcatgattttcatagacagattttttgggcatgtgttttttttccttgttctgatgctaaagtttgcgtcttttgccacagtttttggatctgcgatcaactttgggttttgttttcctcgcaaaaaaaaaaaactttgggttttgttttcatttgtttgaaggtagttgtggaaaataagtttctttaaactaattcgaaacaaagacaaaggagatcgagaaaaaaaatttagaaatcgattatcgatttcagggttagatgatctcaatcctgactgatggtaccgtcttatttattttagttgttgatattggtttttcattctcttaattaatgatagatttccttgggaacctcggaacatgaccaccatcagtcgagtaaaaggcgacgagtcatacaggcgacttccatcccaggaaaagaagcatactgcgatcactcaaggtatgaaaaccattgacaccaggggcacaatcttggaggctagagctggagatgagaaaagtaatagagatgcggcgtcctcagaggtttcatacatcaaatacgatgtactggggcaaagtgcgaagcaggatggctgt

SEQ ID NO: 8156 - DNA, 1501 bp, Oryza sativa
aaataattgcaaagtcgctgtatgcatgatctttcagaattctttctctgacttaaccaatcataatcaagcaactactctaaagttgtaacggcaacgttcgctcgtcgagtcctctgctgtgcccagaggaataaagaaaaaaagaattgtccattaagaagctgaccattcaaagaaaaactttcatgattggaactcacttggggccatgaagaacagttcattgcgatttgcaaaggtgatttggtcatcctttcctggcactcaaaacttgaggaattaaaaaaaagaattaatcaatcagctcgttacaaaacaaacatgaagaagcaattaacccaatgttcagatcactgcaggcgtgtcggttggatcgatcgcaaccgacacgatgatacatcgagacacgaccatcagattaaacgaaaggattaattactgcaagtgctgaagctgttcttgcttgtgtgttttgcacgtcgactaactaacggcctctcacgccatcgcctactaagctagcgtgtatgcttccaacaactatatacttcgatccctctgtccttaaatatttgacgccgttaacttttttaaacatgtttaatcgttcgtcttatttaaaaattaaataattattaattttttttctatcatttattcaatgttaagtatacttttatgtatacatgcatacagttttatatattttacaaaagtttttcaataggacgaacgatcaattatgtttaaaaaagtcaacagcgtcaaatatttagagagtatttcatttgcaaccaaccaccggcgagtcggcgacgagtggaattatcatggccatgcaggacgacgacgacgacgaccagcacatgcacagcatgtctcgctggcgcgcggcgacggcggcggccgggagagaacgtgcgtggtgacccaaaccttgacgcgcagaacacaagctgtacactaccacttctctaattctttaagtacaaaccaacacgtagcaccacctacctaagctttagcttcctctcacattccactcctcacatatatatatataccacattgttgtcatggcacggctcctactccaatcaatcacaaccaacgaattagaatctaatcaccctgtcccattaaccaaattaacatcgatcgatcattagtacaaactaattaatcaatcaattagttagagatcaagttattagtgtccaagtatagcttaggaaggtaatgggaaagagagacacgccggcgaggtcctcctaagttaggaccttggaccgtccctcctccatcctcacggctataccaactttatcctcgccccctccccaccacccctctctcccctcccctctcaaacaccaccgccaccgccatggtcacgcccttcccctcctcctagcaccacctctccccttcccgcgctacgcgggacgaggaccagggatggctccccccaccgccgtctccgcctccaccgccggcc

SEQ ID NO: 8157 - DNA, 1501 bp, Oryza sativa
taggtaatcacgtaaagctaaaacctattggacagctaggtaggtataggctcaacttgcaacaaattaatgagctaattttatggattagatggctaatcatccgggggtggggtttgcagcgcatggggatgggggggtgccaggctcaccccggcaccccctgtggcttcgccactgattctaatcctaacaactataacgcaaggatccaaatcattttttttgacaaacaaagaaataatgtgaacatatgacagttcttgggcagtaaaagatagaaagtgctagagacttggtgtagtgaacactttactgaaaaggcttgaatttaaccaccacaatggaactaagaaattttacaacttcaaattgattcaagctttgtaataatggcatataaacaaggttgccctaatttaggtttattgtatactattaagtttgattacatggcctaagtactaaaagttactcagtaatctctaatttaggtttattgtatactattaagtttgattacttggcctcagtactaaaagttactcagtagtcaattcacaagcgtgttgacgtatttcaggcatatagcccacttactatagacaacttacatggaagggcggtagttagacctaagttatagctaagctacaaaataataaaaaagacacctcttggcaactctggtgcttatctttgtgataaactagtggtaagatagtatgccgttaaaaatctcagctttgcatcatgtacacagtatttcagctgatataactttcctgaaatacaaagcactcacaaattcaatatggcatacatgagaatttagagaatttaccatcaaattcatgtgcctcaactttttttaccacccaatccgcgtgccctctgtaatatatcattatgactgctaattcgtctattttgtaccactttctctatttttcatgtgttttttaattcttaattccatttgtactccctccgtcaaaaaaaacaacctaaacacatcctagtaccatgaatctggacatgtgacacatcatagtaccatgaatgtagtactagtatgtccagatttattgtcatatcgtagtacgatgttgagttttctcgacggagggagtatattttttacaggtttgtgggcatttttctctgggcccacctgtcagaaccaaaagagatatttctctttggatcgatcggatccctccaggcaggcgcaccaccccgccgccgagcgccgccgctgccactggactgtgctggccaccccagctcaccgcccccaccgccgagcgccggcccaccaccccgccgccgagtgccaccaccgccccaggtcaacgcccccacagccgaatggcaggtcaagttcctgagtcctgacgaacgaagagagagttgggaggccctggctgagaccaacaccaccagatttcaccagagttgggaggtcctgactgagagttgggcggagatgtccttcttc

SEQ ID NO: 8158 - DNA, 1501 bp, Oryza sativa
tcctcttcctcggtcgttgttcgctgcctagacaccatggagtagtcactatccttgcttgagtcgcttgtctcatgctttgctccgtctttcaccgcatcatctcctgtgcttgaacgtggttcttcagtgacagctttcttgtcacttgattcttcaatgttcgaaacggatgcctcttccttctccctcttgtccaccaccaccatagagctgccgaaaacctccggttgcggtgcatcggcattctgctgttccttctccaaaccgcgtgattcttccactgcctcaacttccttttcttccacaatcctctcgctttccttatcccccgctacacgttcgacatcttcttcgatcggttcttgctttgatccttcctcattcgcttccgctctttgttgttcttcctcatcctcatcatccacctcccagctcaaatcctcctcgtcctcctccgccgcgaaaacccgcttcacgagctttgctctagcatcctcctgctgcttcaacctatgaacacggtagaagtacctcgcccagaacacctcgctctccaccgtgcccggcacgagcttctccaccatcccttccaacgcatcgctctcgtagcacaacgcctcgatctccccactcctctcatccacgctaaaccctaccctccacgccgcgaagtcatcggagtcctcaggatcggaggtgaacgtggccggatccgactggagcgcgcggagctgcgcttcgaagcggctgtaccggacctgccccgaggcggagctgggctcggattcgccgccgccgccgtccgagtgcccggtggcgggggctgcggcggcggcggcggcgacctgcgcgatggcgtccttgccctgcgcgacgatgtcggcgaggccgtcgagcgcgtgggcgtgcgccgggaggtcccgcgcggcgcgggccgcggcgtcgcggagcgcctcggtctcgcggcgcaggccggtgccgaactcggcgaggtcgcggcggtaggcctcgagcacggtctccgactgggaggtgagcgtcttgagcagcccgccgaagccccatcccccgcccccacccccacccccgccgccgccgacgtcgtcgtcagtgggtggggtcgacgtggatccggcgtgctcctgctccgtctccgtctccggcggcggcggcggggaggacgggccgggctcgggctcggcgaggatggacttgaagaaatccatggcgatttggatcggatcggatcggaggaggaggaggaggggaaggtggtgcgttggtttgcttggtgttggtgggcttgtgttgcggtgcgaggaagaatgacaagggacgtgttttggattgattgagttgcacacgcttgcatcggtcggcttgggaatggattccttgccttgtaaccgcacgtgcgattttgtatctaacgtaattcaaacaagttatatgagaaaattgacattatgccattctcggagatgggctccgctaaatt

SEQ ID NO: 8159 - DNA, 1501 bp, Oryza sativa
gtagtattatgtatgtacctaattggacaaaattacaaaaacttcatttataaaaaaaaaaacagattgacacactacaataaagttataaattcttgtagtatcttaatgctggacttcaattaccacaacaactctcaggttttgaacgcgtgctacaagaacaaattgtgcttctctggagaaagtggtgacacagaggtctactgcttcatcactgaatctagatggacctgaaatattctcctaacactttatctcatgcatcactaggattgaattagctcgaagcataaaaatttccccaaaagccacgtacacggtacattaacctcaatacaataaattaacaaaaccgcagagtaatagaattactgcagaatccagctaattaagcacgtatttagcagacacccaacaaaacatcaaaccaaaccaaaccctcgctcgctcgctcacccaaatccttcgtgcttccggccctcgccaccgatcgcagcacctccgcatccctgagcaacaaatccccggtcagaaccaccaaaatccccccaaaaaatcgcccaaaaaaatgccgccctgcaaaaatcccgcacctgccgctgctcctcccgaggagatacagcgccgcggcgctgaggcagcacccgactccgccccatgggatcaacatctcgcaaggaatcgccaggcgagcaccgaatccggggggggggggagatcagtgaggaggaggacgacgaggagatgaagccgtgaaattttatttttattttcccccctttttcgcggcgagggaagaggaggaggcggcggggagggggaccgggaggcaagcaaagaacaggatacgaggagtgcaccggcctcggtgggggtgggcctcacatgtcagtgagtacattccctgacatgcgggccccgcagggatatgccacggcccctattagatactggcccagaagcgcttttagtaagacttggccctagggcctgtttgagggagcagcaggagctacaacaaagcttcccaaactatccgatttccatgtagagaatgtatatggagaattcagaaaataaactataatttaaaagctgagacttctagtttttctagtttttcgctagctgtttcttagaaccttaagctaccaaaatggagtatgaccttagttagttttggtagtcagccacagttactcttataatcaaaaacttgcttaaatatttttcttaagattctaaaaaactattgttgtgaaatccataaaataaactaaaattgaaaagttagaagattttaaaaaactactgtatctactaatcggttgtttctcgtaatcttaaccttcggcataggtagggcgagctcctctcgcttacatgtggggcctggtcaacctcggtggttcgaacgctgcaagtgggacccacctagggttttaagaggaggagattctcgtcggcggcggcggcgggcaaaggttagccatggaga

SEQ ID NO: 8160 - DNA, 1237 bp, Oryza sativa
ctgcagcccgcaagcgaagaaacaattttcgcaattagggtttttttagaaattacattttcccgctaggcgccacgacggaacgggcgctacagtaaattatgaattaagaattaaaaacgtattcacgtttgagtcacaatttattgtttttattaaattaatagctctgaaatttagaactaataaattgtatacttagcctagattgtcaattacacttttttatgatttaattaattatcgagttatttttattcaagattatttagttttttctacgctttaaaaaaattctttgtctaatgaatttaaaattcaagaattaataattatcatgttgcatctacaatgcactattgtttgatctaaaccgtcataattcggtctcacccgaatggcttagatttattcttataacacaataattttctataagtacccatttggtataattacatgcaatgtaaacatatgtatatttatagatatacaatttatcttccctgagccagttaaaattttcagccgtcatgactggacacatgaaactttcacatgttgcttttgttgacgttatccagtggtttagagattggtcaagtggtatgcaccttattaaacaaagaaatcacaaaagcaattccaaacacagacattcaaaaaacgttccacttgttgagtttttcctcgttccagatttgtcaaacaggcagcccttctattgatcagatcaaatcggacgaccacctaaaaaaatgtcgtgcgaccgattctcgcacctcaaagtagtaacgcattctagactccagagactcttcaacgcaacgccagatatccgcacgccacagaaatgtgggccaggcatactgctggccccaccagtcggtctctccattgctggaagctttccggtcaaaactgtcatacggccggcagccgcgcgagaaaccacagaacccaaccgccaatctccggacacatccagaatcgcaactgctctccatccacctcacgtacaaacgcaacgcgtgcaccgaaaattcttcgcggatgacctgtacacgggacgcgcgcgggtgcacacctatactataaaaactgcgacctcacaatttttcgcgaggagaggagagcaacacagttttctttccctgatcgatcgattactcgaggcgataccgcgttagatcgatcgatcgatcttcgtttagtttctggatggagcggagcagct

SEQ ID NO: 8161 - DNA, 1501 bp, Oryza sativa
ccggagtcgcgtagatgctctagctcgcccgaatcggtctcccgtcgcgccgtcgccgtttcccccttctctcgccgccggttgccgccgccgcaatctgccgccgtcgagcatcccccggcgaatccgagccgttggctcgtttcccctcgtcccgtgcaacctcccggtgtgctcgctttcgcctgtatcgccgtggttcgctccgccgctcgccgccgccgtccgccgtccgttccggccgacgtcgtcgtctacctcccgccggcccgcgtggcagccatgtaggcgccacgtcggcgccacctcggccgcgaccgggtcaagctgaccccggtccgccgcttccctctgccctccccgtgcgcgtggtccacggtgagccgtgaggctgcgcgtgggcccgccgtacccgcatcctccgcgagccacgcacatgcaccgcgccccgctccacaccctagcgccgcgccgcgtgctccctccgcacggtgagccgagccgctgacaagcgggtcccactcgggaccacgcgagatggacccggtccaccggctccctctctgccccccccccccgcgccctattgggccgtgtcctctcgggccggccggcccatttagctcggccgagccgccccttttctctcgggccgcgccctagccgcccgagggaagtttaattcccctccctctttcttttcttttttccaaaatggtttaattaaatcttttttcctttagaccaaaaatccaataatcttagaaattcaatatcttctcaaccgtacatctgtttgactccgttcaacttccaaaatttctcaaatctcgagatctaccaaatggcacgcttagaggtcaataatagggctttattttcgccgttgttgagtcgtctcattcgtgtgtagcttcggagcccgaagaccctgagtgcgcagatttcgaggatcaagctcaagatctcgagcaaggcaagtcacctttgatcatcttgcacctatagtttaaatctaagtatttcttttttgcaagtattgcatgaataggtttaacacaagtatttcggccgcggcttgtgagatagcatgtcggtcccaatcctaattgctgcaattaccctccttgaattattgaacacttaaaccccctttgtcgactgatgtgcttcgatgcacgggccttcgagcacgggcatcggaacacctcccctcgaatttaaaatatccaacgatgggtaaaacttgaggttttacaaaagacttggaaaacccgacacatggatcggtgcttgcgaactaaatgaatttctaaaatcgcggaccggggaacataccgggcgtacggtttcccgctcttgcacctaaggaccgtttccttggaatttcatccgaacataaggcaagtgcgaccacatgggtgtaatgggacgcccctggctgagtaattagctaatcaggggagccatgatgccaagagacatgtggattcaacggggt

SEQ ID NO: 8162 - DNA, 1501 bp, Oryza sativa
aagaaaatgaatatgtacagtataatgtactgtagttgtgtagttgtgaaagatattgttttttttttggtagagaggaagtacccactcggccactccgtctccggccactccgtctccaaaagtacttaattagccctgtttggaaaatttgcccatggctaattttgagagctaatgtttagtcatgaattggtaggttaaacattagtctagggtggtatttttggatccatgggctaattcaaagctaaaaggtggagagagagtagaaagagaggagagatagctgcttttttatggtccttacataaaattaaccccattagcatctcttggagaggctaatgttttgaggaggactaattcactttagcctcaaattagcccacctgtttggattcttgagccctaattcagggctaaaaggtgggggctaataattagtccatggaaccaaacatggccataatctagtacaataaatctgaacatgtttatagtagattatgtaccatcttaattttagattgagttttttttttttttttttacggaggagcgagtatagcgtttccctacctttttctgtggcagactattaccctcgcggaaaaagagagggagagagggagagagagagagaccggtgccctgtagcaaaatctcggaagcaacgagctgtctggttcggatcgaacgaactcgcccgggcccgatccccatccaacaccatcctcacgccccacggcaccgcaccccgcgcgaaaaccccatgcgacctcctccccggccgcgccgcccagtgccggcgcggctcgtcgccgctgcggtcctcctctcggctctcgccgggggagccgcggcgggcgccgccatcgccggcgatgggtacgggcgcggcaggaggctgtacatgaggaacaaggtcctggagatgtgagtgtgctcgacatgccataagctacatgctcagatgctctcttgacttttctctctttcgttgcgcggtcgattggttagatttttttttctttttggttgtggctacatcgcggagaacgaagacatctccgcacttttgttaagcctcgtctccacttgttcgcgaggtctacgataaattcgtcgtaaatttagttgaaaggatgcaaagctttgttcaatgtgttgagacgaatgcccccacttcgaacttaagcctgtaattgtaaagaaggcacgggtttgctatagaaggattgagaatggggtttttgattggataatgtgtgtgtgcccaagttgttaagtattaaaaagtttcatgttataaaacaattatgagaaagttgtcatctcgagttaccaaggattgctttggttggtgtattgtttatctgatgttatctcgagttaccaaggtatttcctgaaccttttatcaacaaatcactgcattaactctgtaaaatagggaaatgctgaaaatctagtctaactttgcatttacaaggcagagt

SEQ ID NO: 8163 - DNA, 1501 bp, Oryza sativa
actacagtacattatactgtacatattcattttcttaaagttgatcttagtgaaagttaatatttaatgaaatatatacgtgctaaaaaactatactaatatattttcgaaattcattatgctccataaggggatgtgttttttcttattacacagtagatgcatacacacaccattatacagacaacattgcgctcacacaccggcgaactctttgcatgtcatgtagatgtttatgaaaattaaaatttgataacatagataattgtataatatattgctcaggaaagtattctaaactcttgaggtgaaagtttaaagtcgacctaaccagttgaaaataagcgaatataactatgaataatgtacttgtattactcattgtgtaatttatatgtttgtttgtttcttattctatatattacatctcaattggccttttcgagagtatcaatattgttaatcttttcagacttttataactatttgattggtgtttttttgacttacaagacgaacaaatgagaaaaaaaaaagttccccctaataaatagtagtactccacagttcataaatattttctagtgttgaccagaataattttaattatgatcattaatatttttgaactgtctaggctaggatgatcgaaaggttaacgattattatatttagaataggacacaccgtcttttaagaattttcaggtctcttatacaatggtatattacatgtgttgtgtaaactgttgtggaacaagatatatgatctcattcatatatatggatagatcggcaaccaactcagggacacgacagttgtgtcatgccccacgtcttctcactctcgtggcgatcctggcaatgggcgcaatgtttctcaaaccatcgtgtctccagttatcgcctctctctcccccctatatattgtaaccactgtgatcgataaagaatcgctcgctcattcgctctattgtgtcgtcaattctctctcgctccaatcaatttcatccactttcaacataaaccttgtgcagttagcattgtgccgccttaggaaatacagtgacgcaacttctacagaaaccaaccaatcaaaagaacgtgcacattctgacgtggatgtattgcaggcgacaatggtctggtctaccagaggaagtatataagttgccacatcagatttgtgcttgcgtggaggagagatgagaggagagagaacataagcgggctacagatttgtagccaactgcagcacgagctccaataaattatatgagagagatgtgtggattatacattaatgatgtagtatatttctgcagctaactattgtatgagtgaactatattagattgactataaataatgttttaaattttgaagctagtagtgagctatattattaaacttgctctcatgaaaaactttgatttgtccatttgaactaatatcattttgcctggtgtgtcatcgaaaaatactttgtcttctaaacaatg

SEQ ID NO: 8164 - DNA, 1501 bp, Oryza sativa
ggtggattgcagccttatgatgattattgttttgtgcttctaccatcttgtggctagcatatgacaacaatggactgcaagattgcaaggtgaggcttcatggcatctgttaacctcgagcttaagtagcgcatcgcagtgggaggccaaaggttgagcacgacgatgggcagaggacgaggttaagcaaggtgcatacctccggtgcaacttgcaaccatggtaaaaatatgaggcccaacatgcaatttactcataaataaatgccatagtagtatcaaacggttctggatcacaaagtgcactgatggggcgcgggcggtcaaagttccgtacactgcctgttcatgtccacggcgccgaactgccgaagtgaacccagaatccaatgggcggaccggctcccacaagccggttgggttcgtgtcattctcacgagtgagtagaggtggccaaacgggcggcccggcccggcacggcacgggcacgggtccggcacggcccgtttcggcacggcccgttaggcatggctcatgaaacgggccgtgccgtcccgacccacgtgccgagccgccggcccaagcacggcccgtggatggccgggccgtgcccgtgccggcacggcatgcgtgtggcccgccgtgtcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgctgtgccggcacggcccgttactgtagcaggccgtgccgggccgtgccggctacaggttccgccgtgcctcgggccgcccgttttggcccggcccgtttggccacctctacgagtgagtatacccagggaagttggccgccgctgcgtagccgaagctccaccacacgacaccccgcaaaacgccatgcgtgctcctgctgcacacttgtcccccgcctcctccgccgtgccgtcacgcaaccacggactcctcctccacctccgtttcctactctcttcttcagtttctcacctctccgcacgagaaaattcgaatcccccttccggctgctggttttcgtgccagaaacaggcgattttaccagtgccagttagctctcgccttcctcctcctccatcgtgctactactctgttcttctggaagaacactggtctcctcgcctacctcagtcaccactcaccacaccaggtgcgagctataaaaaccggcacgccaaaaatcttcaaaaccacacagaaacctcagatctccgaggcttcccaagcgagtcgacgaaaa

SEQ ID NO: 8165 - DNA, 1501 bp, Oryza sativa
cacgccttcggcgacctcacagccttggcctccggcccctcgggcgccgcctgcgggatccgggtgcacgcgccggagccatcgaatgaccagccgtggtatgagcactgcaagcaccccgtctcatcgatccgcccctcctacgaacacacagacatccagatcatcgccgtgaattcaatcggatcaaaattggcgcaaaagaggaagagattggaagggcgcgtggcgatactcataccgagaggggcgcgaggcgatgggggcaacggtcgtcgagggcgacccactcgccggattttgggtccttccagatgacgaggtcgcggttgaggagctggaacggggtgggcacgctggggtcgaggtcctcgacgagggacacggggtaccagtggtccctccacacgaacttctcgtcggccgacgacgtgctcggctcggtctccccgggcgcctggtccgcctccccggggacggacggcggcgccgccacgcggagccgtgtgtcggcgcgggcgcggcggaggcgcaggcgaccggaagccgagagcgccgggagcgaggggacccggcggctcgccggcagcggcctcggggagaggagaagagatgcggtcggagccatcacgggcattttcgtcgactcgcttgggaagcctcggagatctgaggtttctgtgtggttttgaagatttttggcgtgccggtttttatagctcgcacctggtgtggtgagtggtgactgaggtaggcgaggagaccagtgttcttccagaagaacagagtagtagcacgatggaggaggaggaaggcgagagctaactggcactggtaaaatcgcctgtttctggcacgaaaaccagcagccggaagggggattcgaattttctcgtgcggagaggtgagaaactgaagaagagagtaggaaacggaggtggaggaggagtccgtggttgcgtgacggcacggcggaggaggcgggggacaagtgtgcagcaggagcacgcatggcgttttgcggggtgtcgtgtggtggagcttcggctacgcagcggcggccaacttccctgggtatactcactcgtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgg

SEQ ID NO: 8166 - DNA, 284 bp, Oryza sativa
ggcgggggggccggaacaccgagggcgaaggggaccgccctagggtttggagggttctacaaggggcatgctggaggaggaggaggggcctcagtaggctcttctggaaggttcgaatcctacacagctccatcatctctcacaaatcacacattacactagtatttttttggagaagaagaagaagatatgatatgagtatgacggcggcggcggcccccctcccttcctgttcctgtgcgctttgtggtggtggatcgagggttagttcaaaattttataca

SEQ ID NO: 8167 - DNA, 1501 bp, Oryza sativa
agtatataaaaaaccatcataggtgtcagttcccaaccggctatatgtgccggttttcctaccggcacctattgatcgacaccaatacaagcaaccggcacctataccaaaaatagaaccggcacctataggtttgtacgagcaaaaaaaaagagccggctcgaatcgagccggaactcgcaatcgcaatcactgcgccatgccccacatctagttttttgaaatccccacatcacagatcatccaccaatcacagatcaaaacatattcaacaagaaaagcatccacaaatcaaaaaacatcttaaaagaatctacaaaatcatcccaaaaaaattcctcaggcgccgccgcccgccgcctcccctcccaccggatttgacggaggggagtgtgcggcggccgccgttgctgtctccgaggtccgccgtctcctcttcggtcggatcgagcggaggggacagcgccgcggcagccgccgccggccgttcccaaaggtccaccacctcccctccggctggatccggtggaggggagggcgcggccgccgccagccgctgctgccgcctccgcctggccaccgccgaagcccgccgactcccaactgcctccctccacaggctcccctccacgccgccgcctctgtctgtggggtgcccgccgcctccccacctgtcggatctggcggagaggagggcacggccgccgccgcctctgccgcgtccactaggccggttgccagccgcgggggcttgccgtcttcgccatgcagccactgccgagagagagagagagagagtggtgggagagagacgcgagagctgagagacgagagaaaggtagtagatggataaggcggagagacgagagaaaggtagtagatggataaggcggagaaacgatttgataaggacgcgtggtggtgtggtgcttatgggctcggctcgccggcttggctcaaagctataggtgccggttttttaaaaaaacggtacctacaatatatgataggtgctggtttttttaaaaaaactgacacctatagtataagtgccgggtttttttctagaaccagcatctatatatattgtttaaaggtgccggttctattttttccatcgtagggaggtgggaaaagctctataggtgtaggttttaaatgaaccgacacctatgagccgttctctatgacggttttttagtagtgcatgaaaatttggcggaccgattcgacccaacactctcgcgtgaatcacgtgaggcagcggcgaggttgaccacgcgtcgcagcctcctccctttgtgcttcccctccctcactggcttctcgtccaggaagcggctgcggcggcggcaacagcgacggcggtgttggtaggaagcagtggggaggttgatgcgcgagggagtagtcgtcacgacctctttccttctccctccacacttcccctcttgtgccatcttcttgtccaagaacggaggaggcggctcccagcgacatc

SEQ ID NO: 8168 - DNA, 845 bp, Oryza sativa
gccattgattcatattcattgtgtgccatctggtggtgttgtgtataatattagtaggaggggagccttggggaaatatgtagcgcaaactttatatgtaagacaaactgtctgattatgaagtgaatgtgagagatttgtccatgtcatcacgagtaaaagttttatttgtggtgatgtggataaatcttatacgtcaatttgttttatcatttttaggtatgcactacatatatatatatatatatatataattcgtttgtggtacatatttctccgagcttgtcgcggtggtcgtttatacacacgttagctttagggtcatgttgtactacacgagaatgtaatgtttctctctctcttttttttttgaaagaaaaaagatagtaatatgttgtattacagcagaatgtaatgatatactagtatgtaggaagagtggaaggtagttttgggaagagaaatggggatgtgagtagtttgtggttgggagtgtaacgggtggggtggtttggaaggtgatgaggtattggatggagtggagggaaggctgaggtttgccgacgagttcccaaaagtgggatacggacagatggatagatagatagatagatagggccggcaacccagttgggttttcctttcctttttgcgttgataaacccaggcgggggcggcgccgcgcagcttaccaataccaattggagtagaaccaaccaaggaaagaatggcccggctgctactctccggcgtcgcgccgctccccctcctcccctgccgccgtcgcgccattgcatttgcgctcccacttgggaatgtccgcctccgctcgtgtggccgcaccc

SEQ ID NO: 8169 - DNA, 1501 bp, Oryza sativa
tcatcgtcttaatcatcacatcacatataaatatatataatggaataatgaacgtagagtacattgttatgctagtaatattagtagagtactagagtagcaattaattaaccaggtagaatgggtaggcgagcatggggaagggtatggagaagcggagcatccgggtggctctgttaaggctcctgtacagccgctcggggagctgcattttggattggattgatcagattcatttgcaatggggaaacccaactggagtagttgcaattaagtagtgaaatcgagaaggaaggaaggaatgcgtacgggatgccaggactcatccttgtcgacatggccatggttctgatgatgcgtcctgtggctaatcctccagccatggtagggtacgaggatggaggagtggagtatgtggcccatcacgctgttgagcctcgagttgttggagaagctcccgtgcccgctgcaattccaattccatgaacgaattaattactactagtgtagtagagtggagtaggaatcaaaatggaaatgaataccgtcgtaccagtcgtggccgaggacgaagagcgcccagaacatggttccctgcgccgcccagtagagcggccaggcgaggcagctgtggaggcgcgcggcggcggcagcgagggcgaacaccaccaccacgtcgcgcagcacgtaccccatggatcgccaggggtccttcacccaacagtgcttggggatagcggcgcggatgtcggccagaccaaacgggggcgccgcgcccgggtcgaagtcctcacaaggaggaggaggagcattattttcattgtcgtcctcctccacggtggccacgcggctggtgggtgcggccacacgagcggaggcggacattcccaagtgggagcgcaaatgcaatggcgcgacggcggcaggggaggagggggagcggcgcgacgccggagagtagcagccgggccattctttccttggttggttctactccaattggtattggtaagctgcgcggcgccgcccccgcctgggtttatcaacgcaaaaaggaaaggaaaacccaactgggttgccggccctatctatctatctatctatccatctgtccgtatcccacttttgggaactcgtcggcaaacctcagccttccctccactccatccaatacctcatcaccttccaaaccaccccacccgttacactcccaaccacaaactactcacatccccatttctcttcccaaaactaccttccactcttcctacatactagtatatcattacattctgctgtaatacaacatattactatcttttttctttcaaaaaaaaaagagagagagaaacattacattctcgtgtagtacaacatgaccctaaagctaacgtgtgtataaacgaccaccgcgacaagctcggagaaatatgtaccacaaacgaattatatatatatatatatatatatgtagtgcatacctaaaaatgataaaacaaat

SEQ ID NO: 8170 - DNA, 1501 bp, Oryza sativa
aaacgatgtaactcattttttaaatactccatccttttatattagagaaaagtacaaattaacccctgaactattgggtgagtacgaataacaccccctaaactcgaaaaccagacatcacttaccccgaacttttaataccggccaagaaaccccccccccccaagcactgttgtgagcggtttagagttcgaatagcacacgtggcagtccagtcagcaattttttttctaaaacaatagcgggcccacttgtcagaatccccacctctatttctctcctcctctcgttctgaagagtgcggcggtggcggcggccggcccgctctggaggagtagcacgagtgtgcatgcggagaaatacggtggcgcgggagaggggttgacgcggcggggcgcggccagtggcatggaggcggaggcgagggccgcgcggtcgacagcgaaggtggggcggcggagatagagagccaccaccaccatagcctctgccgccaccgccaccaccacaacctcttccgggggagaacgacgccggagctgtggtcgcagacaaagacggcgaacgagaggaccaaggcgcaggccaccaccacgcacaacgccatggaccacggtcgcccgagttcgataaaatcattactcagttttttgagatggagataataattgatctcgatctgatgtgtccatggaattcggaacgtttgttgcttcaaatcgattcacagttgagcacttgagctcctccgccatgcacggtggcccagagcttggacgccaccaagaaggaagaagtttttctttttatttttttttgtttatagctctccgccccatggacttccggcagccaatgcccgtcgccccaccgacggcacggtggttagctggcgatgcgtcgctgtcacggtgctgacacaagccatggccgcctccgccgccgcaccttcaccatcgaccgtgtctccggttgcaccgccctcgcctccgtctccatgacgctagcctctgcaggcgccccgcagcttcgccctctctcccgcatgcgggacagcggggcggccgcgcgtttctgaaggagacggagaagagagagagaaaagatgggtggggaatctgacaaatgagcccactattttttaaaaaaatattgctgattggactgccacgtgtaatattggaactctaaaccgctcgcaacagtgctcaggggggtttcttgttcggttttaaaagtttaaggtgagcgatgtctggttttcaagttttggggtgttattcgtactcacctaatagttcagggaggtaattcgtacttttctctttatattatactcactccatttcaaaatataatgcataatcacctttaactaaaaaccaataaacaatcattatcacctcattgttggctcatcctaataaattagatgatgtctcgcgcgttattgcggaatatttgtattaaaatggaatttaaaaattcaagtacactttgc

SEQ ID NO: 8171 - DNA, 1501 bp, Oryza sativa
cggcccctccacgcgagaccgccccgcccagacgttacaggccatgacgccacactattatattctcatcttttcccttgagcaaatttaatagtatagccaactaccgtctccaaatcatatatagttaatttaatagtcagttacctataaacatatattgcattattaatatatggtcttatctatcatacacacattgtgtcttggagtctgtgctgcagctgtctcctctctcatattttatctcctcgacatgtgtttatagctagcttatagtatgctattgtgcctgctcttatacttatctgccaaaatttaaatttttcaaccttaaatttaaagttaattttgggatcttcttttatcaaaatttatttttcaacctctttatttttagatcgctaaaaacacatatatacaagttttattcgcgaaatatttttcatttgcaaatatgccatttcgcttagagcaggtaaaataggtcttttaagtgggcgataatctgtacacggtggcaaaagtaatgatctggagaagaaattagtggagagagagtgaaagtgggcgactaatttatcgtgagcagcagaaaaagttagattaaaatattgaaaaataatactacctccgtcccaaaataagtgcagtcacaagtttccgcgcctaactttgatcgtccgtcttatttgaatttttttataattagcatttttgttgttattagatgataaaaccatgaataatactttactcgtgacttatatttttaatttttttaattttttttaaataagacgaatgatcaaagttaggcgcgaaaaaccattgtattgctgatgtggatgtttttggagccaaccgtggactatactattgaccttgctcttattccccaaataaagaaaacagtggctcttagagcaagttcaatagtatagctaactaatagctccaattcatctatagccaatctaatagttcattcatacaataattacatactatactattaatactagtcccacctatcatagacacactacgtcttagagtctgtgctacagctgactacaaatatgtactccctccgtcccaaaaaaagacaaaccctggtttccgtgcccaatgtttaaccatccgtcttatttgaaaaaattataaaaaaaattaaaaagacaagtcacacacaaagtattaatcatgttttatcatctagcaacaataaaaatacgaattataaaaaaatttcatataagacgggcagtcaaagttggacacgcaaacccagggtttacctttttttttggacggagggagtagtccgctgctcttctctctcctgatttatctatactaatataaaaagtacgagctcatccacaatccagcaatcctgcagatccgctatcacgtgggacccacctgtcatccggacaaagaaaccgcacagaccacgtcgcgcacggaaaaaaatttcgccaaaaaaaaaactgct

SEQ ID NO: 8172 - DNA, 1501 bp, Oryza sativa
atcacttgggagcttgatgcgtacatgggggacatggtcacagtgttccttctgtcctgccctgattcccttaaagcaaaagaaaccagcaaaatgacatgtatacagtccaaactgctatcgtcagaaaaagaattgagatccgaaaatttagaaatgattgcagcttcaatacagtaacatgaagatatctgaacctcatcaccaaagtttatcaaaaaaaacaaaaccctaattcatgtatggccctaatatcactgtaccagcaaaatggctagtggtttcactggagcacaagcaccttttgataaaatcacaatctatagatttggaaagatcgaaatgtatgatgcagctagagataaaaaatttcaccagaactgtataacaaaaggaacataagtaaaaccacaatctaagacaagcaaattaaacagacctcatccaccatccatttgaagagaggagatcaaggctatggctatggcaggtcccatcttaaagataactgccaaagcctgcactctctgaagtagagatatgtggtattctttccagaaaagagataaaaactgaactgaacacatgcactgtgaatttcaatggacagatagaggaccctttccaagtgaaattaataacaatattatagcccgcttgcataagattacctgaagccactctaaatatctttttcttgccaaatctgaaggcagaactctatgacttaatatatgacatgtttctcctgtgtgggcctaatgtaatgcatatgcctagtactgaatggaatggaatagatttaatagaaataatctatatatgaaagaaggtgctgattatggaagtgttgaatgcatgggaactgggagcaattgatcatcttactccagctaaattttaaaaaacataaatatatttatagatgaaagaggggaaaacatatatacaaggacaaaaactgaccagatcttcatgtagttgatatggttttatccaagggattagacaactgctgcttatgttgtgtgaactacacaaatcagctacctcttcttcaggaaagtatactcatacatcaactgcaacacatgcagtatctgcaatcgtgttaataaatgcatcaccgagaaaatcatatgcctgtaaaaagcaataaatggtcagcatagtcaaaaattcttatcaaggcaaaacactataacaaacatatagtgggcagactatttgtacatgttgacctacgcctccacaccatgccgcctcatatcaaaaaatgtattcatttgtacgacaattgcgcactacattttttggaacatcaataagatattaatattaccctcgttcaattcatatccatgcaaacaataaagaatctctgcatctctattttaacaaaatgattagctgcttgctcatcttgttcttgtaataaatagattatgaaataggatgaaattcatcatattctgtctgagagaggcaatagagaactgag

SEQ ID NO: 8173 - DNA, 1107 bp, Oryza sativa
tatatgaatgtggacaatgttagaaaatcttaaaatatgaagcggagggagtatacacgatttactaaaggtacatgtaacaggaacatcagctttgatgatttggtaaataaacatgatctgtggtcttgggctcttggtacagggagatccacatttgacagtgatcatgcaggttgcgcccactcggtacaataaaactaagcatgagctgaaggagagtaaagaagtagagtatacatacaaaatgcttatccagtgtcaatttctgaaaataaaaatataactgcatctgatcaggactccgagagtctgagccttgtgaccactgatcagacatgaagtggtagtagtatgacatatcggcttgtgaacgacagaagcgtgaaatagctacttcatccgtcctaaaatatagctacctattattatgccgctatattttaaaacggagagagtagaaatatcatctggtgatgcgccacggataagacgatcaattcactataaatacaggcatctcatctgctgctgacttgttgagagagcgcttccccaacttgtgtctttgcagggatataggatttgatgttgtggaataaaactgcaatcctcactgaataaatccataacccatcctcaagagttgggccctgaagtaccagcattaaaaggctctagcaaccagaaatagatcctctaacttactgctctctaactttaagtggctgacatatgtgctcatgactagcgtgccgcatatcagaggacagtgcgttagaggagtctcttcgctagaaaccatggacttccctgaataatgcccttacacccccgagaagcatccatccaagttcctcttggtggtgatgaattgatgatgagttgaagcagcagcaacttcacttgcatgacctacagcggtcagaagtcatctcgatgggtttttatctggttatgggaggggaaaaaaatttatgagagcagttcaggaatgataaggtcagcagcggcgacggcggtcggcttgcggcggccgtgaatgtggaggcatggtggcgaccgtggctgtggtgggaggaggcacggtggtgaccaccgtggtta

SEQ ID NO: 8174 - DNA, 1501 bp, Oryza sativa
tctgttttttcattcctacgattctaaggggccctctacttatgtttcccttgcccaagaaacaaagggtctaaaaatttaggtaccgtttgacatgatttcagattaaacgcggacgctcacacatacacacgcgtgcacatgtactttatccagtattatccatatacacacctccgagatattgtgccagcatatccgattagatcaccattgacatatcttgacattgtggtggcgtgagttgcgaacttacaacgattgtggtgacgtgatagtgtgaggtgtggacttacaacggacatgcagtatgagggctagttcggtgatgggggtggggggggggggggttattacttattaggtgatgaggaaggcatacaagaaagacggattatgtctttagataaggtattggcaggaaacaatatgtttgttgtatgatattgttattagttaaaaaaagtatttgcaaaagaacaacagttttttttattaacttttaaaattttactaactgttacaaagttttatatgtaaaataacttgttttccttctttttttactcttttcagaatttgatctgttgcaaatgaccattgggcctaagcagcacaaccagcccattaagcctaccaacatgagatgaatttttttatttataattttttttattaaaagttttacaaaaataattttccattttgaaaattgacggaagtagtcgcctaccgccctctgggaaaaatcgccctctcagagggcggcgaaaatgacgtggcagacggccgttcgctctcgggcgacggccgtcaacgaaatttgcaggcggcccccttgccgtcctccgctagggcgattttatactgtgcggggggccgcatgcaaatgggcggcgagggggggcatggaattttgcaggcggcccccttgccgccctccgcttgggcgattttgtactgtggggggggccgcctgcaaatgggcggcgagggggcatggaattttgcaggcggcccccttgccgccctccgcgagggcgatttttgcctctccccctataaagcccagtccctcctctgtgaaatttcattatattcactaaaaatcaaaaaaaacgaaagagagagaggggagggcagcagaaggggagcggcgaagccctgctggttcgctcaattcatcacgggtatgctcccatacatcttttgcatttgtactaatatgttatgtttgagtatatatgttgcgttttagttttagttccatatattttagcacatctgtaacacacagcacatatgtgtagatccagagcatagaatataatagtatgaattgagacatagacagtagtgttaattataagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 8175 - DNA, 1058 bp, Oryza sativa
ctctgaagaaagacaacaatgttgacattggatcaggaattcgaaagatactgaaatgtgatgatgaaatgcaacagtttaggaacctttgtgattatatgccctttatacttgtgttgtaggccatcgattgtgttcatagagttagattggacctctgtatcctcagctagtttctcttgcttgaagagttattgccgttgttggacgatcaatctatattgcagtgttacacaaggtaactgatgaactgatattactatgctgtcgctcaagctgtattcaagccagacaattttgtcttctttttgagctttatggacttgattgctaactactcaattgtagattgagaatttgagttttgatcaagaagagcggtaccattttactcctgaaagatataagctactcctccgtagcattttttttcctgtgaaactaatgcctttgcaaacgagacctacctttttgtgccggcaggagtacacaatctcgggccctgtgatttagatgactgattggatttttgtcacagattatctacttacttaattatagagataaattaagacttctataacaagtggtctaagcaatgcatagaagatttttttttttgaagtgtgaagtaaataatctgtttcaataatccggtgagtaatacgtaatatcaaaagaacagaggccggcgtgcaaggttgttcagaaccatctgttcatccatgaagtgcaagtactgcccagcccaatgccccaagagcccacagtacccttgtcagaaatcacgagtagtacaagggcttgaacacaaaatgacccatttgaaaattcgacctcctccgctttggcgttgaacagcaaatcgcgtgtcaaaactcaaaagcggacagaattagaaacttataaaatctctctcgctgcctccacttcttcttcctcctcctcctcctcagatccagcaatccgcgataccaccattagtaccattcgaagcgccgccctctactcgccggagaggaggaagacggagcaaagggagcgcatcagataagcag

SEQ ID NO: 8176 - DNA, 1501 bp, Oryza sativa
aacatgaaatgtactagatctggtgccactaggaaaaaataaaaatgattagtgttcaagaataacttagccgcatcaaatcccggccggattccagggcacatccggtgccgaggcacgcaagcgaaacacacgaattggaatttcaggaaaaaaaacacacgaattctacccaaatcaagttcatttttctaaacaatacatacaaacttcaaacagagctttaattgcgcgcaacgcatcactcttgccaactgccacgccggacagttgaagcacacatgcacatatcgccgcacatgcatcgacgccgacctgctggtcccgcctccgctgggccccgctgggccccacctgccagccaaaggggggccgtgacgtcagcgtctacctagctcatggcccctcgtgctggtgtcagagaccccccctgtacttgccaagcagataggaggagcgaggagaggagcccccctcgaatcttcttcttgccttgtgctgttatcatagtacagtgctgtagtatttgtttagtttagcgggcgccatcagcaacagcgaatcatgggatggaaaataacaaaatgacagttctaagcagcagcagcagtagcagttatactagtctattcaagatccccttttggctggcaatttggacagttctttccagtggcattttccttcttcttctcgctctctgctcgcagctggagctggtgaagcactagctcagctgatcgttgctgctgcttctgcagcaaaacgtccttttcttgcctcctcttgagtcttgatctcctatgccacaagctcccaaagaggaacccacaagtttgggagcttcttctcctttcagttttttgctcttcctctcaaggagttttgttcttgcattttgtctcttcactcttcatctcctagctagctagctagctagctctgctcatcttgccagttgcaaggcttaatagtaagttctttgatgtaacgaggaaggagtgttgttgttgttggcgacaaggtgttgccttcaccattccctcctctccccacaaggtccaaaagcctaaacttagcaaaggcgccataaagtaatcaaagctgaagaaaaatattggtgctcctttctcctcctcctcctccaagatccctagtttttctttcccatggtccaggttttgctctgcctgatgctaatggcaatgtaatgtagcggacagctgcatcccatgccaagaaactggggaaagaacgggtctttttaatccaacccctgcacattgctgcggtttcttggtctgttcttgatccttgagctcctctcgtggcggcaattgcaatgtggtgcctgcattagaggcagaggcggttagtggagaagaataggaggagttgctcatcaggaggaagaagaagaaaaggagcaaaaggtgtctccttggtgtgcgtcttgaggggaaaaaaaacaagatggccggaggcgagggcggcggggctg

SEQ ID NO: 8177 - DNA, 1501 bp, Oryza sativa
ttacatcttacctttgtatccttatggaacatatgtatatatataatccctttgtattcttatggaacatatgtatatatataatcagtatatatgcttataaggatacgacagactccaaaaaaaaatgagaaattttgggtcatgacaagctgcttatacaaaaggtgattggtttttattaaaaattacaaatggtgcaactctatgtcactatttaccatctcacagaagttgaacatgaaacaataattttatgtaggaaatgccaataagaagtaaaatgatcaattcgagaaaatcttataaaaatctcagttccttttcaccaaatttggaacacccgttatcgtagcattacataatttttaattgcttagatcctaatagccttctcacagtcctatacggtgttattagttcctccatatcttacatatataagggcactaaggtagcaatacataattgactatgttttttttccttaagatatactccctccgtttcacaatgtaatcattttaatattttccatatttatattggtgctaattaatctagacatattcattcaatatgaacgtgagaaatactagaatgacttacattgtaaaacggaggaagtactatggatctcacacatccgaaggaagcatggtctagatatgtctcttctctatctttatttgtatgatccaattagagggatgtcacgccccgaactagtcccgagcggaactagcccgtgacgctccaaattaacctgttaaccgataccagtcccaggaaacagtgctggtatcacaggaagacggaatatcacagcaacagatgtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggaattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaatgacacggatgaacagtgcgtctcgtccggtcggagtatgtgcaatgattcagtcttttgaattgatcaagattggcacccggccaaaagctttcaaacggccacccgggcctggctgatcccatcagccgcagattttccaaacatcaacccattccacacagcaaatttcacaaggcagtagtcaaacaaaaactacgctaggaatcacctcacatccgcccatgaccgtgggcacggctattcgaacagttttaataacctctgcagagggggtacactttacccaca

SEQ ID NO: 8178 - DNA, 1501 bp, Oryza sativa
tctgggccctcccctagtcccgctgacgtatggggcccgcctgtcggcgcgcccttcctctttgatgacgtcagccgtgccttttcccttgagaaaacaattaataattgtgcaataaatcgatattaattctagaaattcatttaaatggctcaaaacttctaaaattcatatctaattcattcgaactccgaattgagccattcaacttgcaaaattcatctaaaattaagctctacatgtttgtttacttttcatgtactgttttcttggtgtttattagagtttttcctcgttttgcgtgctagcatgtaggatccgtcgtttcggaagttcgcggtcgcgaggaaaagagttcggaagatcaaagtaaagaagcaaggcaagtcacacattccccttgagcatgttgatcccaatttacaaatgttttaccatttgcaaataaatatgcatgttttgctaattacatgggatcagagttttacctatctgctcgcttgtgccatgtttacttgatatccgtcctttgtcaacattgggtaataaattggctagctcatgttacttatgtgacctagctagaactatatgcttagccatgcttaattaccactagctcagttgatgggataattacaatattagacctttttagtatcagaatgagctgcgtgctcgagacatctggccatgcttcattgtcgtaattatccaactagaatgcgactgaatggtgggctgtgggtgcatggttatgctagtcgcacccatggcaattaaagaccggttcgtgggatgccctagaagaacttatcgtacttaccacaagccagcgtggtaacggctgggcttgtagtgtagctttcctctagccgacgtacccaggcgagggtgggcatgatggagttgggtcggccggggtgtccggttgatcggcttctggattcatcgcggcacgagaggagggctgcccattgtctgctgggggcgggggcgaaccctaaggtgtggtgcgatcggttagagggggttatgcgaagggtcctgtcacggcctctttccagtatgtcgtggtggcatgtcggcgcacggaaacgtgtcgtggggctgagtcttgtgggtacagttgtacacctctggccagagtaaaactattcgaatagccgtgcccgcagttacgggcggtcgaccagattcaccgtgattagtcccaccttaataaatcgactcaatgcactgtagttcaggtgggttggttgggcctgttcaacgtggtgtagcgttgatgagtggagatttaatgttactttaattactcaacagttttactgttttgctcaataaaatgttttacaaccgcctttatgcaaatagccacaaaccgtccttgtgttccccttgcacgtctgcatcattgatgtggcttgctgagtacggtggttgtactcagccttgctattattccccattttcagaagtattgtgcttctgagctgaa

SEQ ID NO: 8179 - DNA, 1501 bp, Oryza sativa
gggaaggatttggattcgggattgaactcgacgatagattggggatttgagatctgagatggcatggacactagacaacaagcaaagaaacggatttcgtaaatagggtttttaagagatagttttcccgctaggcgccacgatggaacgggcgctacaagggaggactaatttgattgtacaattaaacataattattagcaacaatagtgcttttatatttgtgaaaaaaaaagagagagcccctaaactttccataaagaaaaggaatttacacctacttgtttttaaaacaaactaagtctaatttcttttagatgatgaaatggatcataagtattttcttattgaatgcattgtatattataaattggccctcttcttttctccaacaaaaactggataaacttttggataaaaatggcacgcttttcaaactgctaaacggtacatttcgtgcgaaaactttctatataaaagttgctataaagataagattaatctatttttcaagtttgtaataattaaaactcaattaatcacatgttattaccgcctcgtttcgtgtgaaacacctaatctttatcttcattttcatcttcggctccagtggtagcggcggcggaggcaagggcggcgggacgtggagtgaggcggcgacggcgacctccttccctaccgtcgcggcggcgcagagctcggacacaccggcactgcggcggccgcccccttcctcctgcgccgccgtccgccgctctcgcctccgcccgtccttgccctctgcctacccccgcccgtcctcgcccactgcctgcccccgcccgccgcacttcctcgcgcgccgccgtctgttgcccaagcgagccaccgccctccgcccccgcccgccactatcttccaatcccgtctctggtgcagggcggcggggcctcgaagacggcgagggggaagtgccatcgtgcgccgcagcctctgccgtcgttgccgccgacgtcgatgtcgtgcgccgcctctaccgacgttgccaccgtcgccgcagcctcttcccgccctgacgagcgcgtgcccgactcggccatccctgccgcgctcgcctcgcctcgcctctaccgccgttgccgttgccaccgccgcaacagcctcgtccctccccgacgagtgcgacagggccgccatccaccgcccgccttcacgcccagaaatttagcccaaatttccagactattttgtgtattaaatctctgtccagaaccagccagggtacacaaaacgacaagtaatataccgttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttctaacttcgtcttcagctcagaagcacaatacttctgaaaatggggaataatagcaaggctg

SEQ ID NO: 8180 - DNA, 1499 bp, Oryza sativa
caacgctcgccgaacattgaaaccgcgatagcttgtttcagaataaagatactgaacgccgttacattcaacttatgcaaaacacaagcgtttttcccagcgcaaaatgctacgagtcgaaaacagaagtcgaaagctgaaaagtcaacaaatcttttcgccaatccccgaaagggggccgaacgcatgacttttggcaaaatcccctctaaaacaacagggaaaaggggaaagaaaaaaaaatacaagtcaagaatcgtgcaaagcagacaaacttggcaaaatataatcacccagtgtcataatacagcttcgccattttcgaaaggcgaatgccagtgttcatattttttctgcaggagtctaaaaagaggtttcgacaggaacatcagccgaaagggggcgcctcatgccataccgtatagtttgcacggtctcggccgaagctccttactcacccttgcccgtgaggggcttgttggaggcatgccatgaagcccttcggccggacctgccgaaaccatagtaccagccaggatttaagctaaagacatcaagaccattcaggcgaagccctatggcgaaagccataagcgaagatggcgaaggctgaaaagccgcgtcggtactccgaaagtaaaggcatctcgggcgaactacaaagacttcgccatgacgagttcggcatcaagaaggcccaacaggccgcccccggccttttaggcccgttcgccatagaccaggcccagcctatcagcccattaaagacccatatgtgcaaatgacactgcgtacccatgtaaatgtccctttcataagggcaaccatgtaaaatcctttgtaaccctaaaccctagaaggtggaagcttgtgctaaggctataaatagacctctagggccatgtaatggggggatccccaaaaaattttaagaattaatacaattgcttttacattccaactattgttgggagaaccacgcctttcgacgtggcatagttgtccattcgacaacaaacttattagagaaggttagtgatttgataaacaacgttagttagtcaactggttgcatcattgccccattttcaaggtaaaccaaaaaattatcaagagtaatgcaaattaacagcctgcattatctcataagttgagagtgtagctcctgagacaagtcatctgggctgatggacaggggtggacagaaattccccgaagaccgaaggccgacccaacctgacccgaaccgaactaccggtttttttcggtcttcggctggagcttgggtttctaattttgttttcttcggtgttcggctgttttatcagcttgtagataacgcaaaccgaacgcaccgcatacaccgatctactatagcatgtcttgtgtctcacaatcaagaatggcatgtgggccccacatgtgggtgggtcccacattattttgatgtgaatgacaaatgggtcccacatatttttttaattctagaacacataagc

SEQ ID NO: 8181 - DNA, 1501 bp, Oryza sativa
taaatgataagtagcatatttttcccgacatagatatgacaaacaataattactccttacccgtaaacttaaaaactacaaatatccgctttaattttctaacgaattgtataactatttattccttagattcctaatagatacgcaataatgaaccaacacaaccaactccctcccataaatatttgtatgttgttttgccgtcagacttgctcacttagtacctgctattttttaaggtgaccgtacatgctgactatttgttttttgaaaaatatgacgctataaatatagttactcccgttgtccaatactttctcgtcagcaacacaatatttcgttaggaagtggattgcatgatgaatccttttgcacaattgtttggcctactattttttacaattataactaatttaaatttcaaaatgttacaaattagagattagaaaggccaaaaaaggcgaaccgtaacagcccaacaaacttcgtctatactcaatagttaagtactccagggagtattaagcagcacccaaaaaaggacaaaaacaactgcaaaaatcgagtacagttcaatcacagcaagaaactccttgtaccctgatatgtcacgaaacgcattcaccgctgcgtacaaaacaggatgcataaaaggatagaaacggcaggcggcatcatcctcattcattcagttcttgttttggccacctggggcgcgtttccactgcttaaaccttaagcaaaccctaatggaaggtgctggttaaccaaggggggcgtgtttagtgagatgctaatacatccaaatcgtccagggagacacagtgcttgctagacacaaaacttaagaaccaccccacccccacgtgaacgccatggggtaattaccatcgttaaaacctatggatttctcgcatcatcgcaagaacccagacaaaaatctcttgctttaacttgcaaaccgaagcaaaaaaccccaaacaaaaaggggtaaaagggcttgatgataaaaaggccaggggatcaaatagaggtgccaagaaaaatcgaataaaaattttccatttctttatcccccgagtcgtgacggcggcggcggcggacatggttggtgataaggacgcggcggcgctggctggagagctgaccggcgacgcgggcgccagcttgaacggcttctttgaccacacggtatgcgtctctctctctccaatccccgtgtgagaggttgggttgccgtattggctaggtaggcggctggaagttttgattttttgcgtggttcttgcagggtttggagtcggcggtggtaggggaggggcaaggggaaggggaggaggaggaggagctggagtggctttcgaacaaggacgcgttcccgtcggtggacaccatggcggcggaggtggagtcggcggcgcccggggcgccggcgcgcgcggcggtggggccgaggaccaagggtttgcggcggcgccggcgggtgactgctccgtggagc

SEQ ID NO: 8182 - DNA, 1501 bp, Oryza sativa
tcgcaagaacccagacaaaaatctcttgctttaacttgcaaaccgaagcaaaaaaccccaaacaaaaaggggtaaaagggcttgatgataaaaaggccaggggatcaaatagaggtgccaagaaaaatcgaataaaaattttccatttctttatcccccgagtcgtgacggcggcggcggcggacatggttggtgataaggacgcggcggcgctggctggagagctgaccggcgacgcgggcgccagcttgaacggcttctttgaccacacggtatgcgtctctctctctccaatccccgtgtgagaggttgggttgccgtattggctaggtaggcggctggaagttttgattttttgcgtggttcttgcagggtttggagtcggcggtggtaggggaggggcaaggggaaggggaggaggaggaggagctggagtggctttcgaacaaggacgcgttcccgtcggtggacaccatggcggcggaggtggagtcggcggcgcccggggcgccggcgcgcgcggcggtggggccgaggaccaagggtttgcggcggcgccggcgggtgactgctccgtggagcctggcgccccttctgtcgcgcccgcgtcaggcggcggcggcggcggcggacgcgggggcgccgcggcgccggtgcacccactgcgccgtggatgagacgccgcagtggcggctcgggccggacggcccccgcacgctgtgcaacgcgtgcggcgtgcggttcaagtccgggcgcctcttcccggagtaccgcccggcgaacagccccaccttctcgccgctgctgcactccaactcccaccgccgcgtcatggagatgcgcctccagagcgaggaggacgcctcggccgccagccgcgtcaacgccaaggcacgccgcgccgagcgcgcggcggcgcgcctcgccggcaaggacaagaagtgatggaacaaaaaaccgttgcctcttccccggcggaggcgaagttggacggagacgattagcgcgtgtcatctcatctccttttgcatttcttttcaatttccattttgtagaacattaggattagagagaggtttaagaacatctgccaaatcttagttcttggcaaggaaagatcgacagacatcaaagcagcctctcgtcatgctcaatttttcctgaaaccatggcaaccttggtgttgtaaacaaagcaagcggtgaaagtgctgttgctgtttttgcttattaggtccctcctattcctggtagtagcagtagcaaaggcgatcaacatacacagcgtctgaatgtctgaatgcgacgtgtgtatctatgccatcatcggccgggcaagccgctgctgcagccttgcagccgaaacaattttgacggctctagcagtctaccagttccatttcttcaggtttggctgctggtagtaatggtagtatggtagactggcagtagaacatccatatgcatatatccatctctgtgtgaggctgaggcaccggcaa

SEQ ID NO: 8183 - DNA, 1294 bp, Oryza sativa
cccttcagtcccctccccccgcaagcacaaggaactgcctactgtcatcgatctgtgtacgcatgtcttccactccacatgcttgatgagcccatgactcatcatcatgtcaattaataaccgctgccaccaccgctaacccgatcagcgtcttaattaactttctatgttttaaaatatagctatcactaaaaaaaaatatagctgccattttaagttcaaagttgaactatatattttaagatggagaaagcacatttataaatatttgacgtttagagtagggttcgatcaaagttttaaaatttaaaccgtcgaaagtttctcaaatgtgtagtttaaaaccaaatgaaattgtatatatatagatttacctcgaaaagtactaccgtgatattataaacctattgaatcttataattaaactgattctaatatgaaattgatagaagtgaattttaaagtttgaccaaaacttactgtaaacgtcaattattcattgccggagggtgtatttcaatttcttgttcattttcactagctatatatactatgtcgttgcttggtaatttggaagaaatcaaatcaataaaaatttcagtatagtccgttttagcgatatttcaataattcaattctgcatataacctaagccatacgtcacaattaccagaaccagacagaactcgtctaccatggtagaaaaacaagcacttaatttgatacgaatcattctcatgcgagctcaaagctcactggaagcaactgagacatccaaagtacatcaaggtccagcatagtcaacaaaactaggctggaaacttaagaacttaaccaattaatcgatgtccagtttaggtgtgatttgtgcacactccaacacaggaccaagtctaggaaactagtgaggggtagttggttcttgtgtaccaaacacctgcacagaatggccattacccatgtcatgcatggtttttatagcaattgggactagcttgcaatcatctcccagtgatccatatgcctctgcctgaatattaactcaccaaatggttcaagggatcacattttgcttcatattcagtagccatccagagttccccaagaagcaaggctgccatgcttctttaatccagtgctgcattttataagcagctttgttgccaattcagttgcataacctgcacatataaagagggactgcaggctaggtgtgctagaagcagaatctcaagctgtgagggagtagtaactgaattttgatcagttcattcagttgcatgtccttgcatgc

SEQ ID NO: 8184 - DNA, 290 bp, Oryza sativa
atggttgagggtaaaatagggagaaatttgaatgagatatgattgattgggcaattagtactctagaattacaattatgtatgtatatatatatatatatatatatatatatatatatatatatatatatatatatatatatccctattctttagaaagtggcatatatatgtctatttttactaccttttctctgtgtgtcgggcctagctgccggcccatcgtgccgggccgacccaacatgccggtggggggggggggggggcaggcatggcccggcggtcaggccg

SEQ ID NO: 8185 - DNA, 1330 bp, Oryza sativa
aagaaatcaaaccatttttttaaaaaaaaatctaatccacgctggatcgaacgacgattttatttgcctgatccaattcatttactatatgagaaattgagaattaaagagagaggtgctttggaaactcgtgggaaacgtgcgaaatctcagtgccagccgtgagcaaagacatagtatagcattcatgccttctaattaattgattcattccaaaaagaaataataaatatatttaattgcactactagagtaatactatacatggcttacgctattatctttgtctatatatgtttctttgtacgtatactaccagtcgaggaaagttcgagagcattcgtagctggaggctacctttttagccgcccacccaactagttgacgattttaaggttgtattcttatgtctatattgccaactcacactttcttctttttgtatgcacacttcccaaacggttaaacattgtattttttatagaaaaattgctttaaaaatatattaatgtaatttttaagttttttactaatacataattaattatgtgctaatacatcctatcgtttcgtgtgtcaaaaacagcctaaagaaagaaaaattgcaagaaaagaaaagagccaattgacttggctggatacggacaaatatcatctcactgcatgtgtcaaacactcaacagaaacactaagttagaaagagacaaaaaatgacttgaattcagccctgcattgtatggtcgccgcatatgtaggtggagtgaaaccatgggccgtcctcttgatgatcacctcttttgctcttaattgcatcaataatatgtaaacacgcaaaagctcgtgacgcatcaggccgtttgatttctacatctagccaaatggtgatagataaataaatatggagaaattaaaggggaagtatatatagatatagaggacatatgcatctaaagttattctaaatgtaattaacgtatactcatcttgtagaacttttgataatggagtctagaactaactataaaccaggcacattatatatatttatatcatctaaagatgacatgcctcaaatttagatgaactttatggcttctaaagatataccatgatgcaatagaaatttattagttttgacgatgtatggaagcaatacttaaaaatgaccacacttgtttatttctggggtgagtattggacaaatatatatgtagcgatgtacaatgcattggtgtgtggaaaaatgtatgctactcgtttatagatttatgtgcttgtatttctggttttctacctgtgcttccttcttctgtatgtttcagaggaatga

SEQ ID NO: 8186 - DNA, 1501 bp, Oryza sativa
tagcggtcttgaagaaagccgctcattattgtcggtcggtttttccttgccgatgtgcgcgatttgcgaccgctgggtttctgccgcctgtagagaccggccccatctgtcaccaggtctaaggagtggcgtcacgcccgagcgcttccctcgaggggggcgatcgccctggcgtaacgccgggggctactgtcggtgacatgggaccgggggtatcttgactagaggtttggggcagctgcagtcacccatgtggcctgaccccctcggggggggtcgggcccgagagtgatgtggccgcccctccctctgtctccccgaggggtcgggccgctcccgtttcggccccgagggctggggcgccccgaccccctgtgggtttggcgccacgtgagtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcacgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcggcagacaaccgtgctcccacgatgcatctgcctccggtggagtggaggtaggtatgacccatctcatcggatggtcatttggaaagcagccatggcaaatcttcgcccattaatgagggagtaacaaggagatccccggtgtcaggcgagtgacggcgctgagcctcactcaaggacaagttgtgatttagcttccaggcgaaggtgcaagccaagttttggtcaagatagggtaggtccccacccagaagaaaagtaggtagaagtggtgcatgtggtatccccttgagatataaaaggaggaccttgcccaccaaaaaggggggagaaagaaaaaaaggaggctagaggggttctggagcctgaactctctggctctccggctctctgtaactccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtgtgtctttctaagccctcgttctctttcgtgtgcgccaagcttctcccgctcagcccca

SEQ ID NO: 8187 - DNA, 1501 bp, Oryza sativa
ttgtgcgccattgcctgttcggccatggggctgagcgggagaagcttggcgcacacgaaagagaacgagggcttagaaagacacacgcgccccctacctggcgcgccagatgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctcctttttttctttctcccccctttttggtgggcaaggtcctccttttatatctcaaggggataccacatgcaccacttctacctacttttcttctgggtggggacctaccctatcttgaccaaaacttggcttgcaccttcgcctggaagctaaatcacaacttgtccttgagtgaggctcagcgccgtcactcgcctgacaccggggatctccttgttactccctcattaatgggcgaagatttgccatggctgctttccaaatgaccatccgatgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgtgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccactcacgtggcgccaaacccacagggggtcggggcgccccagccctcggggccgaaacgggagcggcccgacccctcggggagacagagggaggggcggccacatcactctcgggcccgaccccccccgagggggtcaggccacatgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcggcagaaacccagcggtcgcaaatcgcgcacatcggcaaggaaaaaccgaccgacaataa

SEQ ID NO: 8188 - DNA, 1501 bp, Oryza sativa
cgttcatcgcttgtaagccaaaagcaatcatgtcctgcacgttcccacgttgctgatgaacttggcatgaaaaagcacggcattgttccgacctttggggctcggatttggggccctgcaagtaagagatggtgttatatccaagcatgggatccaatcggtggtgttatatccaagcgtacagagggttattatattggacggcgatgctttttagtcgaatctcttgttttaatcatttgcttgttgctttccaagttttgttcctactacgagtttatgcttaaagcattcatcctcaaaagctgatcttcttgtatggagtagctgtgtatataagctaatattaaactagactaactttaccataattgtcgggctagagagtaaatacatgccttgcatatgaaaaatagtcgcaacaactgtagtttgcatctgtttaaccttattatgctgttgtaatccgtatctgcacaaatcaaccgttttcagagcacttgctactatagttgcttcctggttgtcagatgtcgacttcgtttgaagcccgtatcgcgcttacaagtggagaaggaaacaaggagcccaattcccatcggggctcgggagccttgacctcgtttccgcctctcaaagttcggcctaccaaagaactggatatatcatctgccgatttttggccaatacgagcccaataggattgtctgaggccgagtttagttccaaattttttcttcaaacttctaatttttccatcacatcaaaactttcctacacacacaaacttttaacttttccgtcacatcgttctaatttcaaccaaaccttcaattttggcatgaactaaacacaccctgattcatgagctattcttcctaagttcagtagaaaattcctcgatatatcttttgagtctaaaattcgtccctaaatcgaaatatcaggtatagcacatcctttaacttatgataccgtgttaactttggtttctcagtagtatagtggttggttttggttgatgtggtgagcgggactcacgtttgccccacatgttagctgtcctctacctctcccacacgcaccgggaatggcatgtcgccagcaccgtcgtcaggacgtggccacggttgggtcattggaagtccaccgcccagaagttggcaacgtcggggcaactgcattgtctctctcttgctcgcatcacgcattccctgctgcgtcccgtacccaagccaagctccgatccatcacaatcaccagccgcagctacaaccacagtgaaacgcggatcgaaagttgtgaccgagtagggggcaggaggtgtcacttcatttgccttccaattcggtcgtcccatgcatcaattgcccccgtgcacgtgccgccccctttgtcgtctccgcccccacaagcaacctgtatagccacacgcgaaaatttcccccctcttgggtattgtggttgctatagttgttgcggtgagtgggaggaggaattg

SEQ ID NO: 8189 - DNA, 1501 bp, Oryza sativa
atggcgacgcgccctctgctccatcgatcccgacaacgcatccagaaggcgccggcgacacctcgccgccgatcgtccgccgcccctagtcgccgccatctctcgatcatccccctgtcccttcccttccacgcacggccggccattccatcgccgcctacctccagacccaatgcatcctctctctctctctctctctctctctctctctctgtctctgtgttaattttgtaatgtattagcaaccattcatggatggatggatgatgatgatcatggcctctgtcctctgtttttactcgtggctgcagactagtgctgtcttttctcttgtttgctgttctagaatctgtgtgctgttttctaaacaatttactgtttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgttgtgtagctaagctggtggccttgtgtgctccacatcactccaaaccctctgtcccaatcaccacattttttcctctccaaatctattaattaatgatccatttcaattcttcatcactgatttattcaccaattaattctctctttttttttcttccactacgctccaaaacttctctccctatatatacctctcccttgtacttgtccagttcttacactcgtctcactttactactcattccactattgtaaagtcatagaaaaaatttatatagagagaaaaaattagtgttgttattgttactggctttctgccagacgagacgagcgagcgcgcgagtgtgttgctctc

SEQ ID NO: 8190 - DNA, 1368 bp, Oryza sativa
tagtcgtcgccggacttgggccagaggcggcggagctcggagcggagggaggaaggggagaaggtgtagccctcggaccacatgagcttggagaagaaggaggagatgggcggcgagccgtagccgcagggctcgccggggccgcggacggcgcgcatcttctccgacgccggcagggagaacacgcgggcgacgcgctcctcgacgcgcgacagcagcgccgccggcacgccgtgcccgaccagaaggaacgcgccccactgctccgccgcccgcgccacccgcgccgccgcgtcgcccgccccgacgtccaccaccggcaccgcgtcctcgccgccgccgccgccgccgtccaccaccgggtggtcgtccagccccggccacgcgtgcgtctccggcacccgcctcgccgcccggaagtcgaagcagagcgggttcttcaagtgcgacggcgtcggcatcgcgacgacgacgacgatgaccagagagcaacacactcgcgcgctcgctcgtctcgtctggcagaaagccagtaacaataacaacactaattttttctctctatataaattttttctatgactttacaatagtggaatgagtagtaaagtgagacgagtgtaagaactggacaagtacaagggagaggtatatatagggagagaagttttggagcgtagtggaagaaaaaaaaagagagaattaattggtgaataaatcagtgatgaagaattgaaatggatcattaattaatagatttggagaggaaaaaatgtggtgattgggacagagggtttggagtgatgtggagcacacaaggccaccagcttagctacacaacacaaatctagctagtatgctcatcaccaccccctggctggctagtggcactgccacccaattaataacacacatattcatacaaattaagttatgttatagtaaagtaaaatcacaatgtgaaataagcaccagagtaatttttaattatcacattacataaaacagattaggtaattaaacataggaatttcacaggaacagtagcgtcctccgttgccgtggtgtttttttttaattcgtctgtctgctttagaaccaaacattctcacatgcagccacttctaattaattatgattaccgtataattctcatacacgtcgaatttcattcgatattttactttcagtagcaagatcttcatgctagttcccatatacagtactacatccgtttcaggttataagacgtcttgactttagtcaaaatcaaactgctttaagtttgactaattttatagaaaaagtagtaatatttttaactcaagacaaatttattatgaaaatatatttaattaactaatttag

SEQ ID NO: 8191 - DNA, 1501 bp, Oryza sativa
tgtttgttacttgttttcggttcttctatccttgtccactgacaacagccttctgctgcttgtgttgtgtaattaaactttacttttcttcttcttctattttacttttcttcttcttctattatattgatatgtaatcattttgcgcattagtgaaaaaagaaaaataatctatctattatattattaaaacagtcttgaaaggaggcaccacgttcgctgtggaagctagaaattctcacattaatcggagaaaaagaaaaggagagtccaagtagaaatacaattcaaaaatagctgaaattcggaattaaaaataagcgatattgaaagatgtgtccatataagaacccaatacaaaattaatcaaaattcgaaataaaaataaaataaaatccgaaattagaaaataaaataaaagttcaagtaggaatacaatttaaaattaactgaaattcggaattaaaaataaggaacattgagagaagagtacatataagaacccaatacgagattagttaatattcggaataaaaataaaaataaaatccgaaattagcaaaaagaaaataagagttcaagtaggaatacaatttaaaattaactgaaattcggaattaaaaataagcaatattaaaagaaggatccatataataacccaatacgagattaattaaaattcagaataaagaaataaaataatatccaaaattagaaaaactaaaagagagttcaagtaagaatacaattttgaaacaactaaaattcaaaaataaaaaataaaaatattaaaagaatgctatatggtattaaataatttttttaaaaaataaattctaaaataagaaaaataaaaaatatttcaattaggaatacaatttataaataactaaaattggtgataaaaataaagactattgaaaaaaaagaccatataaaacatacgatgagataaattaagtaacaagcctataaaagagtagagtggtggcggttgatacgacatataaaaactattagtaaaacaccaaatagaatcttaataatgattaaaaggagggatgataggcaggccatgaagcaaacgtgtaagatggttgccggacttctagaaagtgaaaaaaaaaccccattgataatcatattcgattttcaaaatctcaatgacaataaaaaagagaagcagcgggcatgatgtataggattatagttccagagccaccgatggttggcgggacttctagaaaataaaaaatgaattgaaacgatagttatgttcgaatttcagaatcccaataacaataaagagtaggcggcgaatgggtcgtagaggagtatagtggcatcatttgacgtcacttctaaaaattataattaaaaaatgaaacccaacaagacaataaattgtaaaaactacaaggtccaatttttaaaggttcggaacttctaaaaagtaaaaaaaaaaacccaatgataatcatgtataattttaaaatctcaa

SEQ ID NO: 8192 - DNA, 1501 bp, Oryza sativa
cgccaacgcaaacagccatgataagtataaactcgtcgaaaaagtagaaaagtaaaaaggatggtgatgcgctgaatttgtattcgtggagatagtttacaatgaccccgggtatacatatttatacctatgggtagatactagtccttgttggaaaagaaaaaaattttcctaaagattaaaggaaaacataaactccttatcggacactaaacacactttcctaaagataaaaggaaactaacagaatattcctaattaatagataaactgttatgccgcatcctccttgaactcggtcacttctggataaacttcctttagtagattaatttccttaaccgaatctactaagaatccgactattggtgacttaataattcccatcggtcgattctaggactctgaagccgatactgactttaggccgatgatgacttcggagcttaccaaatttcactgttaacaactaactaggacagtcatagggattagaaattcctcttggtagaaaaacatgtgatgaattttgcataatatttttttcattcttttttttgcatttttttctgtataaattgtacggataatgttgacccgaatgtacagcaaatggagtgcttttaatatagaagtgattaaatttctgaaaaacaatattctttttgatcgtcggtgaaatctgaaaattggtagaggaaccctagcgtatgctcattccacgaataaatcccattcctcgagatgttaatcttatctttgtgatttttttccaacacaaaaccgcatgattttagctttttcctgtcaattggattctacctgaaacgcttgtactttaaaactgaggcaattggttcattcgaatagttggcaaaatttgttgaaggggactattatgaagtgagaccaatcccctttacatgtgttgtgtaaagaaatatgtttcgtgcaaggttggcgattgcaaaaaagacaaaagactcatactcacacaaaccaacgttgttacgtcgtaacaatgtcaaagtacagaacttaactctagtggataagataagttctaccacaagaagcataaccacatctgtgtttcgtttttttttctatatatgactatgtttgcttcggggcttctaaatgatttgattttcaacatgctttttctttgacatgattatatacattgtccaaatttcactttgaactcctttcaaaaactgggtctatccaaaccagttggaggtatcccttgtgatgtggcaaccatgtgtggtctaaacccccccccccacccctctccccccacagtatgtgccagggaagcggctcgtgcgtgtttgtccgcatgcacatcgtgtcgcatgttggcctctccagttccattccgactggtttttggagagacgtgcaagagaatgacactagtagctgtagtagatctatattcattatgacaacattgtgcatgtcagcctggataatgattttgtgacagctt

SEQ ID NO: 8193 - DNA, 1490 bp, Oryza sativa
tccgtgatcaattttggatgaggagcaacggcgcgggcggatttggtggaggagactgtgttgcaacgcacgggcacggggagtgaggctggctggaggaggaagacggcactgtgccgagtggacccgaagcgtcagagagaagggaggtagagggttgcaaaggagacttttctttctctctaggccggacgagagagaggggcgcgggctgcgggctgaggaaggtagacaggagaggagtgagccggatttggcccgagggaaggaagaaagattttaattccttattaatttaaataaatgttgaaatgttgtttcacttattaaatatacttccaaagctcaaaaaattacgggaagaatatagaaaatacatgaacactcaaagtatttaagagaagttttatctagctcaacacttactttaattattaaaaaaatacctagaaatttctttttcacaacaatttataatttagcggtttttagggtctgacagttatccgcatcgtaacctctcactgacaagcaagacaaaaacaatgtgaatatatatttgtgaacaatatggtaactgatgtccagaaatatattttctatgtttatccattatcaaatctcaataatgtttataaattttaatattaaattctagtgctgatataatgtgataaattagtgatggggtgagaatgagtgacagctcattcaattctgttgcatagtggcatgcttataagtattgtatttctattggagtgtgtctatttacatgcgagtcccacctagttttgtcatgattatctcctccaacatgcaaatgaatcatcaaaattcattaacaccttgtacccatctgtcgataaatatatcctcaaattatctccttacttccacacaatcctccctctcctcacctctctcctaacagacgatccaccttcgttgtataagcccatgagttgatgaaatactaatggcatcttataaatctgttgatgaagaattggatccaccgccacagcaagtgaccaagagagagctccatcaaccaatcaattcagagagagttgttagacgagtgttgacaagtgctgttatacgcaatggataagatcggccacaagtgatgacgagtgtttttttttacggttaaacagcaggagaggctcctattgtgctatattaataaataataatatgtacataagtgagagaatacaagagagggagggagaaagaaaggggagtaaaaaagaaagagttctatctaatagaatgtatccatgatggccaacttggtttgattgtagcctttactttgtgcatatgccgagtaaattcctccttgaagtgttcatacttgcacttgtattttttccgtgtcactctcaacatgatggttactatcgtacatatagtcaaaaaggattctgacaggtctatgttgtttcatgtattgacggtgttctctctttgtgtttaga

SEQ ID NO: 8194 - DNA, 1501 bp, Oryza sativa
gccaccccaacacgccatagttggcgtcacgtcttcatttgcatgtgcaacgtacgttggcattaagctgtctacaagctgactcaaaatcatcatccaggttgacatgcacaacgttgccatagtgaatatagatctactactagtagtagtgttattctcctatatatacctctctccaaaaaaccagtcgaaattgaactagaaagaccgacacgatgtgcatgcaaacgaatgttcagcagccgctcccctagcacatactgtacgtggatgccacattataagggataccaccaactagtttggatagacccagtttttaaaaggagttcagggtgaaatttggactatgattaatgtgtagtgacgcacctcagactaccattgtgaaaagtcatatgtaatcctgtcaaagaaaatgcagatagaaacttcataggtacagtcatctggaggagttggtttgctggctagatgccctcgctttaaagcttttaaaatcaaatcacttagaagccccaaaacaaacagagacatatccctactattataaaaattgaagatgtttttaccagaattttaataagtcatccgtatttgaatcggttttatctatatatttacctattataaaactgaagatgattccgtactcataggtagtttcgtccatcctggtcatgctggttctgtccgattgagttcctattgatcattccttttttttccaacatgagcgttgaatctgcatcggcggcgagcaaactagagcccatatagcttccggtatttttttatccttttttcgctgtttctttatcacactttcgggttttttttctttcgtttttctcgcatctcgccctttttttatctcgtccgatccatctcacgtgcatcccgccaccgccgagacataccctcagcgctgatttttgaaagaaacggaaagaggtgatcgagtggatttgaggggaggattggctcaggcatacagtcacataactgccaccgccaagacaaaccttagcgccgccattcgattttgggaaaaacagaaagagcagatcgagtggattaatagcccttaaccaattttgggagatcaagaaagatttggatgaatttgaggggacaattttgggagatcaagaaagatttggctggatttgaggggaggattggctcatatgaccatcttccgaggttaaagacgactgtcgatgtgtgagcggggtttgtggcctcacttgtgggctaagctcgagaggagagagagagagggagagagaggggggtagtggactgggtggggctaaaaagaaagaaaagaatgggctttcagcccaaaaccaagaatgaatttttattaactttttcaattatgattatacagcggttctaatggttcaatttattggcaagcttccaatagttgttgtatccctgaaaaacggtttctccgttgctacgcacgggcatttttctagtatctata

SEQ ID NO: 8195 - DNA, 1501 bp, Oryza sativa
cattcacgtgacactaaacatcatgttacgtggtatgtgagagttgcagtatgtatgtgttgggctttttgttgtacaaaatatggtcacgatgaagatattacactcatactataaatggcttaatatatattgcaaactttacatcttcgtgagtcacggtttatggttgtcgccgccataacgccattgcaagtcccccttatcctctctttattttttcagcctgtgacatatatcagtacaatagatttggccttctatgatggattcactgtgacaaaaagggaatccatcgttgatctatgacgaattttcaagaaatcatcgtaaagttcaggctcggatgattctagtggcagcttgagtttgtggtcacaaaaaatgtcaccatggtcatctgaaacactacacaatttatcattagaaatttgggttggcatatggtcacaaagtattccgtcatagaacttggtaaccatggtcctcatgggtccatggtagatggttccatctgtaggtacaatattctatgacaaagtcatcacaagagtagggccagcacatggcggtgaagtattttggtcatagaactccagtaatagttgtcacgaagtcccacatgtaagtatcagaaaatataaaggaggagacaatttgtctagtattcacatgaactgtgtgcatttgcctagaatttgtttttccaaatcaatgtacatctgacactttgtccggtgactggatcctataacccggtgcggttatctcatatgaaaacgtgtcgatatgctcaagacttgggaagacgccattgatcaccatcgttctcgactgaaagcatgttcccaatggtttatttatctataaacaccacgatttagatggacaatggttcattcatccatccccgattccaggagcacgtgaggggagccttggagaacaacgaaggatgaaacgcagctgcgagtcgccatgaaaacaacaccacgagttgggccttatagaataagatcatacaaaaaccatagtggagaaggtacaagcttcacaagatgggcctttcggaccaatgggccaaaccatgcccatctacaccactactcacttgctttctttcatttagtaccataccatctatcaaaccagggtgtgaccaattaattagtttctactagcctctttgttgtattgacatttaaatatgtacaaattaaatagggccaagccatttatcaatatagatatatcaaatatatgctcatacattagactatatcattgctcctaggtagctacaattgttgcaaggtcactatagttaatttgtaaaaaatgaacaactctataggtacgaaagaggacaaatccatcaatcattatacattgtatggtatatcaaaattatcaaatacacggtcactagtgatactgtgagatatgagagctaattatcatgctagtgatttgatattatatctttgcaatatctccgcga

SEQ ID NO: 8196 - DNA, 1501 bp, Oryza sativa
ttaaattttcccatgtatcgtagtcatttctcgtctttgttctcatggtgtgaacttcggaaactagggaggatcatcaaataagaaacttaactaacgaagttctcacaaaaaaagaaagttcaccatttgtagtatttgttctttcgctgacataagatcttctgagcgaagttaacaacaatcagtttcctttacctgctctgcccttaataaactccaccggatcacgttagttataacaactaatacctgtttcaagtgttgggtgcatgaacacaaacataaaaatacaaacttgcaattcctaacatgaatttggtccagagtcgacgtaagattgggcatccaaaccccgcccaactgctatgatcgatttactacctgcacagttgcacttgactacattatcataaaatggccatgatcatctctgtttaattaattaattggatgtccaggatctccctctaatgcacactttgaagtctcaacagctagctagatatataacaacaggctcaaagtttttttcagttcaaaatgtgtaacaaaacttagggtctgttcactttgatgccattttcaaccataccattttattttggtaaagttacaaaacgtttagtttgttactaaatttagttaatacataagaaatcctaccaaaattttgacaatattaccatcttatcaaaattttgttattgctaaaatttggtaaggtttattttggctacaatctgaataggcccttatttccaattaatgatccttccgcttatgttttcacaaatttccaaagtttccaataagaatccgaaatcaatatgttttctagggaggcagagggcaatctttgcattcaaatttgttggattagaacatgatgttttggctggactaaaaaagaaaacttggcaagttcttgtacatgaatccctcgtgtgccaccagaaggtccaaatcttgttaatttacaagatcacaccagcatcgtcagaggttaacctacatattcttaatggggtatctgtcgggttcaaatgtagaaaaaaaaaacaaacaaccaagcagaaagaaatgtaaattcttcattgagacacaaatagcaagtgcgaatcagaaatataaatcttatatgttcaacacaataaataagcttgactgccaaccaaattcattaaaattaacaataacaattatatttgtttttgccttaagaagatactagaaagtaccaagaaaaatactagcatgatacccataagtatttctagtaaaaccaattcatgccaaccattccaaccatgtcagccacccaataaatattttggatggcattctgttgacacaatgacactgacttcggttgttgccattgtacgcatagcagatttgacccatgtttagtttaatcaagtacgtaccgtgtcacttagcgtgctacttaatcccactgaaaatccgctcacgaaacgtctccaattaatctctctca

SEQ ID NO: 8197 - DNA, 1501 bp, Oryza sativa
gggcattttaagaggtccacatgaaaaaaaaagagtttattttttcatgcggccccttaggggttcgcctacgaaatcaatttttacatgcgggcttcttaatgacccttatacgaaaaatgctcgctcgatttttgcagacatggccaggtccgtttgtaacctaccgagagtcacgtacacaaaaatcactttttttatgataggtttatatattttactctcttatttcacaaaagttacacctattacttttgttaccaagatcaaaaagaaattaacttattttacatgtaacaaagataaaggagtatatatatacatgaaaactatgagtattaagataacttcttggattctaacccaacattttaccttttcatttaaatctgagataaatagagactataaatagaaataacatatttgaaaaatctaaatatgtaataggtctccttcctccgttcaaaaatatatgcatttttagcatagtgacaaatcaaacgtttttgactttgacttttaatagtaaaaaaatcaattatgtaaaattgatgtcattagatttatcattcaacaagctatcataatatgcaactctttttattaaaaataaaatcttatttttgtaaatgttattagttaaattagcatatataaaatcgtgtaagaattaaaaatacttatattttagaatagagggagtaactgctagggaatatgaacgagggagtactttacatgcgtggctgcgtagcgtgtgcatcatgacgaccacgagctttagctgcaaccaaattaatttcgtaagcatattagtatatactccctccgttttttaatagatgatgccgttgactttttctcatatgtttgaccattcgtcttattcaaaaattttattcaaatatataagacataaatcacacttaaagtattatgagtaataaaacaacttataacaaaataaattataattatgtaaattttttgaataagacaaatggaaaaagtcaacggcgtcatctattaaaaacgggactagtattatacacatatccagcttatccgcgtagaaaagtacggctcacggagtcacgggccattatccgtacggcacattatatttctttacagtttcaagcagagcatgcatgcaatgcaaaagcacgagccagcgagattccgggaaagctcccctccccccgatccgctttgccgtccaatcgcacgtgctgatctccggcgccaccacctaccgccattcgccgccgtatatataacaccgccggcgagggacgcatgctcccacactataattacaaccgcgaccaacctcccccttcaactcagtcgatctctagctcgctcaagcagccagccatggcgccagtgcaagtcccagctgagctcatcggcagcagcaacggcggaggaagcgcgggggggtcactgaccgtggacccggcgctcggccggcggcaggcgactgcggcggcgg

SEQ ID NO: 8198 - DNA, 614 bp, Oryza sativa
ggcccggcacggcctgctacagtaacgggccgtgccggcacggcccgtttagccgtgccgtgcttgggccgctggccgagcacgcgggccggcacggcacggcccggctactgtagcgggccggcacggcacggcccggggcacggcccggcacggcacggcggcggcccgtcaggcgcggcaggcgggcggcggtccaatgggacggcgacacgtggcactaacggctatttgaccgttgaaatttgaaaataaccgttgggaggctaaaaattcataaaatttcaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcgaaaatcacaattagtttcgtagttccacagtttgatcgcagaggtttcaagagctccgcggttggaaagatgtaagtaatattcagatttgtgtatatatttgtattgtgggtgtgtaaaaacatcagtattcgacaattctgtttatgtcggtttaaattttcagaa

SEQ ID NO: 8199 - DNA, 522 bp, Oryza sativa
ccgcccacacgctcctgtcgtcgccggggaggggaggggagaggaagtgcaggagccgcggccgcccgtcgtcacccgcccgcccgccggatctgccgccacgcgctcctgtcgctgccggggaggggagagggaggggaggagctgcggccgcccgtcgtcgcccgccctcccgccggatctgccgccgcgcgctcttgtcgctgtcggggaggtgaggggaggggagagggacgggagaagccgcgggccacccgtcccgcctgcgcccgctgccgcctccccatgtctgccggccgccgccgagctcaccgccgtcccgcctgtgtagaaggaggcaaaagaaggtgagagagagagaggaaaatgagtggaggagaaggaaggtgagaagataagggagagagaggagagaaggggccggggggagagagagaaggaagttcaaattttttgaatgggatgggattaggaggcccacctgcgaaaatagggttattttcgcgtgcgggcctgttaagt

SEQ ID NO: 8200 - DNA, 337 bp, Oryza sativa
gtggaaagcaataacttatacaccaccacggacggctttgcccaacgtggcgagctgaaccccccaacccgacatgcatatattttttgaaatttcggaaacacaaaaactgatgtccgattcatacccagatggaggcaggcaaggcaggaacgaggaggtcgccgcgccgcccctccaaccctgctcgccgtcgccgcccgccgtgtgcggaagcagaggagccccgtccacaccgcgcctgcggaactcctcgccggcgacgccgcgccctagctccgcctccgcctccgcagattgggaacggagagagagaggagaggagagaggggggaga

SEQ ID NO: 8201 - DNA, 1501 bp, Oryza sativa
gcgcgagaccgcaggggcgcggccgcgcagggccgcgaggggcgagggggcgaggacggccgcgagatctgtatgccgctcctccgcccggctcgctctgactctctgtctctcactcttctctattctctaatctctattctgaattaggttaggacttagggtagatgctgagttgggttgggctggggaggtattatggacttgtagttgtacttgtatgggccttctgtaacttcggaaattccgagaaagttttcggaaaatttccaaccgattccgagttccgacggaaactgctattatcatattcgattccgtttccggcaaaatatttccgaattcgtttccgttttcgaaaaattccgaaaaaattccgaccgactgattccgttttcgaaaactggcccggaatccggaaaaattacgtactgttttcatccctaatctagatgccttaaccttcaaaatgtatttttataccaaaacttgttgtgagtgtcatatagatttaaatgggttttcacttgctctgtgcgctaacatgacatggtatggtgacgcttaggtgtcagcaggatcaacatgccaatcatagagaaaaagaagagattggagaaaagagaaaatatgttttttttattttttttctatgtgactaacatattggtgccaccaacacataggcatcactgtggtacagagtgggttagagcccgtttaaatatgtatggcacccaaataagaccagggacccaaaattgtatttttgagaattgaagaacctagataacatatctatataagtttgaggaccatcattctgtcagtacactttattttaaaaaaaaacatatacatcttcaatatttctagcagcttaaataaagtaataattaattggaacactcccaaaaaattagtgtagccctgatttttagttatactcttgactatattatttatttaagaaatatagtttattcaatcagtgatattcctacgaaatgttggataataacatatgcaggtcataaaacatggtaatgatcaacagatatggtggtcctattgatgtttaagaacaaaccatagaggaagtcaaaatcttcaacgatttactagttttctttataatctgatgtcaaggatatccgcgattgtatcaatatcaggacctaatcttcaaaattagttcaataaatatcgtcgaaacaactatatcgttatattcaaacaacacgcgttaatgccagggaagctccagagaatgccagggaattgggtatattatataaccaattcaaatttcgattaaaatcaatgaaacataaaccctagaacaaatcccagtaccactgaaacccctataaatatacatcccaacacaaccagcaaaccacaacacttgcaaacctctctcaagcagcttagctcctgcctcctccttctgtgatcacttcttgcaaaccaatcgagtcctcaacgaggtcaatgggca

SEQ ID NO: 8202 - DNA, 962 bp, Oryza sativa
gggggggggggttggtgcagcactgtagtagcaaatttttttctcaagctatattatagtaaattataatgttttcatgtattatcaccatcaatggttcaacataagtaacaatggagttaggttaataatatcgagtagaatacttccttttattttagtcatgaatatttagtgtctaggataatacattcagtcaaaattgtatgttttgaccataaaatttctgaaatacttaactaaaaaataaaataaatggtcgatttgtctggaaaattataatcatccttgagctttatcatgcctaatatgcttacttttttttgcatttctagtattaaccagagttttttttaaagaaattctccataaatgcacatctcatttttagtcatgcaacaatatttagataaaataaaagacagtaactatacatactatcctaccatggttacattgcatcacagcatgtatatatttttttctctccaacgacaactattatcacacaattcaaaacttatctttcaccggagttcttccaatgaatcaaattaacttgtaaagaattagaaaaggagaagaaaagatagaggagactgcaaactgcaatgtaactcatggacaaaaagaaaggacaaagacatgcgtgcatacagctgtactcataaataactgcagactgcaacataactcatgctgtgtttatgggccgctcgtgtgtctcctgtggtctggtttctgatgtagggggtacactaagctgggagaaggggggtgcccatacggtaagtaagggtgttaagcactaatttttcttttttagccgggtgcccaggaaccccgcaggctgtacttagcttcgagcctctcaagcactgatgcactcaccatctcaaattatcaatgcatcaaccgtacaacaatgaatccatgctattagaaagtttaggaagaaattg

SEQ ID NO: 8203 - DNA, 1501 bp, Oryza sativa
  unsure (1)..(1501): unsure at all n locations
aacccgattggcagcggagccaacacctttgatttatcgaaattaaatagaagcaatgagctcgagttcttgcaatgtgcaaattgctgcagggtgcaaacacaaatcgatggaaagtttatgcacttacgggaacatgtgagtcgcgggcgttgcgcttgggatcggtggcggagaagacggtgtacacgagcacgaaggtgccgatgatctcggcggcgaggccggtgccggtggagtagccggcggcgagctcgttggcgccgccgccgtacctgtcgtagagcgagctctggaaccccttgacgagcgcgacgccgcagatggcgccgaggcactgcgccgccatgtacaggagggcgcgcaccagggacaccttccgcgccaggaagaggccgagtgtcaccgccgggttgatgtgcccgccggagacgccggcggtgcagtagacgagnnnnnnnnnnnnnnnnnnnnacgcccacgcgatgccgaggacgcccacaccgccgcacgccgcgtcggcgccgttcacggcggcgtccgtctggtgcttgtacccgatcaccgtggccaccgtgacgtagaggaagagcagcgtggcgacgaactcggcgatcagcgcgcggtacagcgaccacttgcccagctcgtcgacgtcgacgagcggcgccggcggcgggtcgatgtagtcccgggcgccgccggcctcgagagtggacacgtccacctctttgcccattgacctcgttgaggactcgattggtttgcaagaagtgatcacagaaggaggaggcaggagctaagctgcttgagagaggtttgcaagtgttgtggtttgctggttgtgttgggatgtatatttataggggtttcagtggtactgggatttgttctagggtttatgtttcattgattttaatcgaaatttgaattggttatataatatacccaattccctggcattctctggagcttccctggcattaacgcgtgttgtttgaatataacgatatagttgtttcgacgatatttattgaactaattttgaagattaggtcctgatattgatacaatcgcggatatccttgacatcagattataaagaaaactagtaaatcgttgaagattttgacttcctctatggtttgttcttaaacatcaataggaccaccatatctgttgatcattaccatgttttatgacctgcatatgttattatccaacatttcgtaggaatatcactgattgaataaactatatttcttaaataaataatatagtcaagagtataactaaaaatcagggctacactaattttttgggagtgttccaattaattattactttatttaagctgctagaaatattgaagatgtatatgtttttttttaaaataaagtgtactgacagaatgatggtcctcaaacttatatagatatgttatctaggttcttcaattctcaaaaatacaattttgggtccctggtcttatttgggtgcc

SEQ ID NO: 8204 - DNA, 1501 bp, Oryza sativa
acttctaaattcctacatggactctagactattattttaatattccttattttttattttggattttcattatttctaattgtatttttatatgaattctaaactcatctttcaatattccttatttttaaatttggaattttagttatttataaattatatttctatatgaactctacacactttttctaatatttcatttaaaaaaaatcgaattttatttatttaaaactatatttctatatggattctaacctctatttttaattttcttatttttaattctgaatttcaattagctctaaatttattcatgtatagactctagtttccttttctaatattttttactttttaattttgaattttagctgtttttaaattctatcatatatgggctctatcttttccttttctccgattaaaatgagaatttctaagcagtgagagcgaaggtgatggctcctttttctattacatttataagttaacagatagatttggaaaagatataaatgtctggatgcaccaatatttcaggcaaatataaaattaatgcatcccaaatgaagcctcgtgccaacatttgatcatcagcacttagtgattggtttctgttcgcctgtactacgaggtaatacaatctgatcaccactccaatgcctacacgttcgcacgcccatcgaccggggattaaccgatgattaatcactgatcagcacgcagtcaggatgtcctaatcactcactgtcaccgatccagcacagtcatcagcatctaacaaaccgtgctgttaaggtaagaaattgacgtgcctttactttagctactcatcttgccccctcccgccgaatttcacggccacggcacgagcaaaatggagcacccacctgcctgcctaggacgagaaaaggtgtagctacagatgtgggcgatgtgggcagctaggttggcttgcttgcaaggcagccaaggtaagggggaagagcactactcgctcgccgaaagcaggctgatcatagtacaagccagtgaggtcatgtacatgtgcgcagcgtggtttgatttgctcgctttgccggtctgtcgagcggagtgtcgacctttgaatggagcacttgtcccttgctgctattccacaatcagctggacaagtgggactctccgagttgatacatataataaggtgctatttgatactactcatgaagatgaagattaagttgacgtgtgtaaaacgagaaaactattagcatataattatttaagttttaattattacaaacttgatacaaagtagtttgaaaaacgtgctaaccgaaaccgaggtaaaatctgtatagtaagtgatcaaataattttccttgggtcagctcgggctcgttagcgggttgcaacgtatcagtggtggagccagaaaattttcggagctcgaacaaatataaatatattataccttaagtatctgttactgtcgatgggagatacccgcaactatatt

SEQ ID NO: 8205 - DNA, 1501 bp, Oryza sativa
gtcggcgtcggcgtcggcgcggccgaccgcggagggagagtagacctgagggagaggagagagagggcagccgcacctcccctccgcctaatatgggaggggaggggagggagctggagggaaatgagagagagaggggggtgaggaaaatgaggggtggagaggataagatgctagaggaaaagataaggatagaacttagattttttttctgtaggcatgatttttgcaggcagactatgtcactaccaaaaaaaaatttgtggcagtctgtcgtatccttataagcatatataccaaatacttatatatgtccacaaggatacaaggcgagatgtaatgtcttaccctgacaactggagcttggacacctgcagtaatggttccatttatttttcaccagctatattgcttaatacatcggttggttcactgaccaacttattatcaccatgacgattccctatacctagcatgcaggtatatgtcctcttgtatgactctaaatactaagtagaccacactccccactaggtttgcgtgtcatcatttccctcagacatctcatcttgattagtttctgcgcacatcaaatagtaataatatatgagtatgttgtacatactcagcaagattagtacatatagctatatatatatgtttttaaaagaaaaataatattgcccgtagatattaacaactgagaaataataaaagacattacacagagtaaatgagttaaatatacactacaaaggtattaaaataatctcgttccttcaatccattttcctccccaactagtgataccctcatctgagaatcacgccgccaaattccctacttgtgtgaggcattcctcatctcacactgatatcagccgacccgatatcgttgtctcaaatatcggtcgtctcaggcttagtatcacaatcacattattattttcactgataaaatcatcgatctattattcggatgttaataatatttactgttagattgttagtatcaccatcttaatataatacaggtaaacaaatttagttagagatgattaagtaaaatagctaatgggcgcagtcttgccaggtctcctgctgttctacccgtgcgtcccacctagaagacttctactagctctaatgctctcaaatttctcacggacctcaccacagccagagcagaaaaaagtagtaagtactactgatggacaagtggtgtaggatcaagtacggcttaaatagagttgttttcttcagtctggggaggacatctgtccagaggcatgatgaggtctctctcttccttaccttggaagggtttgatcctatccatcaagactcagtgatatttatttatctgtcctcctctcgcaaaacaattcatgagtcacaatagaatgtatttaaggttacgcatcgagcgattccctgatgctgctgctgtcacaatagaatgtatttaagtttacgtatcgagcgattccctcctgctgctg

SEQ ID NO: 8206 - DNA, 1501 bp, Oryza sativa
ctttctatctgacacatatgtgcaaattaaattggctctacccattgcaacgcacggacatcttttctagttgaaaagtttgtgctgcctatcccatttatatatacatgtatatatttgagataaattttgctacataacatcgttaacttcacgttttaacataggaagccacaaaagtgaacctttagaagatcacatactcaaagttggatatttgctagtgtacactacaccaattaaaatatttacttttagttgaattggagagagaaatcgtgtgaaatgtcgaaaatacctttgagcccacatgtcatatctcccatccatcttctcttctctctatcccctccatccacatcagcaatgccggaggaccgccgccactgccctctcgtccccaatctcaatcgccttcactacctccctctagcaatcagcccatgtgagtccattctcatccaccagctgtccaatgaccgccgccacaaccctatcgtcgccatccttggctgccaaggccacctccctccccctgtcggcccgcgcaaatccccttcttgtgtagatcaccgctgtccgacgactaccaccacatcttcttgtccatcccttgccaactcctcgcctccctcccgcccatgtggacctcctccccgtccagattaacgccattgtggtccaggtagaggaagaaggagaggcggtgacacaacaatagcagtggcagctcggcctcgagggagttgtcggccgtctcaggagacgacgagtccctgcctcaccacacttttgtgttgatgtggacggaggggatgagagaaagataggagtgggaaagctgaaatgtgggcccgtgagtattcctgacatttcaaacgatttatttctcctattcaattagaaataaatattttaaagttatggtgtccatcaataaatatccaacctttgaaagtgtcgttctcccaattttacggtatagctaaaatcatgatgttacaatgtgatgtaacaaaatttgcctatatttgaataccaagttcagtttaaactactgactatttcgatgcattcctgatttatttgcacatatttcataactcagctcatcagcaggtcatcccttccacaaaaccgagctatgtcgccgtggatttatgttgtagctatggtgccagaacaaaacatttaatggagcattaagggagttgtacatactacatggttcacaggcacacacagctcatgggatttgctgtacaataatgttgacagctatagccaagatcactacaaagtttccaaaattaagaaaaccaaattaaaccatacaataagaccatcctcttgttcttctcacaaaacccttaaacccctataaatacctcccccatggcacccaagattccacaacacaaacacttgcaacccccaagcatttccgtttcttgctctcctccgtccgtcgagccaatcaggcaagcgagagcaaacgcaa

SEQ ID NO: 8207 - DNA, 851 bp, Oryza sativa
actaaagatttagtcccggttgttctcaacaaccgggagtaaacatctgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccacctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgacgacgacgcgccacgccgccgccttcgccgccgccgcatgccaacgccacgccgccgccgccgtcgccacgccgccgccgccttcgccgccgcgcgcgcaatgccgccgccgccacgccacgccgccgccgccacgccacgccacgccgccgccgccacggccccgcaacgccacgccgccgccgccgtcgccacgctgccgccgccgccgccacgccgccgcgccaaccgccgccccgatgccgccacaccgccgttaacgaacgagaacgatcgaacgaacgagagcgagaacgaacacgtcaacgtacattgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaacgaacgaggacgaacgttaacgtgaaatgcaa

SEQ ID NO: 8208 - DNA, 1501 bp, Oryza sativa
agtacggatatatctaattaaagaaagagcatttgtttcactcaggaccctgcttagatacccttattgcatactgaccctctttacacgtagtatattccaaaacgctctcttcgtcaaaaaataaaaatcaaatcctagctttcatagttaggactgtctctctctctctctctctctctctctcttttaatgagaagtgtatatggtgctagtagctactggacaaatagagttacataatactactagggtgtaaaaaagagcttgaggctcacggcagcttgagctccaaacaagccagaatacatataaatttttatttaattaattagtggatgaaatatgtcatttatatgtatccacatgataaattaacatgtgttgacatcatcctttgttttagcatgttattcttgttcttctcttttgtcaatgagattatccagtttttgcaagagatgtccttatccttgttcttgtgttacactgattacaacttacaaggccagctcaataatcaagctcgagccgaacacgcgtgaaagctcagaggttacgcatgctccgtttgagattgctcgagtttttgttgagctcgagccaacagtgaagctcgcttgagatcggcttgttcaaagtatataattaatattttcaaaaacccttttactaaggtactatacaatcctcagttttaaatatagttacattttctatgaatataaacacaactacatttagcgacagaagaagaacgaagagatttgttaaaactggggcggagctagaataaaataaaggagggttccactcgtttgttttactctggtttgaatcaaatttagcttgatacggatgcctaaatttatactgatggggtgtatatatggtgaaaatagataaattataggtaaaaaaatttttaatgggttcctgggcaccccctagctgtactagctcgcccagtgagtctgttgcgtaatagtaataattgattaatggtgacacgagaaggaccgaattgcaattcaattctcctttaaacaaaaaaaaaaagagaaagaaaagaagaggcgaaaagaaaagaaaactcgtgaaaggaaaattttagtcgtcagtcgtcacctcgccggaagggtacaaacgaaaccgcgcgagagcgagacaggaaaaccgaggcataggcataggcatggccagccagccgcgtcgacgtatacgcggaaggaagcatcgtctcgtcaagctcccctccgcgcgcgcgagcgacgaccggtcagtccgtctccttccttccccactcttgcctccccattttggacttgtgctctccctcgcccctgctcctacgctgatgcagtcagtcatcactggtagtcgccgcacaacaaccgagtgatccatccatccatccatccatccatccatccatctatccttcctcctcctatatatgggcgagccaaccacagtgcctcccaatcaccaactgcccagc

SEQ ID NO: 8209 - DNA, 1497 bp, Oryza sativa
tacatcttgatctttacattgattgtggatgacatgtttattacttcctttattttataataaaatcatttttagcccattttattactagtttctagcgatccttatatatcagaatttgtgaaagtaaaagataaatatattgggaatagataaatagaggaataattgcattggaatttgataaagtgggggttaatctttttagttttgtatcagtatttttcatctcctgttcactgatgatagtctccctttagtccaatcgcagcgatcggcagctattgggaaacctaaacccagaattttgaggaaaagtatcttacgctgctagtcctagaaggaagaatgatcaagggaaaattcaaaagcataaaagaaagattcagcaagagagtcaattactgatcagtgcctcagagaaatatctgtcaaatggggagaggttcttgttaagttggttttgcatagcctccccaccccacctatgctatgatcatgttcaaattctcgtatttgtgatgatcttaagcaaatgttaaggaatttctgatgggataatgaatttgaaagaagaaagttcattggcttgcatatgacaaaggctttatatcaaaattgggaggagaaattgggtttagaggtcttgagatattcgaccaagcattaccggtcattagtatttgtcatgctttataaaataattttggaatggcaccgaattaccctctccacctcggtgtattcctaggcatcatatttatatttccaagaaacacaacgctagtatgaaatgttttcttttttaccttaagatcggataaaagttattgatattaatttatagttgacatacactagcccaacctatctagtttaggagttagttcggaggtgattatggggtgacgtatattttagcacgaggatatctcggcacaaaactattttttttacaagtttctttaagaaattccaaatccatttttgttttcaaaactatagaatccgcataagtttgtgaaatcatgaagcgataagctatcaaaattaaacaatatacaaaccgggctcccttaaaatgcaaaccgcggaggccgaaacagctactcctgatcaactgcgacgaggtgcaacgttaattgttacttttccactctggcccctccacttcccatcaattcccgcttttaatccgaacgagaagaaggggggggggtgggtcgcgctcgccgaaaacaaagcgccaccgccgcaccacaaggaggaaaaaaaaaagaaaggaaaaaggaaaaaaaaatccccaatccaaaacacactccgcccctccgatccccccctctctcaaaccctagctccccccctccccaccaccaatcccccacgcgattcgccggatgcgcccgcccgacgcggcctaggcccctgcggttcaccggcggtggtggggtgagagagcgcgcgccggcgaccggcgaagaggagggggggggtcga

SEQ ID NO: 8210 - DNA, 1501 bp, Oryza sativa; identical to SEQ ID NO: 8000

SEQ ID NO: 8211 - DNA, 911 bp, Oryza sativa
ttagaaaagcaatgtgcactattaataatatataaatatgaaaaggcacaatcctatacataagattcatagataacataatcctatatataagattcaaagataacatacaatatacatagtcatcagtcatgcacaaatccatccagaaaagatttcttacatagaaacagatcattgctcgaatccagagggtagcctagcctgcttccatttagtgacatgtacaggttgttttaattagacaaattctgggcctgccacagtattccaatcaaggttctaaaaggatgataagtgtggacgcatcggattttctccccaacaaatttctcagttcccatttgtacaaataaaatatcaaaatattcgcacaggttgtatttatattgcaggacgtagcatacactagacatatttgaggtgtcccttgctctaagcttctaacaattgacatagagtaaattgctacaaatttatgaagataaattagaccaatatatagtgctcccactgtcccacaatggaagtcatcctaggaagcatgcaaacaattaatacttgcaaatcatatcaattgactatgagaaaactagtattatttattttttcaggcaacatacattagttattcattatattttatttttatattattattattagaatcaatactcaaagtcttgcttttgagactgtaaaggcacaaacaacttacatttttgggtgtatggagtatttgagtattagtcgattaaattacaagtttagacgctacaactttttggaccattatgtgcttgggaaaagtaactcaaatcttaattttataatcaacatatgaagttataaatgatgaggcaaactatcctatatcgcttggcccctaactaatataataccaagcacaa

SEQ ID NO: 8212 - DNA, 1157 bp, Oryza sativa
gatggaagatatgatatgtgggcccaagggcctttagaacttttatatgatttctctctcctcttcaaccgaaaattattattttaatcgacacggtctccactggcaaattaccatgtttatggagtgttttcccttaaaaataagtttgggcaatatcctagggctaaaaccacacaatagcagtgtcctgtagcaaaatttgccaaattttattggtcatgtgatataaccagcctacaattttcatggagtaaaatgtttactcacactgtaatattgtattcatgctgtggaggctaatttggaaaaagaaaaatactcttctcatgtcatcgtccaataaaacatttactatgcgctaataagcgttcgtgaaaaaaatactaatagatcgatacatagcattaaaaataaaaagaacacttggtagtactacgacaaataaggcaccgagctactgaaaataacttaaaaaaataaagatattattacaggtgactaggtaataaaaatattactaatagtagaagggtttatttaactaaatagtaaaatcattactaatattaaggaactaatcaaatgatatatttgcaagtaactgattttctgacagagcctccaacgtaactaaaatccaataattcatttactaaatgaaggttggttgggtgcagaagtaatctgttaataatttttttatcaatggttatgtgagcgaagcaaaacaacacgaaagtaaactgttaatatatttgttttatcaatggttatgtgagggaagcaagacaacacgagtgcacgagaaaaaaaaaaaagagggaacggaaggagcacggacggttgaagaaaaaaaaggaaaaacttgggggtgggatggggtggggggaggaggttacatgaggggagcggttaagttatatatataattgttacatgacaccctgcatgtcacctagttaagtagcatctatagtccagcgtgctactgtagtaacttttttttttactgctatacgagcactatccattttccgtaaatgctgattggattgggaacctaaacttgtgaacagagccttggtgtgagtgtttataccgtccataagcattcgtctgaccgtatcccaccattcctctcttccttactcagt

SEQ ID NO: 8213 - DNA, 1501 bp, Oryza sativa
caagagaacagttaatatgtctatcccgttgcaacgagatcccgttttgtagcagttctcggatgaaaaatagtatatcgactaatatactgaatactaaaaaatccttacataccggatacttaaaaaaacagtacatactcctttaacgatgaatttagtatatacggctatagatgatatttagtatatactggatgaaaaatagtatatcgactaatataccgaatactaaaaaaatccttacataccggatgcttaaaaaaccaaaccagtacatactccttcaacgatggatttagtatatatggctagagatgagatttagtatatatatatatataccggatgaaaaatagtatatcgactaatatactgaatactaaaaaatccttacctatcggatacttaaaaaacagtacatactccttcaacgatggatttagtatatacggctagagatgagatttagtatatatataccggatgaaaaatagtatatcgactaatatactgaatactaaaaaatccttacctatcggatacttaaaaaacagtacatactccttcaactatggatttagtatatacaattagagaaaaggcagtaaatacccgtgtaaaaaaaaggagagataccattcttaagaaatagtatatacttctacaagataaagaagcatataccattccctagcaaaggacgtgatattcaaaaagtaagtacatactagtactagtactactttctgaagaagaaaaataagtatatggtataatcattttgaaccagagaagcgtgcgctccaccgcctccacgtgtttagatcgatcagttacgtgcatttaaaatttgaaacacatgcactccgtcagatgtgtactaaaacaaaactaaaacaaaaaacaaggaaaatacattctttaaaaaaatctgactcaccgtggccctatcagatgctaatggataatcggggggagtatatacacctctatatactctctctctctctctcttctctctctatatatatatacatacacatacatactaaactcacatagacttaggttgtgtaatagctaaaatgctccccctcacacccacccccatacaccccaccccccctcccgtgcacccatccccccgcatcccctcctcccacgcttaacggagtaaattttttactatcaactctatctgctaactatggccatgtttggtttcggagggctattaaatagcgctccggaatcttgctatttaagagtattaaacataattactgataaaacctattccataacttctaggctattttatgagacgaatctaacgaggtatattaatccatgatttgctacagtgattctatagtaatcagccgttaattatggattagttaatagcccggagccgctaattatggattagttaatagccggagtatccaaacaggcctatatttactccctccctctccctcgtagaaaccgttca

SEQ ID NO: 8214 - DNA, 771 bp, Oryza sativa
ggtccatcttttattccgctgaggacgcagaaatcaagtgggtgcgtacctctcgtcaccgtcaggtattgtagatcgtatctgtcccgcaccttgtgctcaagtgtatccgcttccttgctgcgaccatgtcggcgagaaggtgctgcagagaggcgtgagtcgtgacacagggcacaacagggtattttgcgcatttcaccatcgtacagtaaaaatattagaaaaagacaatcacaaataaaaagacaatggaaaaaaatctactgatatgagcccagccccttgcacaggctaattacataattgctgttagttcctttaactaactagagtgcatcgccactggaaaagcatctgaatcagaccgcctacctacagttcagttcatgcatttcaggccagattaaggacggcgaacaagacagcattcctgtggcgccatcaccactggcatccattaggacctcgatcacttaactgtatgcaatatatcctcctgttccttttcccagcttcctgaacataataaagtgaattcacgaatcaaaagaaaattcagatgggagcaaagaagggggtgctgattgcatcgtgaaaacaacactatcaatagacctgatcatgcaaccatggttttgatcactgcgaaaaccatgggcgtgaaagaagtgtagaaaagaaagaagaacaggagaaagggagcagaacatatcgaagctggaggtgatgctgggcgaatggaatcgctcatggtgttgtttgtctaga

SEQ ID NO: 8215 - DNA, 1404 bp, Oryza sativa
acattgccaccgcctccatccttgtcctcctgccgctgccgtcgtcgttctcctgccgccgccgtcaacattgtcctcctcatatcgccgccatcgtcgtcgttgtcctcatcctccagccaccaccattgatgttgtcctcctcccgtcgtcatcctccagtcgccgccactgtcatcctcatcctcacagccgctgcagctgtcctcccttagccgccactgtcctcctcctcctcctcctcccatcatcaccgctggatcagggcaggggaggacggcgaccattggattggggcgggggagggcagccgccactggattagggcgggggagggccgccgtcgccgtattcgccctccacgcggatcaacttaataggtccacatgtgaaaatctattgcttcttgatccaccataagaggtccacctgtaaaaataaactcattttcgcagcggcctaagtgtcccatttgcgaaagtcgattttttacaggacctcttaaggagccgtatgcgaaaatggaggtcgatttttgtagaagcccgcacttacggacggcatgcaacataaggggtctcgtatagaaaaattgttttttaagtaatggattcagagatttgctccatgccattggaattgttaactccatctaaaaagggactgttagcttgttattaaatcctcaattgtttcttgaactgaaacatttactactattattaggcaaaataattccaaacggtcttacacaacgagacatgtaaagatgtaatgtagaagattatgaaaatggtaactcctgggcaggaaagtggagattaataaatattcaaatagaaagcccaagtcatttagatatgcatgaaaggttgtatgataattggtcatttggtctctcactcgaaagtgggaggtcttaagttcaattcccttttgtcatagttggggcaggcatctatcgttcttgaacattagatatttaaaactatttgatatttaacatattgttctaaaccattagttgagacaatttgtgctgctgaaatgcaagggagacagttggcggtatcatggagatgctgagggtagcgaggcatgcatgcctgcttgccgtttgtatcggtggaggtttaggccctgcttagttcccaaaacaaaagttttcacactgtcacatcgaatatttgacacatgcatagagtattaaatgtatgaaaaaaaccaattacgatacagattgcgtgcaaattgtgagacgaatcttttaagcctaattgcgccatgatttgacaatgttgtgctacaggaaacatttgctaatgatggattaattagacttaataaattcgtctcgcagtttcctgacggaatctgtaatctgttttattattagacaactat

SEQ ID NO: 8216 - DNA, 1263 bp, Oryza sativa
atgttgggccctgtggttgtttagaaatgatagggattttgacaaatcatcatctgtttcctatatgcaggtaattttcagggcaacatattagcttcggctgtgggctcaactacaaaagtgtgaggaaaatagagttttcctgaatgttgcatgtcgtactcttgagtcaactgttatgcaactttttgccaaccatggatagagattttctactaggctggaataacgttttccttgtcatgttaggtctttcttttaattttggttggtttgatagttttatcttgaattaagattttataagtctattacttttttaataattggctgtatctcttcggagtaaaggccgagatgtttcattccattatctaaaaaaagtaatgggggcaaaatgaaaattccacttttggttgccggtgattcatcgcacaaacagctaattaatggcaagatcgacagggatatactctttgtatattggctaatcttaccaggtgaaaagagaatttgatcactggagcaagaagagccacgccatctgctgcataatggtcctccgattgaaaagcaaacaaaaatagtaaacactactataaaaaacatttttcccgacgtggggtcttattttcgtaggcggacatgacccttagagccaaataaccgtctataaaaatataaatcagggtgaattttgatgtccgcctgcgaaaatagacttgaatataaatagacttgcgggcgctaattttttttctaagtctcacacctttcctccctccacacctctcctcttctcccctcccctcacctctcctcatcggcctctcccgtcccctcacctctactctccccggccaccaaccgaaggcggcggcggctcccgggggtggcggcgtgtgctcccgacggcgacggcgggcggtggcggtggcggcggagggccgcagcggcaaggaggcgaggcggcgcgtgacaagggggtttgaggcggcggcggcggctcccagcccccccctcccagatctggctggaggggagcgggggaagcacggctaccggcggctcccggcccgtccctcccagatctggctggaagggggaggggggagcgcggcggtggcggcaggcggtggggacggagtgtggcattggcgaggaggcgaggcagcgcggctcccgacaacggtggcggcagctcctggcccctccctcccatatctggccagaggggggcggggggagcgcggcgacagtggc

SEQ ID NO: 8217 - DNA, 1501 bp, Oryza sativa
cagataatggatattaaacccggcctctacatctgatacgatgtagatgaacaggaagaatactagcatgaactagaactcattgtagatgaggctcgaagggatggcccgtcacaggtaagaactcatatgtgacgggcctataagaggacccgacacaaacatctcttacggggtcacttatagacccataatagatgtcgtcctcatgaatctaaacacttttattcaggttgggagagagacattaaacaaatcacaacaaaaatatctttaccagaatgtaagaaccaaaatatctacatttcatggaatcttaaaaaacgattcctttcaaatatattttattctcgtaaaaaaattcaaattatttttcttccaggcatagttaaattaaatgttttgccaacgttaggttttctttcctgtttggtcggactatagctccagctcttttgaacccaaccaaacggttttagttctatcaaaatgggtgtggagcggacttgagtcattaaaaaagctagaagggtaaagcaactccactctaaactattttccaggggttaaatttaggggttaaagtcttaccaaacaaaccctttatattgaactctgctacactgcaaaaaaacaagtcattctcctccttccctctattaatgtacttctccacataaatcgaatcacccgacctaaaaaacacatcctgccgaaaccagtcctttcaagacctatcagaaaaagcggataaaaaaggaacccggccgatgaaaactcttcgttcttattacttcggatcccattagaatgcacggccatggcactagcgtaacaaaaagaattaccttgctaggatcgtccattaagagttgtcaattattattacagttaaaacatacattctagcaactaactttggcaccaactaaatgaaatttctacatagtggacaagctataccaaaattagacctgcaccaaactaatttatacataatgcaaatttcagagcacaatgaattttctcgatttatatatataattaattaagggacataattagtagttgccaaattaaaaaaaaataatagtacccttccatttaaccatatctttgcggtgcgctcgctggtccagcataattaaggttgtgttgctttcccagctcagattcctcgtttatcacgtgcacgcttcccgagctattaaacggtacttttcttttacaaaaaatttctatacaaaattaagttgctttagaaaaatcttattgatccgttttatgtgtttggggagagagtttcccaacttccactcacgattcgttttatgcgactcacgaacacagcagcctaaaactataaatagacgtcgcctgggagcatcttgatgtagatcgactcaaatagtttcgggctctcacctcccttgaacagttgttggaagtgtaagactgacatggccaacgatccaaagctagcatttatggataatcatta

SEQ ID NO: 8218 - DNA, 708 bp, Oryza sativa
ttttttcatattgcacataatatatacatatgtccaaaagctttcaaatcccttgttttaatagatttcttatagtagctaggaagtatttgatgccttgtcttttgcaagatttctttctctgaagctatgctggactaagacaacagaaactataaattgccgtgagaagctcttttaatgatctatgcaaaattgtaaacaaattgctcataactacaagttgcaccgctgagttcatctttatgtttggttaatgtctagttaaacctgattcatctttatgtctagtttcttcactgctgaattcactgattctttccttgttttcatcctgtttcggtgcctacagaaaccataattttgcctgtatggctagtttcttcatatctcaatgtagttacaagtgctccctattttgtctttccttgtactattttcctagatatcgtgttcaaagagagaggattgtttgctttctcatttattagggagcaaatgttttgaacagcattactattatgcttcattactgaagttaatgcatgtaatgttattggttctctgccagcttcaaggaaagagacttgctgttgatctttcgttggatcaagatacactcttctttgggaatctttgcaaaggtaaacttaacccatgatggactttttgtatcacaatgtagaaaatttgttacaaaaaacatga

SEQ ID NO: 8219 - DNA, 1501 bp, Oryza sativa
tcccaaaaagagctacatctaggcaaatatttatcaaattcgtaactagaaataaagtcttcatgagacgaagatagtatttctcttgttaaagtcaatatttgtgaagcgatgttagagttgtcgaagaaattatgagtaaataggagttaaaagaacccgtggccttacaaaaataaataggaggtatggtagaaaacagagagtcaaacagaacaagagaataaaagggagtacagatttgctagtcattaaaacagcaaattctaccaacaaaactggatctgaaattaactatgcattggacaaacaatgaacaatccctatcttaaatcccctcaccaaatatccacaggtattacaatagtcaaacattccctctctcacacatttccctttctcatgcagttgatttgtggggtagcatgcaacatagtgggcatatatccctttctccagacatgagaaaagtaaaaaagagaagaaaaaaaaacacaaggccagttaaagtgcttaatcaccactttcttgttcctaattaactggcaactttatagtagttgccatgtttctcccaaacaaaccatcattgttcatctgctcatctttgcatcaacaacatcattgcaaacagtgctgctaaacccatgcattatccataaacaaatcaaagcattcaaaatgcagcacaaatatacggataaatgagagagagagagacacacacacaaggcggctagggattttaaatatgaacggctagtacaaacttgtactcctctagcgccataataaaatcacatgaacatttttcccgcctaaaacccggacaccatgttcctatacttgcatgcacatcaattccctctgatgtactttctccaaaaacaaatattctttgaccaatgcacacatcaatagtatattctcctatccaaatctttttcaaaacatattttaaatttctcccaaatttctaaaaaaagttacatcaaaacaacaactaaaaaacccccaaaaattaacacgtcaaaatagcctgatcattgctggatcagttgcacctgttcagcttatgtagaggtagttgcattgcacttaaccagagcacatcaacaacctttttggctatctttagaaggtgattagggagagcaattaagccataacccataattacactacactcctccctaatcttttattggctaatctaatccagcccaatccctagctcaataccagcacaagaattaaagcaaaaggaaggacaaattttgccaacaacaaaaaaaaagtaaaaaaaaaacatatatatttttctgccaattaaaggaagcagaagcagctaagcttagctatctttaggaggagctcgagcttacatttccattgctttggaagaagaagaggaggaggtggtggtggtggtggaggaggaggaaacagaggaggcaatcccctgtttcttgctcctcccctgtgttcccggcggcggcga

SEQ ID NO: 8220 - DNA, 1501 bp, Oryza sativa
aaaagttgttatattttgggatggttgagtataaaatttcagcgatttcgggtttggtttaaaacgcaccaccaggacgtgtcaaaataactgtcaaggtaagcatgtggctgtgtaccacacggtttaacggctagtggaccattgttaacagcgaaatctggcgagatatatatatactcggatttggagttagatattgaagaaggagattgaatcttgtccatgttttcggtcaacaaccatgtatttcgactaaatataatggtgagggggatattttttaaccgtgcccctaaaactcgctcctgtcaccgagtgctactaaggcattacaaactactaagctaaaccgccattcgcaaaattacataataacgtaatgtcgttttgatcaactcagattcttcagatgacaataaagtaacacatgatattcactaacaaggtttagttgtaacctacacttctagggttttgattacaagcactcctttctaatcaacattacaccagccgctagcgactacagttccatagccacaccgccatgctccccttgtatgcatgtgtcgtattaattgttatcaccatggttacatttatcccttagagtttgtcagttataagcctattgtttaactctcccatgccgctgttaccacatcaattactattaaaatatattcaacgcctattctaacaacgtatatacttgcgatttgtgactatcttgatcggggagttttatactcatattcaaattagaggatatgaaaactaaactttttcctaacacacaaaagtttttgtgtgtcggaatatgtattagacggtagcaagataaaaatatgacgtgcaaactatatatgtgcaggttaaactacaaaatggaaatccaagtgattttaacctctcacaatctttctaatctaatactaagaacttggttcttacctacttcgaaaataagttactgccacccaatagtagtttttaccccatttcaatggccatcccacctgctaatctttcatagataacaaaaaccaatgagaagatatatatagttttctttttcctaaatatgaatattaaattagactatataaaaagaataccatatcaaatcaaatgggtgaacattaaatctgattcttccaaagtataactcacaatctttagcagtaatcagttacaattgaaaagaagaaattcaagataagatctacagaaattaaaccccatgataataaaaaaaatccccacaattccactcccccttccaatcggacggacaccattgcccagcatcaccaccgccttatgatccaacggccgagaaaattcacagccgatggagagaaaataataataataaaaaaactagccgttgctgctccctcctccgctggcgccgccattttttacgttactcttcttctcctctataaattttggttcgattcgtctcggcgaatttcgaatcgaattttcactc

SEQ ID NO: 8221 - DNA, 1501 bp, Oryza sativa
gtgaaacattaaccgtgacaaccacaagccagcgtgggcaatggctttaccttttgtatagcatggttcattgtggggcaccagactaagaagtggcagagataaacccacgggggttgttgggggagtcgctagggagtccatgccttgttttctaagggggtgattatgacacaggaacggtccactgctgtgaattgtgttatgcacttatgcgaggggtactgccatagctcctttctgtggtaccgtggtggtattcaggcgcatggtgacattttgtgggactgtgtcttgtgggtacagtggtacatcgggccagagtaaaactattcgaatagctgtgctcgcggttatggggggtctaacaatgtttttcgtgattagtctcacacctctcacaataattattgatgttataactggtaataatttgcttagctcctggtttggaatggtatattcctggtttggggatagatctgtacagccgggtgtggttgttcaggatgggagagcctatgcaacgggtatgttgtatagcttgaattaatactgctgaattaaatactttactgctttctaaattttgaaatgtttgttaaataccgtttatgcaaatgagactatattatgccatcctttgttatcccttgcacttgcatatttgctgcgctgctggttgagtatgtcatatactcaccttgcaatcagacgacgagttctacagtgatgctgaaggtgtggaggattaggtgtagccctggtcaagctgcttgtgggatgtcgtcgtctacgctatttattttatttttccgctgcttagatctttaatgattgagagggactatctacctctgtaatgactttatattcgcctattaattagataaatatttgcactctattatcaatttgttattgtgtgcctcggctgattgctggacgagggtttacacacatgtaagagtttggagttttggatagaaattccgggcgtgacaagttggtatcagagcctccttgatcctaggttatgccaaatggttaccgttagaagccctctaaaaatatttaaaaattagaacttttctcctctttcttctctaattaaaccagattaatggcacatgcaatttatagtttctttaatttgctccttgttcaaaatttatttattattcctatgttgttagtactgtacatcgattactatactaatgactcaattactagaaaaattttacaatatttcttgtataatgatgtcacagtataatgaacttagcatttttatgactctcttttattttgtcttaaaatttgttattcaacgtattaaaaaaaatctggttttcgactgttgcagcttaactcttaagtagtttattttatctatttattttttcactctggttttcttgctttattcaaattaatccaaaacttgtgctgttaattggataaatgccttaactctctcctttcacatgtctttaga

SEQ ID NO: 8222 - DNA, 1501 bp, Oryza sativa
aacaaaacaaacctagagaaggcaggcacacaaagaagagttgcaccaggtggaagtccagcctaaaactcaaaaggaaatgtacaatcaacgaatcctgccataggatatgtccgtaatgaaattcatctccaaaacatgtaacacatgtatatattacacatcacatgatcttgaattttggaaggcattccaagtttcatagacatgtttacgaggagtgtcatgagaatacagtagatagtgtgctttctctgaattagtgttcgtgttaaattgaatctggttgccatgttcttggatctctttacaaacttaccagggactacaaggtcataaagttcggggtcagcaggatattgaacgagtttcgttttttcaaatttgtcatgtttcctggttacaactgaatgtgaacaaaatagtgataaccttgcacaaaggatgaccgcatgattaattcccactattcactatgagtgttaggacaaggaatttgggtttcgaaaatatttatggaccacacagcgttatctaaacctcaaaaaatcgatttgaaactcgccacgactgttcagatacaaaatagacatcttttagtaatgatactagcattcagtgtgaagtaacaatacgcacttgtattcattttaaacatttgcatcacgaatagcaaatcataggtgaaagcttttcaacagaacgggctattggcatcagctctcaaccattgccccaaataacaaccagctccattctccaaattgaccgccagttctaaagccaaaataaaatgtaatgtaggagaagatgggagggggtgctgacccgaattccttgcgcttgggtggcaaggttttgacaatatcgacggccttccagaagtcggcgttgctggaccagtcgaggttagccacctgcttgtacgcctcctccctcagcttcgccgccctcaccgcttcgtcggtggaggcaacggcgggagggccgccctctccggaggcggaggaggagaggaggcggctccggaggcgcgcgagggggatgcggcggagaggcctcagcgccgccggaagcatcgccgccgcgcgaggtggtggtggtggtggggcggagcagggatgccggcggcggatcagaattttgggcttttgggcttctgggacccaaaaagccagctcggctcggctcggctcggcttgttaggataacgagctggctcggctctcctcggctcggtgagaggggatgagaacacgaagcggctcgggaggaaaacgataagagaatggaatcgatcgattcgatctagggttcagacaagtacgggactaatctaatgagcttttttgcctttattttcgtgatgggcttagctacttcactaggtcacttgggctcgttggctacgttagctccttgggcttacctacatcggaataagttcacctgccatacctcaactttacaacgagtttgtttgacatcccttatacttaat

SEQ ID NO: 8223 - DNA, 1501 bp, Oryza sativa
aaaaccggcggcacatataagattgcaaacatcatatatagatacaatgttgtttaaaatcagctcatatatatggattcatatgtgttggttttaaactctggactaggcatatatatgaatgataaatgcctcatatgccagttttaagtaattaaaatatatggacggacaagtctaaatatcgccctacactttagatggaagtcatttggaaccttaaatttaaaaccagacatacatccaatctcccaaactttacaatacattttatattcccccctaagatggttttggataatggttttgcgtatttgggatgttaaacacatggctttaaacaactaatataatatatttacgtaccaccaattgtagctcaatttatcatgtacagtgatgtcgtactattaattgttacgtcggtacttttcttgtatgtaagagcgaacaaggggtaaaaacaaagatttaagtgaaaatttaacatatattttcaatgtgtatgtcacattatcaaagctccaccaacgtatatgcaaattaaataaaaaccaatttgtaaaaccaccttaggggggcatatatatatatatgaatggtatgcacagtttagggggttgaatgtccggtttcaaactatagtgcgttagatggacttctgtcatagtctagggggtgggggttatttggactttttcgatatatatgatagtgtcaccatactgtcgatgtttcgtttttatagcactagagtggtgtgtaacggtaaattgattgaggttgacaaaacattctgaagatgaagccataagaggaatggaaatttaattctagaactctagatgaagtggcaaatcgaaataattgaagacaagttaattggaaatccctaaaattaagctcctactgcataatctacattaaccctgcgttgtcatggaatatttggatgatacctttgtattatactttgaccaacaactacagatttaagatcgtataaaatatttgttaatacaattttgtgatattacgtggcactataaaaacatgcatttttggttcaattaattactaataaaaaatttaaatgttgatttttttggaaaataaggagatgctttataattttaaacagggggagtaagcatgtagcagttcatatagggtatataccagttctcacagggtatttacctaatttaggctgtccatataatcttttcatgtcaacattttaaaacaaaatatcttgtgacttactgacgtcacaccatttcttcatgcccttacgtcatgccatgttcacattctgccaagttggcattaaattaatttctactgccagagtgcaatacatatcacaacttaagtgcatacatatcacatcctatcacatcttgaactaacgtcaaggcatccctccagttcaaaaactccatacatacacacccatatctgtccaagttaggaaaccgttcccctgttgctctgtgtt

SEQ ID NO: 8224 - DNA, 1501 bp, Oryza sativa
acgaatatggtatcggggtttctaacagacacggataataatatgtatatccggtgaacaacactatttgatatccgttgaatccataagacatatcacatttctttataactctacaaccttcaatctatctttttagatttttaataggagaccatctcttaacactagtccacattattaatattatttgaacttttaatatctttgataaattataccatattttaaggaggtaactgctggggcgaccaagatgagcttacatgtggaagctggggcggttcggccgaatttgtggtcgggacaaaccactttcgccgcctttagaaataattttaaaagcctaaaacaagagatctaattttaagttaataaactccaatataacagtaggctagataattttttaaaacacttctattgtttctatagttcctaaatttttctgggatttatttgagccaaggaagtatttttaataaatagaattgcatttcatgaataatttaaatagaaaaagttttaaaatctctcttttgggtttggcctttctctctctccccggcttgcgcgcgcttggcccatgccggcccagaccgccgcacccctccctcctctctcttttccgctgataggtggggcccacctgtcagtcgtcttcaacctccagccgccatacccgcgccgcaagctgccgctgccccttccaaatccggccacccctttccatctccggccaaattgtttgaggggaaatgatcccccggatctcctcttccttttcctttttggaactatcgcaaatttctatggaaatagcccggattcgaattcgattcttcccctctaaccctaaatcttccatctcgccgggctcgccgtgggcctagccgccgcgctttgccgctataaaatgacccccgggacctcgtccattcgccaccatcctcgccttggcttgccgtagctggtagagccgcctccgccctagctcgtgcgccgccgccgttgccgcgtgtccaaccgtgccgcgccaccactctagtcgccgtcgtcgctcggggttgccgtcgccggagcggcaaggtcatcgccgtcatcgtcccaccctccgttttcaccgaagaccgctggaccgccgtcgtcgccaccgccacctcgacccgaagaccatcgccgttgacccgaagaccatcgccacctcgacctcgccaccgtcgccatctgtcatcgttcgtgtggagattatgggtaccccatacccacacggcatggttattagactggttataggagataacttatatctatggaatatgtaacggatcatgacttgggtattacgtttccctgtatattatggaacggcctaaagtcctagtttgataagattgtaaagtagatttaggaaaccgataccgtattgattaaggtttctatcttgtagtcctgccccccatcctatataaggtgggcaggaggctctatatggggcatg

SEQ ID NO: 8225 - DNA, 971 bp, Oryza sativa
ttataagctctccttttggtccttatctcccccttgttcatttaattggatctggcaaagtaagctcaacatgaaaatcaaagtctttggatggctactgttgatggatagagtgaataccaagtatcttcttgacaggaaacattgtattcctttgaatgccactgcctattgtttgacatgtgggattaatgcaagagagacaagggatcatctcttctttcaatgtcagttcagcaagtcatgttggagaaagttgggctgggtttggaactcctcattagaataccatcaaatgctgaaggttcaaagaaattccttttctcagtatagttttatggaactatttctactggcagcctggaatatatggaaagaaagaaatggccttatttttcaaggtattcagccatcagttcacaattggaggaagggtttgaaggaggatttgagcctacatttaattaggttcagagaagttcatagacccacggttcaatcatggattgacaatctgtaatctttgctttcttcttttgtttctttgtgtgtattattttttccttctttaatataatttaaccgtgggggcttcccccctgtctttgagtaaaaaaaacaatggtctataataaaggcaataggtcattcccacccggtgacattaaaaaataaatgcaatagttgaatagaaattaaatgggaataacgtgatcaaagagtgattgggatctgtgtgacatgccttgctgcccttcaaactcatcagactcttctcctgcacagacagactctccgggaacatcggaatctaaacataaaagaacaaaatcaatcaaaaatagagacttgaaccaactaaatccgatctacggtgaattagttattaatttttgaagtttaaaccgaattaaattatttatagagattttaattgaattataacgcaataaaaaattattttaaaaaga

SEQ ID NO: 8226 - DNA, 1501 bp, Oryza sativa
agggcccgatggtggagggaaggtactagtgtggcgaagctgcgccaaaagtcctttccatgcctgaggttgagaccgagctcctaatggcccaagcctgatttttatcgtgacaaatatatgagaagtacacaatttattttctgttcgaataggcagagagcagctgtaaatttaccgggtcaaagccaatccaaataacttttttgtgtagttggtaataaaatttggtgctcgtaatttacaccggtttcgtgccacttattagctaaggccctgtttagttcgtgaaatgaaaatttttgggtgtcacatcagatgtttgaccggatgttggaaggggttttcgaacacgaatgaaaaaactaatttcataacttgcctggaaaccgcgagacgaatttttagagcataattaatccatcattagcacatgtgggttactgtagcacttatggctaatcatagactaattaggctcaaaagattcgtctcgcgatttacatacaaactatacaattagtttttcattttatctatatttaatgctccatgcatgtgtccaaagatttgatacgatgtttttgggaaaacaaattctgggaactatacggggcctaagtttcatagtaggctataagtgacaattccccccctccccctcatcgaatcatcgtaagggttcactcaaatattaaaatttcagtgttaaaaaacaaggtgaaataattgatattgtaagtgatcaatctcagtgcttttctccaatttgaaatttgcttcaattccgatatgatttaattgtgacagattgaaatttaatttgttttgaaaagatcaagataagaataccatagttttttgtgattcaaaaactttcaaatttaacattttgatcaagaaaaagaaaatcactgcaccaactcactgaataggtatgttagggatatcacaagtaaaccctaatggatatactccgtatatgccaggatgaaacaaagcttaatcaagacgatggatggaatgatatattgagcaaaaacaaggtgatatatatgcaaggaacgaaatttcctccagataatatgtatgtgttgtaaactttcattggatttgtgaagttgtgtgagcgatacatagccgataagtttatttggcacatacacctatgtcgctctcgtcaactggaggaagaaaggtcgtagaacttgcccatttttttccacaagtttgtgaccccccatcggcgtcatggaaagctaccccttttttgcgtgcatgcgatctgatctcagccacactataaatagctagacaagtgtaacttcttagctcgtgccaatcacaagagcaagaagctactgatcttagctgagctagagttccagtgatcattaaggaaagaattagcacttggtcaatcacacataggtaattaagattaattgcgatcgagatcatatcactagctagctagctgtgtgtacggagtacggtgcca

SEQ ID NO: 8227 - DNA, 1501 bp, Oryza sativa
actctcgaagccaaaggaccggctaaaaaatggcaagggggaggaggagggggagggcgatgacagtccgtctgcgaagatacaatttcgcacgcggaccacgtaagatagcgcctgtgaaaataccaaaattaatatgtccaatttgcatgatcgacagccccttgcctcctatattcatcgatccacagcaaatgtagtttaattccaagctaccgatcgaaccatcttaaattctgtcaatctgttttgaatattattcttttattcacattggatatatatgatcctgtcatgtctcgcctacgtgctcatcacggctatttaatggcatcaatccgtttctcacatctcttaagcgaatttatatacgatcggtatacgtgatcacaacatgcatgaacgtgatcacaggaaaagataactttaaaaaccacgatttgccgagataaaacctaagaatgagacacgaagcttaattcaaattagctggttgattacgatttttaccggtgaacacaatccacgcttgaactttatgaattgcataaattaatgcatatgaatgtattttgggggaaacacatacaacttggtagagaaccaattacaaaccttggtgtccatgcttaggggtttattgaagtcctagtggtggtctcgtcacatattcgtgaagttatccttgcatttttcctattatgcaaaccacatgcatatatatacatcatgtagatagagaccaaagataaatgtgtgaatataataaaatttttatcagaagctactaagctagtgtatccatgtgtagtactaccttcattccaagagaaaagttttgcagtccttgagaaaatatctcaaggcacattaaagtttgttgtaatttgagatacttactatctggaggtacattccaaaatatatgataatgattagtttatttttaaccaactaatctcattccaaaaacaaatagagggactatataattttctctgatcccctgtaaattttgaactgtactcatggtctattgcgcacgtctccaaatagtaatgccaacaacatgtgtgttatctaaacaattttttttgttccattcaatccattgggcattttttctgagcgatacataaacgataagcatatttggctgcatatatatgagtgttgcatttgtcaacaggaggagaaaggtctttgaacttctcgagtgtttttccacttgtgtagcggcctaactttgaccccccattttcgtcatcgaaaggtaccccttttgcatgcatgcaaatgcaacctcagccacactataaatagcaacacatttgttacttctcagctcgtgccagccacacatcaagtaagctaagctactgagctaactcagcttagctaagcttagctagagctcaagtgattaagcaagaacacttagttactcatagataattaattaattaagatttgtgagattaccatggcttcgaggagtagc

SEQ ID NO: 8228 - DNA, 660 bp, Oryza sativa
tatgttatagatatcgtaaaacatatgataggatttaatcatttgttttgaaagccttcatagaaaatttttctatagaattgaaatccttcgaaaccgctatgttttttctacaaatcaaaagcgaagatacgttttcacaggggaggttatgttggcgtttttctcccttcaattgtagaaacttcaaacaaagttagggcgttaattaaccgtgccaatgccggtcagcgactgctcctactagcagttgcaccaacgtatatactgggtccaggtatatttgagctaagctggcggtataataataacaaacatagttagagaaagctatcgtataaacttacagatatctccacatgggagccgtgcagccagctaggtaattaatctgcagaaagcactaattaatcctagcatatcatctcgcatgatcatcgatgcatgcatagagatatctcaaggcacacgtactccactaatccactctataaatagcgaagcacgtaccacgaatccctcagctcgtaccagtcgtcgtcctaagcaagaagaagctaagctagctagctgtgatcggagaggtatacagtgatcagtttgattgtgaatttgtgatcgccatggctgcagcttcgtctactacgactcgtttttgcc

SEQ ID NO: 8229 - DNA, 1501 bp, Oryza sativa
ttgttttttcgtgcgggcggcataagcaccgcacgcgaaaatctgattttcgtgtgctggcgcgccacccgcacgtgaaaatcgtgattttcccagacgatttgttccagacgggccaaagctccgcacgcaaaaattcgattgatcgcctggggaaacgctttgtgtagcagtgaatttacacttgagagacgcccatgacttccaaatcagaattaaatttgaaaatatacagtttattcaatttttttgttagaaatattcgggatgcaaaatcttttgcacaaatataccatcggtctcataacgattgcgtgaaaatgacgtgaaaatgacgttgcgaccggtatcgcgcagtgaaaatgcgagaccgaacgaccttgcgtggttcctgcgcgagaccacgcggtctcgctcaagcaaacagcgataccgctcaagcaatcaacgctatcgcttaagcaaagagcgataccatgccttgccgatttaattagcggttaattatcctcattagcgattagttaataattaattaatcgctaattaggataattaatcactaattagtattagttaattattaattaggtacttaatcactaatcaaatggacccattagacagtgtcgctgatggcttctgcgagaccgttcggtctcgctcttccattccgcgagaccgcacggtctcactccgttaccgcgtgagaccgcatggtctttcgccgcgtgatactgtccgcgcgcgatgtcatccccacgtcattttcgtgcaacggaagtgcaacaccgatggtatatttctgcacaggttttttcatcccgaatatttatgagacaaaattgaatgaacagtatatttttaaatttaattattccaaatcatttggttaaagcggtactcgcaggcagccccgaggaaattggagtctgtaggctgatttataataatttatgtgtattgcgctatagtcctatcggcaactacaccctcatttcatcgagtcaaagtaatatagtattttgaccggagaactatagttacttgcaatacaagtctattagtattaataacgtcaatcacttccgcgctagaaattagtcatcaacaccataatccttctctctcaccgatcaccggataattaagggccagctcaagctaggccaccatcaccgccaccacaccatgggttcgcgttccggctcgtcgacgacgacgagtacgccgccagtggcgccggatgagaaccggccgccggtggtcaaagggccggcgatcttcagctacacctgcgctggcctcgtcacgggcgtcgcgctcgtcgccgtcgtcgtcttctactgcaaccgccacgtccggaggcgcgcgcatgtcgtcgtcgccggcggcggcgggcgagaggacgacgacgtgcgcagcgtcgctggcgtggcggccaagatcccggagttcgcgtacaccgggtcggcgagcggcggcgagggggcggcgcagt

SEQ ID NO: 8230 - DNA, 1501 bp, Oryza sativa
gtttcatttgcaatattaattgtcaccgtttcagtaaaaaaaaatattaattgtcaccgtagcgttagcacgggcacactactagtatatgagatattgtgtttgcgagttttctgttctctctcttgtgatagcaacgaacgagaagaaagttttgaattcaacgaaatatcatgcatgtttgtttatggctttatgtgagaatcaaggtagcttatacggctgagtacggcactattgttttttttcttctgaaaactagtacggtactagttgactaaagaaaataaaaaaagggctaattttgttgctattggaaaaaaataaataaaattaaccacacgcaatttcaaatctgtacggcaaattaaggaccaatttttttagataataaacaacaattaaacccaggtaaaaacagaaaaaatgttgccctgaaatcctgtgatttcaaaaccaagaacgtatatattttacagcaatctttctcagtgttctttaattacaaatacaaagctgaaccaaagcacatacatgccaagctagattaaggttcaaatcaagaaatgatatgcccaaaacgtatgaattaactaatcatgatgtgatgtgatgtgatgactatggacggacctagctagctagctacagtgctacaccggtggcagcgcctccgtcggcgacgactcacccgccgccggcgcaggtcggccgccgtcgtcccccggcggcggctcgacctccgtccggcagagcgggcacgtggcgtgcgaggccagccacatgtcgatgcactccacgtggtacaggtgcttgcacgccggcagccgccgcaccatctcgccgccccgcaccgctccgaggcacaccgagcactgcgccgccccctcgccgccgctcgccgacccggtgtacgcgaactccgggatcttggccgccacgccagcgacgctgcgcacgtcgtcgtcctctcgcccgccgccgccggcgacgacgacatgcgcgcgcctccggacgtggcggttgcagtagaagacgacgacggcgacgagcgcgacgcccgtgacgaggccagcgcaggtgtagctgaagatcgccggccctttgaccaccggcggccggttctcatccggcgccactggcggcgtactcgtcgtcgtcgacgagccggaacgcgaacccatggtgtggtggcggtgatggtggcctagcttgagctggcccttaattatccggtgatcggtgagagagaaggattatggtgttgatgactaatttctagcgcggaagtgattgacgttattaatactaatagacttgtattgcaagtaactatagttctccggtcaaaatactatattactttgactcgatgaaatgagggtgtagttgccgataggactatagcgcaatacacataaattattataaatcagcctacagactccaatttcctcggggctgcctgcgagtaccgctttaaccaaatgatttggaataa

SEQ ID NO: 8231 - DNA, 1501 bp, Oryza sativa
cgtactactctaacaaaatatgcagtttttaatggtaaaaaaatattatttttttgttttaaataaaataaattttgccgtagataaaaattattttgttttccattcgcaaggcgaaactaaaatattatttttgttaaaaatatctcacaaaataaactcataaatatgatagtcacatgcaataaatttatacactccattaatatacttcataaatttatattttcttgataccaaagggttgtcatggataaaaattatttttgttttcccttcgcgaggcgaaactaaaatattacttttgttaaataatatctcacaaaataaactcatgcatataatagtcacatacaataaatttatacacttcatcaatatacttcataaattgttattttcttgatagcaaagggcaaaatggactttatggtagaaatttagtggtcaattaacagtcaactaatggaatgggtatagaagggatccaaactgaaatttaggggcatggaagggaatgagcaaatctcaggggcatagaaaggattgggtgaagtttcaagggtacacagggaattttctcctattaaataattaaaccaacaattcctgatccataatgcctatatttttaacctaaaataagacttgtataaaataaaatagaaaagtagaaaaaaatgtcaatagagattgaattaaatcaattagagagaatctaatacatttgcaaaaaataaaaaattggaacaaccatcgtatgttctattgccataaccatgtttgagtgcttagatattaatggccttccatctatcctatatcgtggtattatgagtttctcatatttattgcatatataagacatactatggtagcaatgacgtagaagtacttagtttggttaaaaaggtatatatatatatatatatatatatatatatatatatatatatatatatatatatatatatatatatatatatatatatatatatatatatatgctactatcaactttaaatttaggactcacgttggctagttatttttttaaagaacaccataaatcacatatataataggaaaacgacgcgcacaatatatatgtctcctacgtatttacggactcactctttattttagaaaataaagaagatcattggtaattgcttatagtaatgaattaaatattatatagttcaaaccttacaaatatcttgtaaaaaattatctaagcaatgtcaatgaagaaaatttataaagaaatagtacttttcaagcgtagcaggtaccatccgattgatattccaccttacatgttactcaagcataacctactttacatgcctgcgcgaagtccattgccccttcccgcacggcccgctccctcacctcgggccgccatcccctcttctctctccccggcccagctcgctactcagcccgctcgccccttccctcaccaaagttcgctttacctaccccttacttggttcac

SEQ ID NO: 8232 - DNA, 1501 bp, Oryza sativa
ctatttctgcttttggatgtattccggaccgctcggtccgatgatttaagacaatgcctgcgggcttatgttgtaataattcgcactagactctcgtgtatgagcatttggtattacagctatgaactcgtgtgtaccagactacttgatccagggaaatggtactatttacacgattgattcctgttataaaaacgggggtctacagtttaggagcaggaagaggtcatagtctgttttgcatggacgcatgcatcggcggattagatacctgcaactgaacgtgtgagtgtggtgttctatatgcaaggagatgtggcctgcatgtagggaagtgattagtggataaaccatgcagtgtttggctgggtagtgcggccagaacatggcttaatgtgtgctatttaagcagtgtattagcttgtgttttgtggtgtgattaatagcagtgcgcttgtgagtgctgtggtgtgcaggtgtgcagcaaaaaaaattctctagtccagtgtgtttatgtttttcattctcgcttgtgtgctcgtgtgagaggagccgaatcatcggttagccaacatcgctgtcatttttgctgtcttaggtcgtcatcgtagtcatggtggaagagcacctcgccacctcctgctccaggattcgccttttccgtagccgcccgcatcacaccttgcaccccccctcccccatcacccccttccggggaccgcgctgacgccatctcccttctactgcagtgctgccgccaccaccgccccttagctggcttcagatccaccatctcgtgctacgggcatgatcgacagaggtggcggtggaggaggataggtacgctgcgttttgaaggggagggaggagatgtttcggcctttcgggttgtttgaggtggttgcgaaggaggcggatggtcgtcacgaccaattttcagtcgggattaaaaatctcttagtaatgtattcctaaatttatattaaaagtcaaagcaatttaatcaagtcaatttatcagaaaattaaaaatttcctttaaaaaatcatggctagaaatatttttataatattttccgtgctataaaatactctctaaaatttcatgtgaatttttggagctcaagaaataattttaatatcacaaagttcatttagtcaattaattaaatctgttatctactaaaagtcgtccatgaaacttcctataaacgctcctaagccaccacgtggtactcctacaaacgctcctaaactgccacatggcactttttaatctaactgtcgattttcacttaaattggtgggcctgctattttggaccattagattagatctatttaaaaaagtctcagcttcatagaaattatttactagaaaaattaacgtacatactggggatacccttttttttttgacaaattgtcccttttcaaaaacatcttgcgaaactagcccgttcaaaaaacttcaaccaaaaatagactgcggactcagcgcca

SEQ ID NO: 8233 - DNA, 1501 bp, Oryza sativa
tccggtgaccgcgacaaccaccaccactacgacacacacccgttgaggtgaagatgacctggtgactgctagctccttgactcccgctactttgcctcatgcagatttggagacgagaggcggacctggtgaccacgacgatgatgatttgtgaatgtgaatactctgtgaatttgtgaatgtcaatgctatgcattttctggcctggattggactttcgtgggtcctattgagattagcaggcggcgctaggcgaggagcggtgttggctatgattttttttagcaccgaaaaggattttcgcaggtgcccggacggctgcgatattttttagcgttggaaaagatttttgtaggccaatgacttaagaggttgtctgcgaaaaaacatgaaatttacagtcctttaatgccaggaggaatgccgtcagcatgtgtatatcaattttggccacctgggaaaatatttgtagtagtgatattataagatattttatcctctccatcccatatgtagattcaataagacaaattttactacaggacatcgtgacttcgcggttttagatataggacaccgcacgaagtgacttttaggggaagacactcccaaaagtgatatttgctggtggacacggtatgcattaaagtaataatttctggtttaagaggagagataaatcacatgaaatgtcagaaatgctcttgggctcacatatcagttcttctctctatcccacatgctagcgatgacggtgggcaggtgaggtccggtggcagcggcggcggcgggagggcgaggttagagcggacgcgactagcggcacgcggaggagcgccggcgccagcgcttatggacagcggcggcggccggacaacaggcaaggttcggcggtggcaggtgcgtctggtggagtggcagtgcggctggacggcaacggctgcagcgcgcggagtgaggagggaggggcgccgtcggtggccggcaccgctgtccgggcaccctcccgtcgccacagccaaacctcacttgcccaccgtcgtcgtcctcatgtggcgagcgagagagaagaggagggaaagagaagagagataggagagctgatatgtgagtctaagggcattttgatatttcacacgatttctctctccccttcaaccgtgcggtgtccatcagcgaatattcaacttttgggagtgttttcccccaaaagtcatttcgtgcggtatcctatagctaaaaccgcgaagttatagtgtcctatagtaaaatttgccattcaataacgttcatatgaatttagatataaatcaagcatttacatgtatctataaataaatctatccaaagcctaaagcggcttacaatacattggtttttttaaaccaaaaccaacaacaacgtccgttcaaaccgctcaactttagctaggagtacactcagtatttcatagtattaattttcattggctgaatcgatgaacaaataggaagtggattgg

SEQ ID NO: 8234 - DNA, 1501 bp, Oryza sativa
gaatgttgaaactattcaattaagaaaataaaaggaatgaacaaggtattatatagtagtctctccgtcccaaaagtattacaatatggaataggtttggtcaagatttattgtaccgttctactatgttgtaattacaatttgaatttaagagggattagtaaatacttatttctatttgttaagtagtactccctccgtcccataaaataacaacataggaccgaatagcgtctaattcggttatagattgttatattataggattgtgggcattttggattggtgccaaaatgtgcactacaaatttattagtatcttgaatagtaatagtatggatttggattgaagacaaatctattacattattaaaacagctttaaaaggaggcaccacgttcgctgtgggagctagaaatttccacattaatcggagaaaaagaaaaacaagaaaaggagaatccaagtagaaatacaatttaaaaatagttgaaattcggaattaaaaataagcaatatagaaagaagtttccatataagaacccaatacgagattaatcaaaattcaaaataaaaataaaataaaatccaaaattagaaaaggaaaggagagtcaagtagaaatacaatttaaaaatagctgaaattcggaattaaaaataagcaatattgaaagaagtttccatataagaacctaatacgagattaatcgaaattagaaataaaataaaataaaatctaaaattagaaaaattaaaagagagtttaaataggaatacatttttcaaacaaatgaaattgaaaataaaaataaaaacattaaaagaacacaatacggtattaactaaagtttttttttaaaaaaagttctgaaattagaaaaagaaaaataagatttcaattaggaatacaatttataaaaactaaaatttgtgataaaaataaagattattgaaagaaaagaccatctaaaacacatgataaataaattatgtaacatgtctataaaggagtagagtggtggcggttgatacgacgtataaaaattgttaataaaacaacgaatagatcctaatgacgattaaaaggagggacgtcaggcaggccgtgaagcaaacgagtaaggtggttgccgggacttctagaaagtaaaaaaataaaccctattgatactcatattcgatttttaaaatctcaatgacaataaaaaagagaagtagcgggcggggtgtataagagtatagttgcagagccgctgacggttgatggtacttctagaaaataaaaaatgaattccaacgatagttacgttcgatttttagaatcacaatgataataaagagtaggtggcggacgggctgtagaggggcatagtggcatcgtttgatgggacttctaaaaatatataaaaaatgaaactacaagtccaatttttaaagtttcggaacttctaaaaagtaaaaaaaaaataatgataatcatgttcgattttaaaatctcaa

SEQ ID NO: 8235 - DNA, 1501 bp, Oryza sativa
ctaggaggaattctgaaggagtactggagtatcggtgagtactggagtactggccgagtagcttcctagatggctacgaaatcagtcttggctttatagccatggttcgagagaaaaccttctctggtagtatcggtgaaaatccatacctccatcttcaggactttgagctagtgtgttcgtgcctatctatcgtcggcatgacacatgatactcttaagtggaaattgtttcctttttctcgtagagatgaagctaagcaatggtacactctatctgtcaagaaattccactgtgaatgggaggagcttaagtgcaatttctgccttactttctttccattaacccgtgtaatcaatctttgagtagacatcctttcttttcgacagaatgagaaggaatatctcggtgcagcctaggccagtttctcactgttaactcaatctggcccagacttgtcgttacccgaccacgtgttgttgcaacattttcggtacgggttagacaaggagtttgccgaaaatctcaatatttctgccggaggatcgttcgcacacaagacaaccgccgaaggaagagaactcttagatttgatcttagagaacgattctttcggccgaagcgaagccgtcccgaaggtcgagattattcatgaggaacctctgcacgtggagttggaacccgactcaactgtcgaatcctcatcccggtcgcaggagccggaggaagaagaaattcatcctccggaaatttcattccaattcgaggaggatcttttcgaagattattagaacaccttgaattattcctgagagaagagaccaccgaccaaggtcaattctaatgaacctcttgataaatctatgcttaaagagacggtgaagaggttgaccatcatcatgagtaacaaatggttaagagaaggagagctcttatctgaatcgattcagatccgatgcccctcctcaaccattatgtgtcacattggaggtaattcggtccgtgctctgtataatccctctgttggtgccaatattatgtccgcaacctttgcattcgattgcttaggggacagatcgttggaaccaaccgtcagaaccttccgaatttccacaaactctactaccgaaggtttagggattatctctggagtgcccacacggcacaacagtgttgaggtcatattagattttcatgtgtttgaaatatatgatttcgacatactcatagggcatcccatagaaaaactcttagatgtgcccgaaaccggtgtccttaacctgaaaataggaagaattgccacctccgtccctatgttgcaatcaaccaattctttgatggagtctcttcctgttcctgagccaattgagggagtgatggctatttctccattcgagaccctagagtctattttcgatgaatccatcgaagaattcaatgaaggggaggatgaaactggagaaacgatggatctgccaaaaacggatctgccgtcacgagc

SEQ ID NO: 8236 - DNA, 1501 bp, Oryza sativa
cctccacgatagtatctaatcctaagaaactttcctagggagggtactcctccgtatttagcctaggttggacggccatggtaggttgtcgtaagaaactcggcaacccggggtagtctctcgaagcaccaggagggcactgttagggggtattggctatatggttgtatactagtagatgtagactaaagttgagtgtatattagaattataggaattgattgttttttctatttcttcttccacttagttcagaaatgattaaagaagaaatatgagtgctttgcttcgtgtcactctacccatataaatattttaacccatgcttagactttgattatgtaagtggcatgtatatatattattagcatagttctctcttacaatcttcccttgcgattaaataaatacgataccttagaatactcccgggtgaaatgctacaatggtaaatccgtgcgcttgcggattctttctgtaaaccatatatataccaggaccatttctagcgccattgctgggaattcatatttctagtaatatcgttaagaaataccaacaacaggctggccggactagagggacaggatgcaacattccttggaacattgggatggccaagtacaacgcacaacacaggaagcgcaaacaaactaaggaacaaagagagggtcgtcttagagaatagattgtaagggaggttaaacaaactaaggaacagacagaagatcatcttagagaacatattgtaagggaggtcatgggtgaatgttggtatttcttacgaccaaagataaatccacaagcgcacggaataccgctgtagcacttcaccttcgggtgaccccaaaaggatatcaaactcagggaatgtgtgtaatctacctagggctaagacgatccaaggacaacaactataggtaggcaggctagagaggactttctctgtgttttaattatctaagctaagcaaaggtaatttcctatctgttgctacgggcaccgacccctgctggtctgtcagtgtggttccggctatagctctatgatgtacccgaacatggaggattactaggacggaattcagggctgtcaccacctgccgtctacctctgacaaatccgtgggatacacaacaaacaaaggtaatctctaacctagacaccaggcctaagttattaattacttctctaatacttgcgcaggaaattccttctctatccggagtcctagtactagagcacttagtataaatactaaataatgaacctgcaaagatggaaatatatcttactcagactaagtaattaaataacataagaaaggaacacgaatgcttacttaatagaagaagttctctgaacctagagcaaagtgtaccaacagctccagtactcctccagaattcctactacgaagctacactcgtcgaggcagaagtcggatgagcgccaaacttccgggcactcctctagagcttcccctcactttctacctattt

SEQ ID NO: 8237 - DNA, 1501 bp, Oryza sativa; identical to SEQ ID NO: 523

SEQ ID NO: 8238 - DNA, 1501 bp, Oryza sativa
agtactttggatgttggatgtatcgacccctcccccatgccccagcccagccagccagcacccatcagctcattaggcccatcgtgcaagccaggcccaggatgcagggaaataggccgcgaggaaggtgcagtcgcgcacatgcgtatggtacgactaaggaccggcctatcaattcggcgtaagccatgcgcggtttatgcgtacgtgggcatcgcgaggtgccctacatgctacacgcccatgtgtagatctcgggtgtaaacacatccatgctactctcgaaaggttaatgtacgcgcacgaagaaggagtttacgtccacgatgcatgggcagacatgaaccatatgtaggcaacttgcgatcccagcacgcgtacgtgtaaaccttcacgcacgtctcgcccatacaacatcattgtgcccgagctgtgtgcattacgcctacgtcaggatttcagatgtaaaaacgtacatagagcgtaccgcctacaacacggtttacacgtgcgtgatggctgatatgctatttcgcgagtcatgcacgctctatgcgtacgcagagatcgctaggtgcctacaaggttcacccctgcccgtgcctacaaggctttaacgctaggcgttcacaacgtacgtggatggtttacgcacaccatgggattgcgcacataaacaggcacgttgaacgtatgagtagaatcgatgtgtttacgtccgcaatctgtggatggtggtgacccgaggacaagaccttgacaaaattataaattatatatatcacattttcaatattttggataataataaggggctaacaataaaatcgatgctgtgtttggcttgtaatagtggaaatataaaggactattatataaaacggttactgccaaaatgggcttcataattgactgaccttgggatttactcctatcgttattcagtacacggttgagaggattacctgctaaatttaggtgagcctggcctaccataaaatttgttcgttctcatattgtataccagaggagtgctatcgatcttatgtggctatgtactttgtattttctatttgtagaccaacgtaaacggatgtaaccacaattgcttggttttagctaggatcttctacattagatcatttgtaccactatttacgtgtgccgatgcaatggctttctctaaacgcgatctacaatagcggcgcgatatagagcgtaaaccataaaaactagcacataattgaacattccactcgcctcttagctttccggggattcctttgtcctctccggcgaactctaacactgcgtacgttcctccggtgtggaatcacgactagagtaaactaacgattagagtttacgccggtgtccaaatgaccgtaatacccctggggtaaattaacctcattatttactcagctgacgggtggcgctccctcattggtcgtgcctacctttatgtagctttatgctgactgcacttaagaaagactca

SEQ ID NO: 8239 - DNA, 1501 bp, Oryza sativa
gagcgccaccggtagagagatgatcggagcgaggatcaagggcacagacttcttgcaaggagatgatattctctggatcaatttcaagggtatctacaaactataccagctggacgctctcgacgtctctattatgagttgctggattttgtaagtatcgttcagttagatttcttattacgtttcctttaattaattaggtccttgtatataagtagactatatatattatatacttccttctatcgttgtagaatggagattcaaagggcccgacggcggggggttttcgatactagattcatcgaccctcggaaagtaaacgtcacaatgctcgaccagtatccgcaagccacagaggacaatctcgtccatctcctgaaggcgcagcattacaagacgttcatactattgccgtacaacacagagttagtttttactgtcttcctataccaaatttcattcccgtacaaacatgctaagtgtttcatatgtaatgcatccgatgcacattgcagattccactgggtccttttactcttcgacttggaggcctgcaccgtcaacgtatatgactcaatggataaaaaagagtctacgtttgacaaggttttcgaacttatagacaggtactgtcataagttcctatgttaattaagaatcttgttataattaattgctactacgaatcatagctttaaactccatgtagggcttagtatcggttccgtcatttggtccgcggcaagtggagagaaagacttaggcggaagtttaattttcctgtgagtacacatgctctacatttatattgaatctccaattcaaatacatacaagtgtatattaattagatctctcgccgtttgtcatttatttatagtgcgcaaagcaagcccagggaactaacttgtgcggctactacgtgtgcgagtattgccactgccttgtagaccaaatcatcaccacaagagagctcaatgtacgtacaaataaattcaaaatttcattgtgtacgtatcgatttgttgtttactaattaatttcatacattcatatagtttattcgtatgagggataacctcacacacaaggaatttatcgcggcggttcaagaacaactcatgggattcatcgacgaacaaatccttgatctcaagggtgaattctactacgacagaaatacaattcataggtccttagcttctgagataacgactactactacatcgaaatcgtagctagctaggacattataatggattgtaattaatccatgtctatttttctatatgcatgtacacattttctttaatgtaaatatatattttggtcatatatatatatatatgcacataaaatgttaagtgctttcatatatatatatacacacacacacacacatatgcatttgcataacatatatatgtataaatacatatatattatgcatgtatctgtattgaaacatatataaatatcatatatatatgcatggttta

SEQ ID NO: 8240 - DNA, 1501 bp, Oryza sativa
caattcggacgacatgaaaaaggcaagtgttgtccaccataaaaatatttaccaatttagctttactatgcatatttatagaatgatctatgtaatgatgtaatatatgtcgatattttatcatatttctttgatattttgatgacatctagaattcatgggttgattatgatatatttcttatatagaaaaacataggcatacgaaacttaatttgtttgcttaattaaaaatagagaaatagttatattagatatcaaacatgtagcgtgtagctatagaaatatcatcatttaaaaattaaaattattaattatttctcttttagttggataactaaataataggaacggagagaggaatgaagagtgccagtttaagctagtgggaggagcggacattgataaacgtatgtgaggggagggggacgggggagataaagggacctttgttttcttagagatatatttattgggtccacaggtgaagaaaatagatggaattgtttgtaaatgatgtggtgtttaataattgtttacattatttggtgcgaaagggcataaaaagacataatacggtttcgtgtgaaatttttttaattaaaatattgctaatatgtgttgtaatattctttatctagagtaaattgcacctgcgatgcaacaactaggcaagtgggtgtaatttggtataataacttgagaaataagcgttctagtgcaacaacttggtaggaatgtgcaatttagtataagaactttagaggtgatcacataaatgcagcaacttgtaaggtaggtacgattttgatacaatatattaagaagttatgtgacaacttaattatttggagcatttttatataattcgaatacacatacttacttataatggataatatactagcgtggatttgaataagcatacttatatttttatcctaataactaatatctgaaagcaattaacctggatgtagaaattattatatttcggttgatattttagaaggtgaagaaaaaaaatcttaaaagtaattggatgtaaattgtatgtgcagtataattcttataaagattaaattcaatattataaggtaatatccgaaggaatactatgtaatggcatattgatatcgtgaaaaaactcaccttgcatatgtttagccaagttgatgcaccaaaatactaaactttcaaatttttgtactagaacgcacccacttatcaagttgttgcactcggacatttaattcttaagtttttacactatatcgcactcacctgtcaagttgttataccgtgggtgcaatttactcttttatctattatagataagatagatgtgctatgttttaaatagatatattgattgtttgtttttctcgatggtaggtgcctgcgtacgtacgtacatgtttttttactttgtcatcgatagttaaggctgtcaaaaaaaaagctcgaggctctcaagctgcttgaactcggctcgtcttagg

SEQ ID NO: 8241 - DNA, 1489 bp, Oryza sativa
tcaggctacaaagcgagagtactgatctaaagagtccaacccttcatccgtatctggtccccttacttttatagtccaaggagaggctcacattattataaatctactctttgtcttgtcttatcagcaatcttgtcgttgctggctggttcctatcacaatatttaagaaacccttcgagtcgtgcaattcgtattacctcgggatctgtctgagacagttgggctctcgccagtgtgctcgtacatggtgcatggtgggcctgacgagacccgacctgcccgaaatagcgccacggttgcttctttgcccgtttggctaaagcaggtggtgcagggcatgtgcgacgcgtgtccaaggcgtcaccggtcctaagtgactcagcgcagatgttttgtccacgccctttcaactctagactggctggggatcccccataaacttgtttcatttatggcggggcatgctacttcacagctggctgtggagcacgcccaacttcccggcaagttctgatgccgcgccctcccgcgtttaaagaagaggtttggttattctcggatgagcttcttgaagatgtcgttgatgaaggaatattctaagattatgtatcttgtatgtctcgacactcctctaggcagaggggcgtgagccctacaaggaccaaggtgagcccgaggcccggaacaaggctgggcccgaggcaaacctcagtttaaacctttatgtttggtatgtctcgacagtcctctttctcgagtagtgcatgaattgtgcatgatgagtttatactcgaggaggaagactaccctgtcgttgactacgtgttgattatccatgccgccaagtcgataatagctagataggttacccaaatattatacttgtgtgatccagatgaataaagagcaacatcagctttggccaacaggagtataaaaagagtaaatttcacaaaactacagatactatgaacaaactaccacaaaactacagatttaaggagttatatcacaaaactacacatttagcactaaatttatcacaaaactacatatttaagatgaagtgtcacaaaactacacgtttagtaactaaattattataaaactacaggtttagaaccaatttaatcacaaagtaataatgtttatagctccaccataacaatggtgctagggatttaaactccaaaagttgtagttttttgataagttcaatattaaatatgtatatttgtgatacttaatctaaaatctatagttttgtgataaatttggtgctaaatgtgtagttttgtgatataactccttaaatctgtagttttgtgataatttggtcaaaatacctgtagttttgtgaaatttactcgtataaaaatccttgtctccatctcttttacctcaatcttgcatatacccttataccaattgtcagggttacgggttaggcataccctttacccttcgatatacattacatatcggta

SEQ ID NO: 8242 - DNA, 569 bp, Oryza sativa
ttcctgcagcccttactctactccttttatcaatatagctacatggtctgtctagatttattaattgtagtaggatatgttttatgtaatataaggttggatgaggatagttaaacggtaaaagtaaaggaaacagtgagtgccctttgaatcacatgaatacaaaaattgaggaaaggaaaaacacatgattctaacaagagcaaaacaaatgattgcaaaatatagaaaaacatagggataatcatttgattggaccgcagtaaaaacataggaatcagatgagagagataaactcaaaatgaaattttcaagaggtttaagctcttactaaattttctgtaaaatctgtatatgattgtttattctatagggatttcgaacgatgatataggattcaatcttttgtttcaaataccttcgtagaaaatttttctataaaatttaaatcctttaaaatttttatattttttcttcaaatcaaagacacatgaataacagccaactccaaagagaggagggggccaccaccacattgaagtcactagcccccaccccacccccccaga

SEQ ID NO: 8243 - DNA, 335 bp, Oryza sativa
cggcgttgtcgcgctccgcgggctccgcccctctctcggcgcagtcgtcgttagtctccaccccggtcaccgtttctctaacccctgaagaaaaggccggcgaggagggagcctcatgattccggcgaccagctgagccggcgtccggcagggtgtcggccgccgccggcgagcgcaacgacgccgccgtgggacgtcccactcccactgcatgacgtcatggccggaacactgtgagatcatggtgccgtgcgggagggagaagagaactcaactagtgcaagtgcaaagtagttgcaggcagtggcactgacgacgggtgtcgaggagaacaa

SEQ ID NO: 8244 - DNA, 1431 bp, Oryza sativa
attgttatctaagttattgattaataagagatgacccgatgatatgaatcttactcttgatgatgaacccttgggaattttacaaaaaaagaagaaaataaatagttttacattctcctcattgatgttcccttcctaccaatgccatatgttgatcttaatgataaaattttatacatatactgcttgttatcattttgagttttgtcaaatatttgttactagtgtcgaaagacaactgcgtcatgtcgaaggacgtggttcactcgatgagttgatggaatagtaaaagcaatgtattaattggtaagaaaatttttgggatctccccattgcatggccctagggattagttactacaggggaatttatagggatacccttatgatagagacattagtgtgggtactgggtacacagtgtcttttgtatttatgtaccatctggtgatttccttggaccggcccattaatgcagaaaggcccccatgggccgcagggcctcccaagcccttagtcaaaggcacctcctactcaggagaaggcctcctgctccacttcatggccttcgcccatagtgattgttagtatttcttacgaccacagataaatccacaagcgcacagaataccgctatagcacttcaccttcgggtgaccctaaaaggatattgaacttagagaacgtgtgtaatcaacctaaggctaaggcgatccaaggacaacaactataggtaggctggctaggctagagtggacttttatgtgttttagttatctgtgctaagcaaagggaatttcctatctattgctttgggcaccgacccctgctggtctgccagcgtggtttcggctatagctctatgatgtatccgaacgtggaggattactaggacggaattcagggctgtcaccacctgccatctatctctgacaaatccctgggatacacaacaaacaaaggtaatctctaacctagacacgacgtctaagttgttaattactactctaatacttgcgcagaaacatccttctttatccagagtactagtagagcacttagtatgaatactaaacagtgaacccgcaaacaaggaaatatatcttactcatactaagtaattaaataacaaaagaaaggatctcgagtgcttactttataaaagaagtttctccgaacctagagcagagtttaccgacagctccggtactcctccagaattcctcctagaaagctacactcgtcgaggtagaagtcggatgagcgccaaacttctgggcactcctccagagcttcccctcactctctacctatttataatgtacaaaagatacaataaagcctcttgtaatttagctcaaagttgtgtgtcgtgaagtgtaaaggagacctccttttataggctccaaatgacggttacaagtatgggaaa

SEQ ID NO: 8245 - DNA, 754 bp, Oryza sativa
ctccaatgaacaaatgtacagtttacatctctgcacttattctctcggttctaatcaatggagagaagccagaagttacaaaaaatttaggtagggctcaattgatgtgttttaatttgtccaaactttacatggtgattgaaatatatatatatgtatatatatatatatgtatgtatatatatacatacatatatatatatatatatacatatatatatatatatatatatatacacatacatatatatatatatataaaataagtaaactgatagcccaattaaccctgaaaatcagttatttgtcgtttcaccttcgatagcgggattgcacgttggcactctggatcgcggcatcgcgccaatcagaaagaaaacgatgtctcgcctatccctctgttggcgtctggcgctttgccactgtaccgcactgtcgctgagtcctaacgccgtcgcccagcctacctgcctacctgagtccctgccggctgcaggctacagcgcctgagccccggcgcccttgtcccctacgcctagtctagtcggctagtcgcctgtcctaatcaggtaatgttaatgtaatccctattccctaattgtagtatatggattattaagtttttggttcatctactatatacgctaaatcaatttttgtccttacatcctgtattttaattttgaagatatgtcttcaacaaatcggaatagaaaatatgactccggttatgaaacataagaagaaaaaataa

SEQ ID NO: 8246 - DNA, 1501 bp, Oryza sativa
tttaatggatgcttgaccagatgtcgaaggggttttcggacacgaatgaaaaaactaatttcataactaaacagcgagacgaatcttttgagcctaattaatccatcattagcacatgtgggttactgtagcatttatggctaatcatggattagttaggctcaaaagattcgtctcgcgatttacatgcaaactgtacaattagtttttttttatctatatttaatactctatacatgtgtctaaagattcgatgtgatgtttttagaaaaagtttttggggaactgaacaaccccttattattattgtcaaccgtaaatcaaatttaaaattttgtaaatttagaattgaattgattttaggggttttcatcctagtatatgttgttttctagccttgccttttttttattaaaccactaataatacagacatagaaaagtttcacgcataaaaatatttttactattctgttcattcatttttctacgtgttatcaaccacaacttgaacccatcagagtgttgtttcttctcatcctgcagagtattgtttctcattctgtgattccatttcttccggtttgtatcatcaaacacttgttgttcattcatgctgatgcagcaactgatttggagttcaacttggtgtgaggaggttcgtaagaaacagcagaggttcttcttgctgccgaagacgtgctactttattctaaaaagattttttaaaaatttttacagatacgaaccattggttgcgaaatgtgctcttccacaacaacagctgagataaaaacaagctcgaaatcataatcccttcacaaagtaggccgcacggtaaagtcacaccatacattaaaacgtaaacacactacaaaaaaaaatccttgattatttatccatccgtcaaccaacaggaaggcgcagttcatgaattgacctgccaataatagacacaaatttgctcatgaaaaaaaaaattggcaggagcacaagcattacagactaaaacagctctgggtaatcgaatgatctatagaagtaagactttgattcgaagaacacaaatttcattaatttccacaactgcaaagcatagatgcagagctagaagctataacttataaagcccacaatatcagctcaatcgaacatttcacagtgtaagtactaacaaaatcaacattatattgtttgtgctatgcatttgaaagtaaagctttacttaaaatcactaatcatcctagtctcttggaagttgtggaaagaaagaaactcgagagttttcaggcaacttgcaagcactaaacggacatcctggctaaaactaaggatgaagcacggctctggataatggtaggagcaaagtccttagctgagttccttccgttgggagagtaggcctcgtttctggtcagggatgaccgaaactcccaccccccttgtaaatgctgttttcttacccctttatcaatatataaggcaataattttgcctttttt

SEQ ID NO: 8247 - DNA, 1501 bp, Oryza sativa
ttttgtacaaataataagtcaaagttgtgttttggagaccgtgtcgctgtccaaaacgacttcctttacgagtacggagagagtacacagcagctttgctggtagaaggaaaaaggaacgctgagtcttctctttgtcttttgaattgggaagaaacactggtttagccgctccgaatcctggctaccccagggttcacaatttctttgaatttcgtcacccaaaatgtcaatttggagcttcttcaaatcgctccttttcttgttaaattttgttggaagcaaaattactcgtctcattgggaccgtgaaacgaaatcgtgaaccgtggccacccaagaaatgaagaaaaacaacccccaaccaaatatactaattccaaaatataaagagttttaggttagacattggaattaaaaaaatagtagaattaaatagaataatatcgtgattggttgagaagggtaaggaatttgaatggtaaaatgttgtatacttgtatttagttgagaaaaaatataggtgaaaaatgttgttatatagtatattttagggcaatttttgttttaagtaggaataaaatttaaaggcgttgttatactttaaaacgaagtatgtagtttgcttggttgcgtctaattaatatgcaaacagtcggacgatgtgagcatctgtgagcatcgaagggtttgtttgtgccccaaaaagaaatcgttctccgtcagtccgtctcctcctccatggcacgatcccttcccacacctttcctatattctctgcatctcacgcgtgtaattgggagattagtggagaactaaaaggagtaaagaacgtgaaagggaattccaatttgcggaacgccagttaggagaactaaatggagtaccttttttttttctttccaaaacacaatttagggattagactccattttggacatttttagggtgtgtttgctagtgtagttggtgaaatgaagccgcggatttaatagaactttttaaaatagctttcatctatgatttttttttttaaaacaaataaatcttctagtaatttggaaaacgtgtgaacgagggagttgaagtttggaagggatgaaagaacataatctttgagcaagtttaataatagttggttacaaatctatagcccgtttttttctctttcttctcctctcccctccacataaatacaaatatgatatggcaacttgtacaatctgcttacataattttattgtagtcgctcttatagtgcgttcggaagttgtctttcccaactcatactctcttattttcctcgcgcaagttttccgaattgcgctaaacagtacgtctttttttaaaaaaaatctataaaaaaattgatttaaaaatcatattaatttaaggagttaatttatcagatgaaactgatgaggcattatctcagccgttggaaacaagtaacagatgacatagatttggacaactccaccggtagagttctaccccaacttg

SEQ ID NO: 8248 - DNA, 1501 bp, Oryza sativa
caggactgtggtaacacattcccaaataatgtttctccagagtcatgctagattactatcagtcctcaattatactagcatgcagcccacaaattattaatcttgtgtaccgagtcatgcttggttgttaggtaatgattgatgcattcttcatctatatatctatccttccgccatgatttcgtagtaaagctttacttcttttttcgtttcgttttgttttcttttttgaaaaaaaaggcaaaattattgccttatatattgataaaggggtaagaaaacagcatttacaaggggggtgggagtttcggtcatccctgaccagaaacgaggcctactctcccaacggaaggaactcagctaaggactttgctcctaccattatccagagccgtgcttcatccttagttttagccaggatgtccgtttagtgcttgcaagttgcctgaaaactctcgagtttctttctttccacaacttccaagagactaggatgattagtgattttaagtaaagctttactttcaaatgcatagcacaaacaatataatgttgattttgttagtacttacactgtgaaatgttcgattgagctgatattgtgggctttataagttatagcttctagctctgcatctatgctttgcagttgtggaaattaatgaaatttgtgttcttcgaatcaaagtcttacttctatagatcattcgattacccagagctgttttagtctgtaatgcttgtgctcctgccaattttttttttcatgagcaaatttgtgtctattattggcaggtcaattcatgaactgcgccttcctgttggttgacggatggataaataatcaaggatttttttttgtagtgtgtttacgttttaatgtatggtgtgactttaccgtgcggcctactttgtgaagggattatgatttcgagcttgtttttatctcagctgttgttgtggaagagcacatttcgcaaccaatggttcgtatctgtaaaaatttttaaaaaatctttttagaataaagtagcacgtcttcggcagcaagaagaacctctgctgtttcttacgaacctcctcacaccaagttgaactccaaatcagttgctgcatcagcatgaatgaacaacaagtgtttgatgatacaaaccggaagaaatggaatcacagaatgagaaacaatactctgcaggatgagaagaaacaacactctgatgggttcaagttgtggttgataacacgtagaaaaatgaatgaacagaatagtaaaaatatttttatgcgtgaaacttttctatgtctgtattattagtggtttaataaaaaaaaggcaaggctagaaaacaacatatactaggatgaaaacccctaaaatcaattcaattctaaatttacaaaattttaaatttgatttacggttgacaataataataaggggttgttcagttccccaaaaactttttctaaaaacatcacatcgaatctttagacacatgta

SEQ ID NO: 8249 - DNA, 1501 bp, Oryza sativa
tataatatattgtggcgcagaactttcatctatggataaattgactctgaatgtgtcttatcaaaagaaaacgaaaaaagaaaatattttaaagaacacatgctagttccaaatggaatgcatatgatagcaactgcaatgtaacgaaacataggcaaatgatgtttgttcggaataaaaagcaccagaaggtttagccgtttagctaattcaaaccataaggaattgtttcctttggttttgataacattaaggtgtttgtgatgtatcataccatgcatttcaaatatcagttcaaaaaatacgcagtggaagttaagcatactacagtatcatgaatagcactgttcaaacaagaggccctaagaacgggttaagaaaatgatgaattctggaagaaaggtactttcacagcataagcgattcaatcataaacaatgaacttgatgtctgaaatcggaaaaataatcaagcaaccacacctctttacatatcaaggaacagaatagcacaaaaataatgacaggaaaggaactagggctagggaagacacaaacttgcaactttacagggcctactcaagcctgccaaaaacaacaattccagcaccatgactaattcttactggaccaagaatgctgatgaggacaagacaaggccttgagctgaacaaaagacttggcacagatttggatgcttatggtgagagggaacgcatgtagaggaatgaagcagtaacggataattcaagattgactagattacgtgggtcgaaccagagcattgcgggatctaaagcgaacaatggatgatgcctcccatcaagtaaaaagacattatctaaaaatcaagtaacaagtagaacccccacccccttccacaaaaaagaaaagaaaagaaacatttgcccccaaaatttgcagtatcaagaacattcaaggcaacaccttttatctatctattcagggttcagggtgcaggtcgttctgcaactcgcgtatacaatatttggtttcgaagagggaaagaagaagaagaagaagaagaagaagaagaagaagaagaagaagaagaagaagaagaagaagaagaagaagaagaagaagaagaagaacaagctttcctctgctgtaacgaacttgggggccgggattaccttggtggccgcctcagataggggaggatacggatccttgtggacgcatccgctccctgcctcgtgaacgccaggagctggcttgcgctggctgagatcgccgccgcggacctcggaagaaagggcgcggggacggcgagcgcccgcgcgtcctgccttgccgccgcagcccaagaaagatcgcgcaaacgaagccatgcccactcctctctttcgctgccagcgatcgcggctgcagggttaggttgggggttctggagtggagtgcgagaggtatggggaattttggacttacgccgttttagttggtggcaaaatcaatattaaagattaaagttgggtaag

SEQ ID NO: 8250 - DNA, 1501 bp, Oryza sativa
tttgagttataggcattccaatacagtgtatcaaatatagtgtcatttattctgtcatattcctttaggaagcttgtaacactatgccttggcccaactcctcttttaaaccttgcattagtcccttcacttagcgttgtgctttgaataaatgggaaaaagtcattcttgcaatagacagggatgcagctttgtcttgtatcccaaattgattgcaagtatttcacattgtgcagctcatatttatcaatcatttgtgtcacaaggtttcaaactcatgctctgtcaaacaattgttaacaatgtcttcaaattcattgtatagatctttctttgtactgtcagtgaatgtgttacctgttctctctctgcaattttcttgatatgaaataggcagttcctatgcttggttttcttgaacacttgccctattgcagatctcattgcactgtcttggtctgttattatgctaataggatctttgcctctcatagctgtcctgaatgtctcaaaaacccacttaaatgtctcagttgtctcatctcctaggaatgcacacccaaaaagacatgtgtttccatggtctgtcatcccaacaaatggagcaaacggcaagtcatatttgtttgtcttataagttgtatcaaagctgacacaatcaccatattgaccatacaacactgtcgatctgccatctgtccagaacatatttctgactttgttgttctcatctagcatgagcttgtaatagaaacctgggtcttgtgcttcttttttcttcagatactacaacacttgactcatatccttgcttcttgtttcaaagttaatcgatgcaccaacattgctaacatcctccttcgtgtagggcaatgatggcaaccctccacggagaaatgacaggatcacaatcatactcctcgttggtatgttgcattcctttagcgtcctaattgatggaataagccttgtggtctttggtccttgtggtccttctcttgcttttaggttgtttttccccttttaggacagcatcctttcagttttgcttttagcatctttcggttttgcttttagcttccctaggacagtatctagcatctcctttatgctttatttagtttggatgctctctaggacagcatcacgttcaaattttagactagtgtgggcagcaattagctagcagccatccagccagctatggctatatatatatatgtatccaacctccctcgggaaggtatggctttgtgttttgtgaatgaagaaaaccagaaaattgccccatctctagtgccatcctcttctcaatgagagtaaccattgaaattctaacatctagtatcagagccacactttcctgtaggcaaaacatctcgtgttccaccccttaccaagctcggttgagctctcagccagcagcagcagcagcacccgctgctcctccttcccctttcccttccccttctccacgcagcagccccccggaggcacgcca

SEQ ID NO: 8251 - DNA, 1501 bp, Oryza sativa
tcagttacttctaaattgtattcctatattgactttaataaatttattatgtttattctaaattttagttagttataaattcctatatggactctatactctacttctaatattccttatttttttaattccgaatttcttttttttcttaattgtatttctatatatactctatactctacctctaatattccttattttaaatttcaaatttctattatttcctaattgtatttttatatggactccatactctacttctaatattccttatttttaattccgaatttcagttatttgctaattgtatttctatatggactctatactctacttctaatattccttatttttaattccggatttcagttatttcctaattgcatttctatatggactctagtctcctattctaatatttcttatttttaattccgaatttcaactatttctaaattgtatttctatatggactctgtcttttcttttctccgattaatgtgagaatttctagaccatgagagcgaacatggaggcttctttttctattcctttaataatacaatagatatgagcaatgctaaaaagtcttataatatgaaacggaggaagtacggatttagacatgaagcttgctcagattcataatactaggttgagtcacatactcaagagtcatgtataacccaagattgctactccttccatccagatatgtagcaacccatgatgaaattagaccctatgttcagattcgtagtcgatccatcttaggttgttacatattgtgagggagtatagtatgagacggaggcaggcagtaaaaattagcaaggacaaagtgttgagagtacgaggtcaagaaaaaaataccagaaaagtggtggagcaaactgcaaaagcggacgtcatcattcatcctcgagcccctcaactgggcaccgccccccgtcgcgagtccacctcccttgacttcgactccacacagcagcgacgccacctactctctctctctgtctctcgctctcgccgtcgccgagctagttgagccgcggatggatagccccggtggtgcggcggcggcggcggcggcggcggagtccagcaatcgcgcggtgagattctgcaccccggggatccaattcttgatatttttttgttcttctttagcttgctgtgtgggattctttgtcagcttcaggcttggatgtttccaataggtcatgggagctagtatagtgtctgtatttcgttagaaagatttggatctctgggggtgttctgttttggaattgggttgtcgtttttggctgttttggtggggaatcttgtggattcttcgccatctgttgtttgttgttgccatacacatgcgagctagacatacatagtttatttactcttttagtgttttactctttcgattttgctttgctttagcggtttgagcaggcgttgttaacatgatactgctgtttaattccagttgcttgactgaata

SEQ ID NO: 8252 - DNA, 1501 bp, Oryza sativa
gaaatacttcccgtgattccctctccctttccccccatttttccctctctctctcgcgttcaaacgggcggatttgcccccgcaaatctcgccggcgccattgatggcggccgacctcccgcgccggtttccttcccctccggccgctctctcccccttccaaccctatttaaaccctccccgcacttccttcgcccgtttccaccctttgccgtgccttctcctcgccggaatcgagctcgcgccatcgcctctctctccgccgtcgccgccgagctccggttcaccgccgtcgtcgccccggaccgcctcccacctcggcgccgcctccttcggcttcaccgcatcctcgccgacctcgtccacctctctgtttcggttgccgaccgccggagcgccgctgtccccgtcgacctgagccgcgccaccgcctccctccgctccggccgcctcctccgtcgccgccgtcgccccggggtgagccgtggaccgtcgcctcctttcccccttccctcccctctctcggccgccgctccgccgcgccggtggtcgccggcggcgatcatcggggcacaggcgcgccgtctcccgccgaccgcgccggcgtggccgccctcgggtgcggctgacgtgtggggcccacggcgccggccggtgtgagcccgggtgcacctggtccaccgtggactgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcagaagatctgctcttcgtggaggttgaagccgacgtttgggaaagcgagcaaggcaagtcacatcatccttgaacatattggttcccattttataacattattttgatttaaattattgcattatcgctttatttaaattcccgcgttatcactgttttatttagccatgcctatttacctttgttatgaccttattattattgttattgatattattaccttgttcaccctagattaaacaaaaccccaactagtggacactctactcatggaaccactagtatgaatttaggtagaagcttcgctggttaattaggcaaaattaggtggttttacaactctagactttgggaatattctcatcacctggacactatggaatggatggattattgtggaattggattcacacctccccctctattcaaaatcctcaaaatggttttaggctgggctcggggtgcatggttttgatagtagcacctcggccatataaggaccggt

SEQ ID NO: 8253 - DNA, 1104 bp, Oryza sativa
taggtttgcgcgtcgacggcgctataggaggcggctgcggctaaaactcgggccaaacggaaaagcacgactaggggatgctatttataggcttggattaaggagatcgaactcggaacgagaggaatcgaagcggaaaatcctatgttttagttggagagataaactctaaacgagtttgattcttataaaatacaaggaattggtttccgattctcgggggaaacgaaagagggagataagggaaatatttcccctcaactaattttaagaatacactagagagaaggccggatttggaggagaaaaaccgagccaactcggtctcggttcggctgtcctgaggttgaagacgaacagtaacgagggagaaaagtagactttcagtctgggccggctgagaacaaagaaagaaaagacaaggggatgtagggaggaggggcggctcggcctgggccaacttgggccgagcgcacgcggccggagaagagagagggaaggctgggccgacttttggcccaaagccgaaaaggagatttaaaaaccttttctatttaaatttattcatgaaatgcaattccatttattaaaaatacttccttggctcaaatatatcccataaaaatctaggaactatagaaacaagataagtatttaccaaaattttatctagcccatttttattgatatttattaaactaaacttagatcttttcttttaggcctttaagatcatttataaaaattcaatttataatttaaggatttttaaacaagcaaagcacttatcaaaattacaaatagatcatttcatgattatcttattgattaactaattaatgaaatgttttttgtattactaaaattaataattgagctctgaaaaatctgagaaaattccagagagtataattaatcatggagaatttaataaaaattaaattcatccatgctttatatttaggaaattttatttcccacatttaacttaactcataaattaataaacatttaatataaattcatacaacaatttattaaataatttataaatcgtaagacgaaaatcacacctcgctcccgcgccggcaggtaggcccgtca

SEQ ID NO: 8254 - DNA, 305 bp, Oryza sativa
ccgaatgaaatccctcttcttcctacttgtaacgcttcgagcttcaccaggccccccccggggaaaaggggggcccttttttccccgggggaaaccccccccaaaaaaaggggcctttggggggggggccctttaaaaaaggttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagcca

SEQ ID NO: 8255 - DNA, 1501 bp, Oryza sativa
tcctgctgctcccgctgagctctcgccgccccgctgctctctccatctcgatcgacactgagtataaagagggaagagggaggagctgagtaactgacacgtgggcccaattttttttatttaggtttgtttttattttgtgccacgtaagcgtcatgtcgatgccacatgggatgaagaccaagtcaacccgtcacgtaagtgctacgtacgacgaaaccgcctccaaaaccgctgggggagttgatttgcaacggttttatgagttagacgattggttatacccggtttttgcggttgagggtgcattttaaccagacccatgagttgaggacttattcctatgctagtgccttgtttgctcttgtgggaaagtaggagggaagtttattctgctgagtcccctttgctgagagcgtcaagtcgatcttcaaccacctgtgctagctactccactgctccataggcaatcatcaatcagtaatccgttctgaaaagaagatataggtgtgcgcaatcaggaacgttctagttcgtgctagaaatcagcagctcctaagttagcatctcgatgacttaaatgctcgctgcgggcgtccggcggagatgaagtttgtgataaacttggtcatgacattcatatatgtgcctgtgtacggagtattcatcagcaaacatacacctacttctaccttatccatttggattgctcatggcggctttgatatggaatttgtaatgaacttggttatgacttatgacatactgatactcgtaacattcatagatactgacataaattcatcaactacaatagatgagatggctagtcttagtagaacagtagtctctctttccggcttgctccattggctgatgacgatgaacaactcggactcattgattccagcattatctgattctcgcatttcgaggtccggattagggtctcaccgagatgtggatagaattgccatgtcaggaattgaaggaggacgagccatatgtgcatatacatgacgggagatcaagcggccagtcaagaggctaactgcaaccctattatatacgatcagcctgctagaacacgtagcactgtcttttttgtctgaactctgaagatgaaagttcagagaaatgctcgccttatccaagccggcgatggatggaggaggaggtagccggcgcccgcctcaggcagtcgtcgcgatcacgccgccgcatcccgtcgccttggagaccgggccccgacgcggccgacgcggcgcctacgtggccatgctttattgccttatccatatccacgccatttattgtggtcgtctctcctgatcattctcattcccctgccacggtgaccgtgcccccggtgttctatatatgccccccgacgtcgaggtcattcgccacgaacacatcgatcatccatcatctacaagagatcgatcagtagtggttagcagcaactcactatcgaacacggtttcagcttacacagata

SEQ ID NO: 8256 - DNA, 1501 bp, Oryza sativa
taaaatgtgacaaaccatagttcaccttatgtaaatcaacaacgttccatcaaattagtatagttccttctcaagatcaaaagtaaacgcaaaggacggttacatagctttagtaaaagaaaataagaaaattgctgtggttggcatggggctatagtcatctggactgtgtggaaggccagaaatacagcttacttcaaaaacaagagaattaaagatcctactgaactaatacatgaaggtttttactggatcaattcctgatccattatgcagatatcggaggactagcgaagaatactgcagctggggttggcgctgctaatgagaggttgccgttaaattatactccctccgtattttgaccaacgtttgatcatttgttttattcaaattttttgtataaatatgaaaatatttatgtcatacttaaagaacatttgatgatgaatcaagtcacaataaaagaaataataattgcattttttttaataaaacgaatgatcaaacgttaaacaaaaagtcaacgtcatacattagaacataaagttagtataattcaaagatatggatgaaggtcacaagcaatgcgcttgacgtggtgcaaatctggagttattgagctttccattgcatgtctgtgattgtaccaagtcaatcgacgtttgctgttttctttgcaaatagtcctagactaagttgcttgcagttgcaggattatggtggattggtgacggagttggtgcttatggcctttgttttctgtcaggggagttgtctgctctgcaggtcatataaactctgtaaaagtgtatattggcatttcgtcgatgaaatgggagaggatctcctctcttttttcaataaaaaaaagtaaatgcaaaatatatgtccgttgcaccgatctcctttccaaaccgaaagtttccctgccggcgcttgatccgtcacaccgatgacgcgacgccggtagaggcccggtacctgttcgaacaaccaactgatgtgcggctcctccgcttgcggcttgcctcttatcaacgtatcgccgtttccgtcatgcgtgatcggtgatcgatcaccgagagagaccggacgacgagtcgagagagctcgcgcgcgcctcgatcggcgcggcggtgactcgagcagggcctgaagtagctgcacggctcaaggcggcactccatcaccggacaccggggtccagactactcgtttccgttggagaaataaccacctttatccatgttgcttatccgtgaattgcaacagcattgattgttcgcgtttaattcgcctcggccatgtaacctccgacctgatcctcttggacactataaatagaggccagttcaggcaatgcaagagcagagaagcagagtacagcaggcagctcttcttctctttgcgaaggttggctacttggccagccattaggaaacaagttagtttggagaagaagcagagttgagactgcatttgcattgctctgtagcca

SEQ ID NO: 8257 - DNA, 1501 bp, Oryza sativa
gtgctgcttggtacaggcgtacagcgctcatgacaagtagtacactactacttacttcctccgtttcacaatataagtcattctaacattttccattttatgataatgttaatgaatctaaactagctgggtggcccgcgcaattacgcggctagcacccatataaaattatatatttttaatatgattttacttcaaatttattaaatagttatctcattgtcttaagatttttaaagactacaccttattatcctcgtgtttctaatttttttagtttttaaaagtcacaacagttgctaccccttacttctttcatattattctttatttgcttacccgatctaccactattttctattcattctccttagaatctttaaaaaatggatctaaaaacttataggttttagagtctattgtcctgtttggcatctttttttataatttctagaagtcccatcaaacacttccattatacttatctatgaccgtccaccgcatcgtctctttattgtcattgctattttaaaaatcgaacataattatcgtttaggtttatattttttactttctataagttccgccaaaacgtcagcgactttatcactgtactcctctacggctcacccgctgccgcccttctttattgtcattgagattttaaaatcaaacaggattatcgttggggtttatttttttactttttagaaacccgaacctttaaaaattggagtttattgtcttgttgggtttcatttttttaataatttttagaaatcccgtcaaacgctgccactatactcctctacgacccgtctgctgcatactctttattgtcattaggattgtaaaagtcgaacataactatcgttggaattcatttttttttactttctagaaggcccaccaatcattggcaacttggccattgtactcctatacgacctgctcgctgcctctcatttttattataatcgagattttaaaaatcaaatatgattatcatttggtttatttttttactttctagaagtcccgccaaccgccttgaccgattgcttcacgacctgcctgttgtatttctttttagtcgtcattaggattctatttgcggtagtttttagatgttctatcaaccgccaccactatgctcctctataggcatgttacttaattaatctcgtcatgtgtttcaaatggtcttttcttttagtaatctttatttttttatcaccaattttagttatttataaattgtattcctagctaatatcttatttttctttttctaatttcagaatttattttatttttcgtattgtgtgcttttgatatttttatttttattttcaatttcagttgttttaaaattgtatttctactttaactctctttttaatttgcctaatttcagattatatattatttttattttgaattttagttaatctactattaggttcttatatgtactcttattttaatattgtttatattt

SEQ ID NO: 8258 - DNA, 1501 bp, Oryza sativa
gttgtcgacgtagatcctcgccagcggcgcggagtagcccttggcgaagtcgaggcgccagccgtcgaagccgaggtcggtcctgagccagttgagccagtcggtgagctcccgctggacacgcgggttgaggtggtcgatgtcgggcgcggcgccgaacccggcgccggtgtcgcggtggccgcggccgttggagtactgcgtgtcgtcgctgcagatcatgtcggggccccagtcgaggcggccgtcgggcgtgccgccctcgaacacgcagtacacgccgcggctgtccttgtagtcggcgcagcggtggttgatgacgatgtcggcgaggcactcgacgttcttgtcgtggaatgcctcgatcagcgacttgagctccgcctccgtgccgtacttggacgcgtccaggtcgtagagccgccccggcatgtaaccctgcggcgagacagagtgcgacggcggcgggagccagacgtgggtggcgcccgtgctggcgatctcctccaccttctcgtgcagaaagttgtaccacccgccttgcttcctccacgactcccagttaaacccctgcacgtacggcaaaaacacccaaacgcaacccatggtcaaatcaagcttcctgactgcggcgcgtacattatattgccgtgcaagattattattatcaagtattaacaaactttcaccaaggcgtcagtaaattaaactacctggaagagaacttgggcttgtgctaagctggacgccaggcagagcacagcaaaaacgacacaacacagggtgacatggtgcttgcccatggctacagagcaatgcaaatgcagtctcaactctgcttcttctccaaactaacttgtttcctaatggctggccaagtagccaaccttcgcaaagagaagaagagctgcctgctgtactctgcttctctgctcttgcattgcctgaactggcctctatttatagtgtccaagaggatcaggtcggaggttacatggccgaggcgaattaaacgcgaacaatcaatgctgttgcaattcacggataagcaacatggataaaggtggttatttctccaacggaaacgagtagtctggaccccggtgtccggtgatggagtgccgccttgagccgtgcagctacttcaggccctgctcgagtcaccgccgcgccgatcgaggcgcgcgcgagctctctcgactcgtcgtccggtctctctcggtgatcgatcaccgatcacgcatgacggaaacggcgatacgttgataagaggcaagccgcaagcggaggagccgcacatcagttggttgttcgaacaggtaccgggcctctaccggcgtcgcgtcatcggtgtgacggatcaagcgccggcagggaaactttcggtttggaaaggagatcggtgcaacggacatatattttgcatttacttttttttattgaaaaaagagaggagatcctctcccatttcatcgacgaaatgccaatatacacttttaca

SEQ ID NO: 8259 - DNA, 1030 bp, Oryza sativa
caagcccccctttccctccccctttttctacctttttccctctcgccggcgtcacctcctgtcgccgttttggccgctagccggagcgccagctcgccggcttgaccgtccaatgtcggttcccctctcccaaaccgacattgccgcccatttaaacccaaggcgccctcccatcgatttccccctcccgtttcgctcgccgcctccgcgccattgccgccctctgtttcgccgtcgccgttcgtcgttgcgcatgtcggaggagccggcacgagcaaggacgcggaaggggacttcggccgcgccctctccttcctcttccccagccctaggccggagagattactcccacgccgtcagcctctcgtcacagcgcccctcctcacctcggtgatgtctccctccgttcttcctcctcgctccatctcccccccttagttttcggtagtagctcgagtagcctccccgtagctagccggcgccgccccgaccgttgccgtcgctcgtagtttactcgccgccgtcgccgcccgagctccgtagcacccgctcgtcgccagcctcgctcggcgtagctccgctcaatccgacgctagcatcggattcccgtggccgcgtagatgctctcaccgccgggaatcggcccctcgtgacctcgtcgccgtttcccttctccctccccgtcggttgccgccgccgcgattcgccaccgtcgagcttcctccggcgaatccgagccgttggctcgtctcccctcgtctcgtgcaaccacccggtgtgctcgctttcgcctgtatcgccgtggttcgctccgccgctcgccgctgtcgtccgccgtccgttccggccggcgtcgtcgtctacctcccgccagcccacgttgcagccacgtaggcgccacgtcggcgccagctcagccaagaccgggtcgagccgaccccggtcagtccctccccgtgcgcgcgttccaccgcgagccgtgaggctgcgcgtgggcccgccgtatcctttccaccgcgaaccgcgcaca

SEQ ID NO: 8260 - DNA, 1501 bp, Oryza sativa
cattcatcgaattattgggaattccatctcaaaactcacaaaatcttatataaaacattgcaaaaaaaaaacacttctattgcaaaaatcttgcagataaattttctttttccaatgatgcagcttatatttatcacttaaaaaagtcatctcctgtgccgtggctccatttgctcccttttatttatttccccccatcccggttatagatcaaatccatttgaccattaaaagaagccaaaataatcaagcagtaccagatcacacaaggcatctagaaagaaagaagaaaaaaaacgatattttttttaaaagaatcaggaaaaatatatccaggaaccatggtacaaactactgaaactgttgtgcaaacttcttgatcttttgggatatttctaatttaggtttttttttgttgaattaactgaacagtggacaccttttttttcaaaaaaaatctttgaccaaatgagaatagtttaaaagaaatgaagagagctgtgacaaaagagagtaccgtcttcatgcggaagaaatggcattagaggttatacaagtggcaagtaaaaatggtctaaactttatggcaggctagtaaaaaatagtaatataaacaacaacagtctaagcaaaatttaactaaggattacaacaatccataatgatgtagtaccaatcaagctgtcagagagatctcaggctctgatgctatgttgaatctcaatccccaaatcaatgcctgtccatgggccaaatcccagggaattcgtgcaagccccgctgagctgcacatgactaggaccctatttgaaagattagcccagaactaattttgagagctaatatttagtaatgaattggtaggctaaacattagtctaggttggtatgtttggatctatgggctaattcaaggctaaaaggtagagagagagtagaaagagaggagagagaaggagagagagagctgctttttgatggtccccacacaaaattagccccattagcacttcttagagaggctaatattttgagaggggctaattcatattagctcaaaattagacaacctgtttggattcttgagagctaatttaaggctaaaaggtaagagctaaacattagcccatggaaacaaacagggccaggaatcttctaatctccctttcatgtgtccctcctttttttctccctatccccaaagatttcacattttctaatgagcatcatgccgtccatgagctctgttttttatcctaacacccctctgcagccgtgctcaccctctataaataccccatacaggtgtcttccaatagcaccaccatttggaagaatcctccccaagattgctcgatcccctcgtgtccctctctcccaacaacactgcgccacagacacaaatcacactcagatacgaaagataagtacagagagagagagagggcacggattatacactgcacacaagcatatatatatatatatcgattagccatccg

SEQ ID NO: 8261 - DNA, 1416 bp, Oryza sativa
cagaggaaacgctccaagcgccgcgcctgggcccgggagccgcgaagccacggctcgagaacttgcgttggaggagtcagagccccgcgcgtcgcctcgtctgatcggtccccccgtgcacctaccccaaatccccatctcatcgtggttgtcgtcgtccgctgctctccgccgccgccagatccggtgagctcatggccggatccaccaccgccagtggcccctcaccgtcgcgacatggggatggaggggagaggccagctgatgcgacgctcgtgaagaagggagggggagaggatccgccgccgccgatggtccctcggctgctgcgagaagaggggggagagggaagaagttggcggccagatccggcactgtcgtgggaagaggccgccgccgctcgtagagaagggagggcaagaggccaacgagctcgcggccaaatccgccgccgccgccatggggctccgccatcgccactcgttgtcccttccaccgctgccgcttgcagagaagacgcgggggagaggccggagctagatggggagcagggggagcggcgcctctgtgtcggaagaggaggcggtgccgttgagaggaggaggaggaggtgttgaatcggttggagaggaagaggataagatagaggctgctaggaagagaaaataaatgagagagagagaggatttgagaggctgacagtgtgggtctatatatagattaggggtatctgtacatttctttttgatgttagaaggtctaaaatagttaatttgttaataacaaatatcatagggactaacacataaataggtagagattgaaacacaaaaatacacttagcagtgatctccattatagatatcgtggtttttgtgtggggttatcctatgtggcaacctgagaccacagatgcttgtggtctccatgacacatacccttcgtacactttataaacggattttctatacaactgtcgacagttaacaggtgtgaaaactttcaaattttaagtcgtctaatatgctttgagatttgtggtttttgtgtggggttatcctatgtggcaacctgagaccacagatgcttgtggtctccatgacacatacccttcgtacactttataaacggattttctatacaactgtcgacagttaacaggtgtgaaaactttcaaattttaagtcgtctaatatgctttgagatttgtgctagtgaagtaaaaggggaaaaaatcagacgcatgcagcagggatcaaacccaacacctccaacttagaggtttgtccagctaaccagttgctccggcgtgcttttttgagttacactcgagttacatagtagttacaatgtatttatatagtagttacatttgaaagtttttcatccaaaaaactgtcgacagttgtatagcta

SEQ ID NO: 8262 - DNA, 1501 bp, Oryza sativa
gcctcgacgcgacgcaaacgaggtcctcgatgtcgcaggagctcactgcgcggggctcgtcgccagcggccgcgtcctcccctcgccgagtgggtcttcttccccaactgcgccgaaggtcctcgtggacaggcggcagcaatctcctccacatgctcaggcgctcagctctcgcttctctttggatagcccgacggaatcccggtatgtagcattttcattcaaatttaactaggggtaaaagttttactgtgagtaaaaattttactcgagatgacgtgaatgaatcttaaacgttcatttttttttctatggtagttttcatgtttacactatatatatggttttcaggttagtaacagatctttagcctcactgaattcactttttatgtgcatccatgtgtatatatagtatttgtgagcaccaagtttcaaacactgatggatgaagttttacacccccacgattccacgaggaccacgaccacatctgtggtcttttccctatcacttaaaatctttgatccggctttaaccaaaacaaagtggctatgatttttttttgaaaagttggcatacattgataaagtattaagtatgcataagccatcctacaaattaaatctcaattacacaatgaagtttggggctgtgaatgtagtactgtatatagttatactgtcgaatttgcacccttcttttcaaagtgtgcatgtagtttgtatgaaattttacatgataggactctatagtcgatttatttttaagaatctttacaattattctgaatatgtttaaatagtaacggaacataccattaatgtttcgaaggatttttttttctctaggacttgtccttgttcggaactttagatattctttagatttgtcagtgatctggaccactatttatccaacggtggatagaagggttgcaaacttgcaacttttcaactccaggcgatctctacccatattacgtaggagtatctacgcttaccagatgtactggggccgtccaattccatctttcaccggaaatccccgccgtacgtttggtcatctcatcggaacagggttcatctgtcgttgttactactcgttgttactcggcggattaggcatggtaaaactagcagccgcgagacaaatcctgggcgaggtcacgtacgccgccttgttcgttaccagcgaggagggaaaccaccaagagacgccaactcaaagaatcgccttgtgctctcctccgcctcctccccgttgcttgccttgctccccctacccctcgatctcttcccctggccccaccacccgtaccgcgacgcaatggccgcctcctcccctatataacccgcgtctcctccatccctcacctcgcctctgctccctccagcgttcgtccagttcgtctacctcgttgccacagccattgtcatctgtcgaagctttactggtagtgcgcgttctaggggcggtcgccgtacgggaggcggtggcaa

SEQ ID NO: 8263 - DNA, 1501 bp, Oryza sativa
attatttttgtcgtgcattttgcctccgtgcatgttcgaactggataatactaggagtactactactagccgacaaatcggcagtaaatggtaaatttccaccgtttttagtttttaccctcacctcacctagacggtgtgtcatgatgagtggttgggtcggatcggatagttgtgggttgggttcgtgctcatacatgcacccccgcgcttttggttgagggtgttgcagcagttgttattactgtgtgcaccgtgccgacgtgtctccgctttccgtcgacctcgcggccggccacgggtgtggcctccgaaaagaacagccttgttccgtagccagccagccgcagcggcggcagcgcacacgcgcggcttttgccctcgggagccgagcgcccgtgtcgcccgccccgcctgccatgccgcgcgctgtggcctgtggtgcccgtgcatgcagccgtacgtgcagccgcggcgcggcgcgttcccgttctcacttgctgctctcctctctcgtcgcaacaagcagctttggtgcaggcacctcgcctcgcacggttcatcaatgccgcggcgtgcgctccgtgcaggtggtggtgataaactgaacgtttcaactggtgataaactgtacagatggccaactctccgagggcccttcagtagcatagggattctttttagttccgatgggaaattaaccgttttctgtaataaaaaaaaagcgtgaaattcttgtaggaaggtgccccagcgaaatggatgtgtgcagatctcttttatctgggaggttttataaaggggagtagctatacaactgtcgacagttttttggatgaaaaactttcaaatgtaactactatataaatacattgtaactactatgtaactcgagtgtaactcaaaaaagcacgccggagcaactggttagctggacaaacctctaagttggaggtgttgggtttgatccctgctgcatgcgtctgattttttccccttttacttcactagcacaaatctcaaagcatattagacgacttaaaatttgaaagttttcacacctgttaactgtcgacagttgtatagaaaatccgtttataaagtgtacgaagggtatgtgtcatggagaccacaagcatctgtggtctcaggttgccacataggataaccccacacaaaaaccacaaatctcaaagcatattagacgacttaaaatttgaaagttttcacacctgttaactgtcgacagttgtatagaaaatccgtttataaagtgtacgaagggtatgtgtcatggagaccacaagcatctgtggtctcaggttgccacataggataaccccacacaaaaaccacgatatctataatggagatcactgctaagtgtatttttgtgtttcaatctctacctatttatgtgttagtccctatgatatttgttattaacaaattaactattttagaccttctaacatcaaaaagaaatgtacagataccccta

SEQ ID NO: 8264 - DNA, 747 bp, Oryza sativa
ttttagataaactttggaggcaaataagtacgaggtttcacctcatattttcttctgagttcttgtgttttcatacgtgccaatcaaatgattatatttaatttgtaacttttatgtgtcttaaaattgtagaacccaatgagcataatattttattactatgtatttttttcaattaatgtatttttaacaattaatgcatttcgaagctgctcttatcatgtacatggacgcagactcgaattgttcatgagccgagctaagccgttaaggcgcggatcgaggcatggaaaaaccaaaaagacaaaaaaaaaaaaaggaaagtgacaagccaaaattacacatgcctcccaaatatctcgccgaaatgctctctccacccccaagactcctctataaatccactcccctctacctccttccaacaaggaaggaaaaaagagaagcaaccagacactgcacacatcatcatcttctcccccgagaccgggtaagccatccccttctctctctagatcttctctctctcatcaagaacaacaagagtgaattaatgaacagcaagaacaacaacaaaaaaaacgcagaggagaggatgcatgcatgatcaatcaaattaagcttcaaggtagctagctagcttgctagctctaagctaaatacacatttaattaatttgctacgtataaaaaacgttgcaggtgatcttgggttagcttagctagctaaattaagctgcgtgcagca

SEQ ID NO: 8265 - DNA, 922 bp, Oryza sativa
  unsure (1)..(922): unsure at all n locations
aaattcccgcagcaatgcgcggggttttacctagtataaacaaaacttataactggttaagtctctctcacggtaaaacatgtctattcgaaatcaaatcctaaacttgatagctaaacttgataggagagcgtttgtatttatggttaattaaatttccagtagagtatatgtgtgcacgtttatagaatgattgtctatgcgttatgtaagcgtcttatgcgcggttgtacggtgggttgtacatattgttttttttctaaaaaaaactaagacaggattagagaggtactaatcgtgccaccgacctccttattccttcttagttaagtaggtatctactctctccgtctcataaaaaagaatttagaaccggatatgacatattatagtataataaatatggacatatgtatgtctagattcatagtattaggatgtgtcacatccaatactagcttgtttttttatgggatggagggagtataatctatcaagatcgacatattcacatggctcgctaatttcatctcttttggcgattaattctgttggccccattgggtcactcgtagcatctatatttctatatgcctatatatatatatatatatatatatatatatatatatatatatatatatattgtgtgtgttacatgtcgagttctcaagtgtacacatttccagactccagtactgtagtagttgccatatactatctccgtcctaaaatatagctatttctagcacagtacttancctaaaatgaagctatttttctacctaccttctcctctcaaccaatcacaaccattctttttcatctaccttctcttttcaaccaatcacacacctttttcaattattctcacctattttcttaatacccatgccaacctcaaaaatacttacattttaga

SEQ ID NO: 8266 - DNA, 1501 bp, Oryza sativa
aaccaatcacacacctttttcaattattctcacctattttcttaatacccatgccaacctcaaaaatacttacattttagaacggaggaagtactacgtaggagcagtagctatagctcgtcggtcatgtgcttgcacgttgcagcagccacctttccaagcgatgccaatgtccttatctgaagatctagcataacacgccggccacgtatgtgtcctccgtttctagtttatgatgaataagaaacggtttaattttgtgtgatgatgctttgttaacggctgtttggttcatcaagtaatgtaaagtttgggacatgctttagctaaatagtacttatcattctcccttttaatttacatctgggtgcatgcatgctcagctccccaggtcattagttatttgagggtggtttattaagaattgtttcagggatcagagcataactcagtggtcatcagtccatgctttgggggtttctgtccttgtcacgtcgggccaaaaataaaataaactcaagactcaaatcatacaggaattaaaatgaagaattttttaatctacgacctttagatggattcatgtacatagtacacctctagcatacgtacttcttccgttccaaaatataaaaattttgggtgaatgagagaaaattgtaaatgtcttagaaattgaacataagaccttagagataattaaaaccacacacttcttaccactgcactatcaagtgcattttagaaaatcacaagtaagtatatggcaattttacgcagatgcaccggcttaattctgacttggtgatccatcatgttctaacctggcatccgatcaaacacaatcatgcaagcatgttcctgtgcaggccatacataaattaaagtccgtacttacctgaaaaattaattaatttccagcgcacacagcctgcctcaggccctcagttagctattccactgcagaaaaggagtgtgaattaagcacaactccagagtccagacttggcgattgcgccaagctcatcactaaaatccggaattgatatgatatattcctgcttcgcttgcaaggcaacgtacgtacaaaatatatttatactttttttttctgaatcttctttaatttgaagtctagctatctaagctaagctagctaaagcttagcccggatggatcaaacacaatgcattcttgagcgacacgccgcgctagtctcgtccaatcaaaacattatcaaatcccattttaaaaaccgggagaaaattaatggaatctctccggctgatgcatatgcagctagcttgccatgttacccctccatggccgcgttgcgagtacgaactgattatataatcgcatgcccactctcgcatgccgtcctctcgatccattcatcattcgctcgctctcgctctcgctgatctctccatcttcttctccagctcagttcagtgacaagatcgatcctaaatgggcgacgatggcggcggcgtgaagg

SEQ ID NO: 8267 - DNA, 1501 bp, Oryza sativa
gcaattgctggagtcgatcgatgagcagagtttgttgttggttaactatggttgagttcagattaatgttgtttagttttagttaatgttgaatggttttgtcaaccttggagtttaattttcataacataagccctccaagacatattttacaaatgaaccttctaggtactactcccttcgtttcatgttataggttgcagctgttcggccttcgaatatggcaaccgacgtgcaacctagtccaccagcggttgcagtgctgtggtcgtcagcttttgggtcgagagcggcagtccaaatatttgcaaggccttgtccgcttccccagatccaaacagctttggtggcatgtcctcgccatcatcctgcaagccctttgcttcccttccaatagtgttttcttcgagtggtggtgtgatgctagaaagaaagttgacaaagcaaacaaactgagcttcgacaccatttgtcaccctagtagcctggataatttggaaggaatgaaacaattgggtgttcaactatgaaaggaaattatgggaggaagtagcgcaagcgtggccgcggaggtagcaacagtctagcgcgcagctgacctgcccatttgaggcgttgtccgctgatcagtcgccagacttgtcgcgagatgtagacccacgccttttgtgttcccttgtttttctttttttccttatagttaaagtttgtaaagtttaaaaatttcacctctcttaatacaaaagatacacaaggcttttgcttattctggtcaaacttttttagatttgatcggtttgtagaaaattttagcaacaaaacaacactaaactagtttcgttaaatattacattaaatttattttgaaaatatgtttgttttgtgttatctatgttgctatattttttttctataaacttgattaagctaaaataattgattagaaaaaatatcaaaataaattataatataaaacgaagatgatataacatagatattttgctagtggattaaaaaacatggcctgtacatcctagccagtttggattaacaattagttttgcataattgcatcctaagcttggtacatattttcgtttgcttcacagtatacagtccctgttagtcgttgtggataacgtcctaattaaccgagtcaaatataactagtcaacgactcgtagcaagcagccaatcagccagctggctcgcaatatctgcagaaactagtgcatcgacattgccatgtccgactcagcaatagttaagctcgtagtagtctccatatacgaccgtcaacatcaaccattgcatgcaaccaattaaagagtcaaaaaaaggctgcaatcacatcgctcctaacccatatccaactcatctttataagatccaaccattcctccccagtgaacccaagccccccacacacacttctaactagctaggtgtgatacacagcagtgacagtgagagtgagagtgagcttgagtgatcatagcca

SEQ ID NO: 8268 - DNA, 1501 bp, Oryza sativa
tattgaccgaaccttgacaccgccgttgacagacactgtgcgcaagccagcggtgacaagtcctgtgtgcactgtgccagcccgtagatgttgatgaacggcgtgtactgatccttcgtcctacccagcccaccactcccagcctgtgatgcctgcgacgttgccttgcccataaccttccctaccgccttctggaacgccttgccgttatccatcgcctgcacgttcacaagaatcaccccggcatctgtgtccgtctgcccgatgaagttctcgttctcgaaccgcatgaagcagtagtcatacctgcacgtagaataattatagttttgaagtttatcagtcgcctgaattcattgttttttcgtatgtttgtggtcatcacacttggcatatataccatattcttgagtcggattggtagttgcagctggtgaggatctggttggcggcggaggcgaggcaggcctggcagtcgctggtggagacgtcgccgcggcattgcgcgagaccgtagatgacgttgttggctttcccggcggaggacgtggcgaagccgccgccggtggagcccttggcgacgaggtcggtgaggacggagttgatgcttgccacggccttgctgttgccggccaagctgttccctgaacagtagctgccaatggagtccatggccatgctcagtgggagcaaggcaaatgacatgagcaccaagcaacggcaagctttgctactgaatgccatggctatgatcactcaagctcactctcactctcactgtcactgctgtgtatcacacctagctagttagaagtgtgtgtggggggcttgggttcactggggaggaatggttggatcttataaagatgagttggatatgggttaggagcgatgtgattgcagcctttttttgactctttaattggttgcatgcaatggttgatgttgacggtcgtatatggagactactacgagcttaactattgctgagtcggacatggcaatgtcgatgcactagtttctgcagatattgcgagccagctggctgattggctgcttgctacgagtcgttgactagttatatttgactcggttaattaggacgttatccacaacgactaacagggactgtatactgtgaagcaaacgaaaatatgtaccaagcttaggatgcaattatgcaaaactaattgttaatccaaactggctaggatgtacaggccatgttttttaatccactagcaaaatatctatgttatatcatcttcgttttatattataatttattttgatattttttctaatcaattattttagcttaatcaagtttatagaaaaaaaatatagcaacatagataacacaaaacaaacatattttcaaaataaatttaatgtaatatttaacgaaactagtttagtgttgttttgttgctaaaattttctacaaaccgatcaaatctaaaaaagtttgaccagaataagcaaaagccttgtgtatctt

SEQ ID NO: 8269 - DNA, 802 bp, Oryza sativa
gccacccccccccccttttgctgacgtcatccgggatcctttattgcgtaataaaactcattaaggcttttcttttatagtaataaacatagataatcttctaaaattcatatctaattcatccgagctccgattaagtccattcaagtctcagtaaattcataaaaatgcgtagaatccattaaaaatggttttttttttcctgtttcagtagtcttatagcctgtttgcttgtgtgctttgtttgtcgcatagatttcggtcgtttcgtcgatctgcggtttctcgaagacgttgctgtggtctcattagtgcgagagcaaggcaagtcatgcattacgattgatcaaattgtacccaatttacaaatgtcccgcatttctattaaatattgcattgttttacaatatcatgtgggatgggtcctactactcagccatatcttgtttaccttatgccattgataacttgggtattaagatgcttagatgttggtttacggaatgcttagccatacttagttcaactagtacacaatgggggaatcacattaatgcatagactttgattattggcaatagctttggattagtgctaccgcaagggtgttagttaattaaaatacactacatggtgggctgtgggtgcatggttttgctagtcgtgcccatggcgattaaggaccggttcgcgagaggccctagaagaatttatcgtacttaccacaagccagcgtgggcaacggctgggcttgtagtgtagctttcctctagccgacgtacccaggcgagggtgggcgtga

SEQ ID NO: 8270 - DNA, 1501 bp, Oryza sativa
gagatggacggtcggatcgtggggtggttggacggctcggatggggttcgcgggggcgcgatccgtgggaggggcggatgggccaatcagaggagagggaatttgggagcacgaaatttttttgcgcgtccgttttcccgcccgcgggatggttgttcttttttggggaaaaaagcagcgccacacaggcggacggtgaggtggatggcgctctgagctgtgaacacgaggatttggtgattttgtgattagtacatcttagcccttgtttatttccaatttttttcttcaaacattaaaacttttcatcacattaaaacttttctacacaccaacttctaattttttcgtcatatcgttctaattttaactaaatttccaattttgacgtgaactaaacacaccttacatgttgataaaattttggaagagaataattaaggattggatttttgtatgataacttttgaaaaaaaataaggaaagaggtggggtgagtttggaagttttgtttttttttcaccctactgttttaaactttctttttgttggttccggcctagagggaggtaacggagcgaatttaaaactataagctaaataaatgttataagtggaagtagataggataatacgacaaaagaattggaaattccttctatattggaacttctaatataacagttgcgagaaaggaaccatatccaaagaaggcaacttatgcctcaattgatttatatattgttaaggatattattgtcgtggattatctatttaattgtatagcaaatctattaaacaacccgaacatttaatttctggattaacgtacctggagaaaatgctggaggggatgatgcaagtggtgatgtacatgaccttggcgacacaccggtagattgctcattgggtaaaaaaccattgaagcgagggtcttccagcaccgccactagtccatacaagaaggttaagaaccccatggttaggataatgaggaatattcaaaccactatggatatcaattgtgatattgccaacaaggtgatgcaaggtgaatttaggttcaattccattaaggaggtgatggatttggtggtggattgtggggcagcagaaggaagtgcggagcatttcatggctacaagattatttgtgaaagctgaacatcgtgatatgttcaagactcttaccaccaaggcgggaaggctctcttggttgcagagatggtgcgagaaggaagggcagcagtagaaaactgctaattatttatatgcatgaactagttatctctgtttttactttgtcagacaatatgtattagcaagattgctacttatttattcgcatgaacttatgtattgcctggccatgtaatatggcgccttaattttgattggatgaactactgtttagtgatccatcaacatggtctttctgtgactattgaggtgatatcatttgttgcattgtttgtagatgggcatgtatggaagtgatgatg

SEQ ID NO: 8271 - DNA, 1501 bp, Oryza sativa
ttactaaacttgtctgagcaatcgaggatcaacatgctagacaatctgtcttgtacatattggcgtacgagacagtatgtttgtcaaagtcagagttgtataggctggacagttcccttgtgcaaattggcgtacatgacaatatatttgtctaggctgatgttgtacaaatcggattgtctaggccaaccagattgtttgggtgaagttgatcatcgacaggctagatagcacgcttcaatggaccgtattgtctgaattgagataggataatccaccagttgaaaggtcctcggactatccacctcttaatggcccgatagttagtttctcatcgaccgttgctacggtgtaaagggccgagctatcaaggctgaggcgatgactagtttgagtgattgggctataaataccaaatgctataaacttgcttcaagatttttgaagtaatgactagtttgagtgacatgagcaactaaggccctgtttctttcagcttaggattattataatccaacttattgagtcagattattataagctggattattataagctagaggaaaataagctgtgagcttgacggagcgtggggctcctcaccgggagaccgcgcgggcccccctttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttcccgagctccccccttcttaagtgggcaaggtcttccttttatatctcaaggggatcccacatgcaccacttctacctactcttcttttgggtggggactcaccctatcttcccaaaaaagaaaaactggcttgcgccttcgcctggaagctaaatcacaacttgtctttgagtgaggcccagcgtcatcactcgcctgacaccggggatctccctgttactccctcattaatgggcggagatttgccatggctgttgtccgaatgaccctctgatgggatgggccatacctaccttcactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgac

SEQ ID NO: 8272 - DNA, 1501 bp, Oryza sativa
gcaatcttgctaatacatattgtctgacaaagtaaaaacagagataactagttcatgcatataaataattagcagttttctactgctgcccttccttctcgcaccatctctgcaaccaagagagccttcccgccttggtggtaagagtcttgaacatatcacgatgttcagctttcacaaataatcttgtagccatgaaatgctccgcacttccttctgctgccccacaatccaccaccaaatccatcacctccttaatggaattgaacctaaattcaccttgcatcaccttgttggcaatatcacaattgatatccatagtggtttgaatattcctcattatcctaaccatggggttcttaaccttcttgtatggactagtggcggtgctggaagaccctcgcttcaatggttttttacccaatgagcaatctaccggtgtgtcgccaaggtcatgtacatcaccacttgcatcatcccctccagcattttctccaggtacgttaatccagaaattaaatgttcgggttgtttaatagatttgctatacaattaaatagataatccacgacaataatatccttaacaatatataaatcaattgaggcataagttgccttctttggatatggttcctttctcgcaactgttatattagaagttccaatatagaaggaatttccaattcttttgtcgtattatcctatctacttccacttataacatttatttagcttatagttttaaattcgctccgttacctccctctaggccggaaccaacaaaaagaaagtttaaaacagtagggtgaaaaaaaaacaaaacttccaaactcaccccacctctttccttattttttttcaaaagttatcatacaaaaatccaatccttaattattctcttccaaaattttatcaacatgtaaggtgtgtttagttcacgtcaaaattggaaatttagttaaaattagaacgatatgacgaaaaaattagaagttggtgtgtagaaaagttttaatgtgatgaaaagttttaatgtttgaagaaaaaaattggaaataaacaagggctaagatgtactaatcacaaaatcaccaaatcctcgtgttcacagctcagagcgccatccacctcaccgtccgcctgtgtggcgctgcttttttccccaaaaaagaacaaccatcccgcgggcgggaaaacggacgcgcaaaaaaatttcgtgctcccaaattccctctcctctgattggcccatccgcccctcccacggatcgcgcccccgcgaaccccatccgagccgtccaaccaccccacgatccgaccgtccatctcccctcccacggatcgacgggcccaccaccctccccttcccccaaccgtttaaatacgccaccccatcggcctcgtctcgccatcgccatatcgcattcgactaaagaaaagggaaaaaaaaatcctcctcgccttcgacagcagcagcaaccagcttagctaggctagcca

SEQ ID NO: 8273 - DNA, 1501 bp, Oryza sativa
acacctacaaatcgagagaaatgtgcttaactggtgtcagagtgttgcaagggctctagtgaattgaatgaagtgcctaggaagttcccctcctgctggttggggggggggtatttatagcccaacccaccaaaactagtctttgggggtcaaaatcccccaactctgtgctctattggtccgaccaccattgaggggcccaatctaaacggctagccgccctgaaactagttcaaaatctatatgttgggggtgcaataaatgcaatggccattagaccgctggcgaagggctggtccgaccaaccgtggcctccgtgctaccaagcaatttgggactttcacaggtctgaccaactaatgggcccgatccgaccagctcctagcctcccaggcttggtctgaccggcattgttcgtcgtgcacgacgaatgctctgtaccaagacaatttgcccgatgctatcgttgcaacaccaaaacggtactggataggctcagtccgaccggctagctctagaaataaagatcaaagccaaagatacaagaaaccctcatcatgcactaatgtgttatttagatcacctctttgtcaagattaccaccccctctaaatagtacggtaaagctataaagaaaacctagcaaattgatcacccaacgcttcgatcgttaaaaacataaccatatttatcaccttcctctcattgctttgcactatcaattttaatctgcggtagccggtaatcattcttggtatacacatcatgtggccctctcttaaattatctcactcaaataaaatagttagtccacaattagtgcttaatattaattaccaaaattaacaacgtaggcctacatgcttcactttgaccataactaaacaaacacttggaagaaaaatatggtttgagtactattgtttactccaattatatgtatatcatatccctcttaatagtgtggcatcctaaacacaagaaaaatagagcaatacatcaattaatagtcattttttcttgaatcaaaccacagggatgcctttagtcttgcatgcacttagggtgtgtttggttggtggtcatgcatggatgggatatggccatccaattttatgtttggtaaggagagtggaataaacaagatttttgtttggttggagggatgacatgtggatatggtgagtcaatttttttgtttggtaggatggatggactgttatggttaccactggataagatggtggagaatacccccattggcaaacaatttcatcttgatgcatatgtatgcttgttgcatgtattgtgagtaatatttatcatgttgtaaattaattttagccactatttataaatgataacattttcactctgtaaaattcaccctgcacacatatatcaaaatctaatacaccatcagattatacacggagatctacacagaacataacaaaaaccatcccaatcctaaaaaaacatcagatctgaagttctgaac

SEQ ID NO: 8274 - DNA, 1501 bp, Oryza sativa
gagaagcacaacgtgagtcgcccatctccacggctcactgacggatggggcccgccccctcccctccccagccagcgcacgcgctcccctcccctcgcccccgcccggccgccgccgggtttcttcctcgctggtttttttttttttgtgtttctctctgttttttttttcctctctcgctcggtgaaataaccccaactccccgcgcgcgcgcgcaggcgaagctcgaggggacggtcgccgccggcggctacgcctgcgcttgccccgcctacgcgggctgcgactaccgcggcaaggtgagatcccggttttttcgcctcccctcccggtttttttgcgcggagagagagggggtgaggatttttttttttttggttcctcaccatcttcttcctcttctccggcggcgtggggggcggctgcggcgcaggtgctgtcggcgctgcagttcgagaagcacgcgggggtgacgtcgaagaaccagaacggccacatcttcctccgcaacggccgctcgctctacgagctcttccacaagctcagggaggtgcccgccgagaaattccccgaggcattccggatggccgcgggggtgcccatgacggtgctcgccgccgcggccgccgccgccgctgaggaggcgccgcgggagcgggggcttgggccggggcctgtggcggcggagcagcccccggcctcggcgacgccccgaccgcgcccgaccatggagatgctgaccgaggaggagaaggccggtttgtctctccttggcttgaggtgagtgacctccgctgcttgactttcgtcgggaaatcgctgcgcagtagtactgtagtggtgtgatttcacggcagaggtgtatttggccttcccatggggatgaattctatagtgactgggggaattgtagggtattttgtcaaagctggaaacaatgacgtgttagattagtaaaattagtaggtagttgcaggattatgtcgggcttaattcgattttttgagcagggcaagtggctcaaggaccgaaataaattccatggacggcattgaagggcttgctacagaagcgattgggaatgcaccaagcagtgaccatgcgatgcttgatgcagaagagatggggaatgcagctgctcagcgacctaggaatagtggtctttccacaaccacaactgttaaagtgccggtgacagcacgcaataaccatgcaatgcctgatgcaaatgaggtgaggaatgctgatggtggtcggtcagcaacccttgctgttaaactggaggttacatctggcagtgaccatgcaatgtctgatgcgaaagagttgaagaatgcagattatgagcaacctagggatagtgtgctggcaacaacctctgctgttaaagtgcgaattggagcagccaatgaccatgcaatgcctgatgcggaacagacaaggaatccagttcttgagcaaccttgggatagtagcatgttaataaccgctcctgttaagg

SEQ ID NO: 8275 - DNA, 1501 bp, Oryza sativa
ccatgttggtatgttggatgttatggaaagagcgcaactcgagaatctttgatcacaaagattgcgcaacagcgcaagtttacagatccattagagatgaaatgctgatttggagggaagctgaagtgtttaagcatagagagtaccacgtgggagtttctcctggttcctgtttttctggattttctttctttctttttttgcgacgggggtgggtggggggggcttatacctttgcgacagtataatatcgttctgtaactagctcgattttttatcttcttaatgcaattcggttggtcgattttcggctgacctggcaaaatgaattcaaatccactttcgttttgaatcgaaaatgcagcgattccaccggagcaacagacaagggtggaatgggcctaaggaaaagcccagctttgatttcaggaaagtttgggcaccgcaagtagttgggctttggtcatgtaggcctattaacaatattggagttgaattcctattattttgtttctaaaaagaaatttctaactacattttttggcgagggaaatgcttaaccagttgggtgggttttgcagtgatttgaaaaaaaaataaattagttctacaggactaattaatttgtcgagtttttgtcaaaggtattgattggaatgtgtaaggtacacttaatgggacgaaagtatagataagtagtacgctctcaattatttttgtaatgggttaaactggcctttacatccagaaaggatgtatacagtgaaaatacgctctcgattaattggctagtccataatgctcattaattatgtaatgtttacagctactgcctctgtttcaggttataagattttctagcattactcatattcatatagatgttaattaatcatgcatatatgtgtgtctagattgattaacatctctataaatataggcaatgctagaaaagtcttataacctgaaacggaggaagtagcaaatatgtactactcccatatgtttacagggatgtataataagtgggtgcatgctccttgcctatatatatacagacacactagcttgttttgcctctctctcctggtctgtgcgctcaacataccaggtgcataattgggattgagatctgatgcagtagctactaggactgcacggtaactactgcacgcaatccgagccctccatgtcaaaatctaacgaccaaaaaggattcggcacagtaaaatcagaacagtacccttccacagtaaatcgctacagtgctcagatatatctgggatgtccattttaaattgtgcgatgctagtgtgactgtttatcatgcagtcatactagctactgcacctgaatcggatcccagatgcatatatgctagcttaaaacatagtagcaaaatatatagcttttcttctgtgattatttgaacgattctccataacgacatagcaaaatagttatatcagaggtaattattaaggggagagaaaagcaagct

SEQ ID NO: 8276 - DNA, 1501 bp, Oryza sativa
tttctttcatgtacttagagccaccagatttgttttattggaggtagatgatataattggcttgggaggcattggtaacatgagaagtattgggtagatagagagaagcctggcatcaattttattaggaaggaaatatgaacatactctctagtattgggaacataggatcaagccagcacaacaaatctgtccatgaattgctgaccatgcagtaggtaacatggaagaactatctactgcgaacaggcgaacggcgatgggtacatcttcgtcaacgatcttcagccagggaagtaaatatcacgctgaagggttaatttgatccatgtcactctaaatttgccgatttgaaaaaatgtcactattatttgtgatatcggctgagtgccattgggtacgagtccgggtcaggtaacggctaggttggcctgtggaatctttcacaactgaagatgcccgctcctgatcaagttacaagagacagagcagcgacgaccgaactattgtcataccggagggaacaaaaacggaattttgtaaaattgaaaccatgtcattgccgtcacatttttttttatcttcttccttcttctcttttcttcttctccccgtcagcaaactctttgatgcggcggcgcacaggcggcatgggcggcagtgtcgatgcccagatcgggacggactagggcagtgcacatcgagcatggtcgtcgtccggtccttaggtggatcgaggcagtgcagtatgacgacgggctcctacattcttcggaggcggtggggctggcaaggtctataacgacgcagatcaaaggctgacggggccagcaagctccatgctccgcccgctgtcttcagggccggctctacaattttgagggccctagggcaaacttgacaacatgatccttaacgctctctcccctatagagagacgtgttatatgtatattcacattttttgggttgttcagattaatgtcattttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagg

SEQ ID NO: 8277 - DNA, 450 bp, Oryza sativa
tattgatcacggtgaattccaattccaatgtacttctggctagcaagtcaccatccacatgcatcggacggcctgaaattaacgagcgtgcataattaattacctcgcgaactgaccgtcagggagcgagatcaaaatcaggccacatagaaaagcaggggactgggtaaggtgagtgcggcgggtgggcccggcaaaatcccccgccaccgcctctccgcgaatggggaggcggcacccacgtgagcaagccccacatgctgacatgtccccactcgatcgtcgatccccccctatttctacctcctccaccccgctgcttgtcacgctctcgttggtcgatcactccatcgatccatcgatcgatcgctagctactcgccgtcgtcgaccggtcgatccgccattagcgagctgcaaggctctctcgcttataaatcttccgagtagg

SEQ ID NO: 8278 - DNA, 1501 bp, Oryza sativa
ggctgttcttgatagatggataacgggcatagaagaaatcaaagaggaacccaagctcggcctcgaccacccggtacgccctatcgaggtcttggtcatcggcgaggagccccttgacgacgaagtcccatgacttgccttcttggaaagggagggcaaaacgaccaacatgatcgacggcaaaccttaacctgagcatcttgaagagggcgaaggacaggcataggtcccgccgccgcgccacaccttgatcccttcgaccgtcgctcaacttcagcagtttccctttgcattgccagaccttctcgacatccaccgtctccggaaccccgtaggctacctgtttgacttgctgcccgaactccaccttctccacctctttgccatcgacgaggtagatgtactccttcatggtttcggggtcatagttgcccttacaagatcggacgccggtgctgctcggtggctcatgctctatgtaatccaacacgacctggttctccttggtgagcccacgggagcgattcgtcgacaggtacgccttgaccctcaaccccaaccgcaccacgctcaagctccagatatagttggccatatggcccgaggcccgatggcccagcccatggcacgggaatttggcccggcccaagcacggcacggcccggtagcaatcgggcccatgccggcccggcatgactattgggccatgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcgccgtgtgcgcccgcatatataagccagcgagcgccgcccctcccctccccagtcccctctcgcctctcgctctccgcctctccgcctctccgcctaaccctaaccctagccgccaccgctcaaccgcctccgccgatccgcctccgacgctccaccgcccactagatctcctcctccaccgtccgccgctcactcactcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccagatccagccttcctcttcgtctctttcccttttgttcttcttcgccagatcccttggtcttctcgtagatctctgagcctatcgtcttcaacggcaactctggtgctccggctgcgcagttacaagcatggaaccatcatttttcttttttttttctccatttccgaccctaaccttgagtgttgttggctgcttgcaggtcgcaagcccgttgcttagcggcagccgccgttgagggaccagagtgcctgcga

SEQ ID NO: 8279 - DNA, 1501 bp, Oryza sativa
acgatcacatgacatgaataaatgtgcaaatgcttaagagcaagttcaataatatagccaactactatctccaattcatctatagtcaatataatagctcattcatacaatagttacatactacactattaatacttggtctcacctgtcatactcacactgtgtcttggagtccgtgctgcagctggctacaaatctgtagcctgctacccttctctctctacatttatctacttaaaatatgtttgcagctggcttagggcacccacaatagttatctataagctctctacaaaagatccatgtcagcatatttttctacttggaagagattaaatgaagcgagagagcaaagctatctactaacatggagatagtctatagagaaaaacgaggcaatggattagagagctatagatacccatgtagatatactattgaaatggtttactattaatctagtctattgctgagatgtacatattttatagatagcaccttactttactattgcgggtgctcttatagcctgctattgtacctgctctaagagatagaaatgatgttgactaaatggtcaaatgtaatgcgaatccgtgacacgagtttgaccatttggtttcctgggcaggaatgaaatggaaatactgggtgctaatcagttggcataataatccagagagttgcacgatggagcattcgttagtgttaggtacactaaaatttcagatatagctaccaaatttcctgtgttgaccattgacaattttccagacctatttgaccattgactagtaataacatgtactagtagtaagtactttcagcccagtgggttgggccggaacccaccgggccaggccgacggccagcgaagcaaagaaaagaaaaggaaaaccaaaagaccggtaggtagaccccacctgtcagtgaaagcaggcgacggcgaccgacatcccccaaattcccccatctccccgtctcggaattcgggttgtgctccactaaatccctcgctaatggcgtgctaatcccaccaccacccttgcattgcacgcggccgtataaaatcccgtgccaccgtatcattcactcctcccgtccctatcgcgtcggatcgccacccacctcgccgccgctgcttgcttcactcgcctcagatccgcgccgccgccccccgcgaatcccctctcctccccgaaccctagccccgctctcgggggttccccctcctcctccgccgcccgccgcgtccgccacttccatcggaggtattgctgctgctgctgcttctgcttctgctgctgcgttgggggggggggtgttccgatctgtgggctgtagggggatctggattccgcccgtgctgggggtgtgattttgtgtgggcatttgtttgtgatgacgggatgatgatattgttgggtgcgagcaggtgatcgatcgagcgggggtggggggagaggttgggcggcttggattggagagggctcggagtgga

SEQ ID NO: 8280 - DNA, 1501 bp, Oryza sativa
catctaacaaattcacaagcacagcatcagaacctgtcagatctgcatcaaagaagctcgcgccgagcagcttcgcgcctttgaagttcgcctgcctcagtatagactgcaacaaaaacataccaagaaaacagcataagctttgcaattgcatttgctgacaattcagatactcttctggacatagaattcagtaattcacccacaagaacagttacaatttatctacagaaatatgatcatatccgagttcaagaactgaaacagaaaggcaatgggaacaatcaaagagagtaccgtcttgaagtcctgcctgatgagcgtctggccactgaagtccttgccggtgaggtcctgcccccgtgtcacctgctgcccgtacgggcctcctcccttgaatgccagggccgggtcggcgacgaggagcgaggccgcgacgagcgcggcggcgccggcgttggcgaggtggaaatgcagggaggaggaggcggaggagcgcaccggcgtggcggagggtggggatggcgtgagcttcagactgcccaggatggtggggatggccatgatcgatcgtcgtcgattcttgatgctctccgactccggtggtcgtcggagttggtttctttgtgtttcttctttagcgacggtgtgtttatccgtcttatctgttcgtgggttgcttgctcagtcgaccaatcgttgatcgccacgtcggctgttctttcctagtataaaggaggagaaaataaaaggaatttttccagccattctgatatgattcaggttttatttttttattaaaaaatggaaatggttcactttcttgctactacaagtttcaatataattattttgcggagaaatatgttttatttgatatatcttagtgtttgtatgttcagagttactccctctgtcccataaaataccaatttagcactggatgtaacgtataattttttttagacgaagggagtcggtgaaaaagtgtgtgctaccatcataagaactacgagtaccagatttcctaaactattgaacacgttttaaattcaccactcaaatttaccttgggtttttaagcaaaaaaaaaaactttactgccactaccgtgatacttcctgcatcccaaaatatacatatttctagcacagtacattatttcaaaatgaaactatttcttcacatacgttctcctctcaaccaatcatcactattctcctttacctacttttacttatcaaccaatcacacatttcctccgattattctcacctattttttattaataaccgtaccaacctaaaaaaaatgtctacattttgggataagggaaacaatttggcaaaaagatctatgagcactcatctgtaaaaataaataattcattagggtgtaatttgtaaattgtcttgagtctttacgaacaaatccctatcctgcataccgccatcgtctctttctcgtcgtcgccggcgacgcctcccgccgccgccgagga

SEQ ID NO: 8281 - DNA, 651 bp, Oryza sativa
aggctcaactatcaggctgaagcactatttaactatctggagtaaccagttgcacaaaatccacagaagatcccgttcccgtgctctgttgccaattctcccccaccaccatgctcctcgccgcgcgcggccgccgtcaccccttcgccgccgcgcgcctccttccgatcccgctttcctccggcccctccttcgcctcctccaccaccaccacgacctccaatggcgcctgttcgtcctccgccgcggaccccgacgccgtggccgccgaggtggccaccctcctctcccgctgctccggcgactggaggctcgccgtctcctcctccgacctcccctcccgcctctcccccgccgccatctcctccctcgtccgacgacgcccgtccccctcctccccgcgcctccaccctaagctcctcctcgacttcttctactggtccagcccccagctcgcgccgtcggcccccgcccccgatgccttcgcccacctggccatgtccctgtgcgccggctcactcttcaacctggccaacggcctcctcatcaagatgatccgcgcctacccgtcacctcccgtcgtcctcgcctccatccatcgcgcgctatcggattctggccaccgttcgccggcggtgctcgacgtcctcg

SEQ ID NO: 8282 - DNA, 1501 bp, Oryza sativa
tcaatcataacccttcaccattcaaatttcttacctacatccacttttctaccaatcacaaccttctctcatttaattctacccactttcttaatacccatgtccaatcctaaaaatttttatattttaggacggaggcagcactaagcacgtaaaacgaagcaacatttagcgtgtgattaattaagtattagctatttttttttcaaaaatagataaatatgattctttaagcaactttcgtatagaaactttttgtaaaaaacacaccatttagcagtttgaaaagcgtgtgcgtgaaaaatgaggagggggagttgggaacaactgggacgcagagcaggtacaatagcagagtaatagccaactgatgaaccctgagctccactcgagactcaaggctgttctttggcccgatctttcggtgagttgatgataactacgatttgggagaagcgttgacgacccgactacaaccgtacaagacgttgttgtgttgcgccttagcgatcgatacacctctccgtgggttgttgatcttgccggtgcagatcaaccttattcctgcaagcaaatcgaagaaacaagcaagaacaagataaaagcaatctgaattgtagataggaattgaatacaaatgataggttgtggttccgtcacgagtaaactggcgatcaaaccgatcacgggattacacagcaaagtagcaaagctaaattttaatctaaacaaaacccaagaaaatctagagtggtacctaactatttaaggaggtgggaggacctctaggccttcctccacctagttgggacgcaccccacatgggccctacatgggccggggtcccaaacatagttacaagcccaaaggcccatgacaggtgatgcagcatcttgtttcttcatctgcggttgactaggatggaatttggtgatgaggctggatccgttggaaagaggactccaagagctttccatcaagtactcacgggccgaaaacggagctcgtatgcagattcggcggccgtttgaaatcagcagtgtagcaagtggccgaatcggattctagcacttagaggacttgatcttgatagcatcttgttcatccatgatgtgagcaacggttgtatccgtagtaaccatggtcacatcaccagctataaacatattttaattatataaaagatgagagagaagagcagcgggctacaaatctgtagccagctgcagcacggactctaagacgcaacgtgtgtatgacatgtgggaccatatattaacagtatagtaagtaactattgtataaattggtatagatgtattggagttagtactaggctatactattaaacttgctcaaagagatcagaggggtggcaattggtcgcgatcagccgcgggccgcccctgctccccggctgcgtgggcctcacttccacagtgcctcttcttttcggaggattctgggccaaacgttcaaacgcagaatcgccggttctcat

SEQ ID NO: 8283 - DNA, 1501 bp, Oryza sativa
gaaagcatttcaacactcagggagggaccacttgtaacatctgcaacctgaccatcacaaaagactacatccatttattcttctcatgttcttttgcccaacaatgttggaactatattgggataaattgggatctgtcactagactttatgaatatgatcatgacggcaagaaggcttttccctcaacctttctttatggaagtattaagaattggatgctggcatatttggaacagaatgtgcctatcagattttcaacaatgtgcctatcaatttcagtaaatggaaagtggactttaaagaagattttactcggcatatgcacagagtaaaagtatcagataaacccagttggcaatcatggattaacatcatcagctaattgtcttgttttctcatttctcttctctttattttctttctcttttctttctcccttgtgtatattcttcctttgtacattatgttcctttttttatattaatatagcatagtaggagcctctcctgctgtttaaaccgtcaaaaaagataaaaccaatctgaattgtagatatgtcacgtcctaaaaatcgcttaaattaataatgcatattttaaatcaattttagaaattatttcaaaagcctacaagttaaactataataatctagggaaaatttcaacataaaattgagctagataaaatttcattaaatactttgcttgtttatctattttctagatttttctgggaattatttgagcaagggaagtatttttaataaatgaaatatcatttcacaaattattttaattaaaaaagttttaaaaaccctcccctaagccgttgggccgaattaggccgaacatcctctctccccgcgcgcggccgagcggcccacgccggcccatcctgagccgctgccccgccccccctctcacaagtcaccgacatgtggggcccacatgtcggattcacccccaacctccagccggccggccgagcaagccgagcccgagccgctgcctctctccgccaaattcgcccaaaccattcgcgttcgagtccgattggttgaggggtttttatccccttgttgtcctctatcttatcccccaaaaatcggagctaattgcttcgtgatttatccgaatcaaactcgttttcgagtttatctctccaaaactaaacctagattttcccagctcgatttctctcggttggagtccgatctctccaatccaaggctataaatagcaacccctagtcgtcctcttccgtttgcctcttgtcccacgcgaaacagtcgatcgtagcgccgccaccgcgccgccctagccgccgccgccgccggccgtcgttcagccgcctcgcaccgtcgccggtcgccggaacgccgtcgccgtcgccgacccgagccgcgccgccgttagagctcaccgccggccgctgttcattgtcgtccgtcgtgtttgctagtaccggtgtgttcgcgtcgtcgttctctacgcgtaagt

SEQ ID NO: 8284 - DNA, 769 bp, Oryza sativa
taaccctacatacacatacaagccccgaatcgcgcggcggtggctcctctccttccccctgccagaaatcgcagcagcaacgaaatcagaacgaggcgcaggaagaagaaaaactcaccgaagcagaggggatgggggggcaaatctgaggtgaaccaggagcggatggatgagcagtcgaaaccctaggcgcgcggtgtggaggatcggcgggggcgggggcctgaatcagaggcgaggcgaggcgagggagcggtgggttcgcggcggcgggattccgggcgatctgctgctcctccgactccgatgagcgaaaaaattgagaagagcggaggaaggaaggaagggtgggaggaagctaagcacgccccacgccgatgcaacgaaggatggaagaagcagacagctgagagaaaaaaaaaagtcggtaataagaagaagaagaaaaagaaaattgtactgtactagtgggctcggcggatttctctctcttctgggctattgggcctgggcttgtatgtagagacggacggcccatggaagttaggcggaaaggggtgtggggcccagtgtcagcgtcagcgggggaactcgtggacaggagaagaacccgcgatgtgatgtctttcttctcactccacgcaccattttcttcttcttcttcttcgtcttcgtcaccgccagccaaccacctgacaaagcaagcaatcgagctgagcaccccaacccaaccctaggcagaggctgaggctgagcgagatcgcgggca

SEQ ID NO: 8285 - DNA, 592 bp, Oryza sativa
tcctgcagcccttccttagttctattgtatatcggtatagactctagttttctctttatatattccttattttttatttcgaatttcagttatttttaaatttcattcctatatagactctgttttttctttttctcagattaatatgagaatttttaggctatgaaagcgaacatgtattatcctaaccttgtacgatccatcggttatgaaaactacttaacgaacaattgaccttttattttgaaatctaagtaaaagaaacaacgcatgatcattattaagggtccaaaaaagagttgtttaatagtatagtagcagtagtaacgcgtaaactaagcttaattaggtagtagaattgggctaaccttgcttgcctcacttaccctcttccaattggaggcgtatgtacgtattttgtatcagtaataataggggtacgtacgcacgcatggtaactaagctacttgctagtgctatatataggggtacgtactttgctggggaaatcggaactcaatagctagcccagtacattccatcgatcaatacactacgctagcacgaacgaattagctaggaagaagatcca

SEQ ID NO: 8286 - DNA, 1501 bp, Oryza sativa
ggttttcggacacgaataaaaaaactaatttcataacttacctggaaaccgtgagacgaatcttttgagcctaattaagctgttattagcacatgcatgtgggttattgtagcacttatggctaatcatggactaattaggctcaaaagattagtctcgcgatttacatgcaaattgtgcgattagtttatctttttttatctatatttaatgctccatacatgtgtccaaagatttaatgtgatgtttttgcgaaaatgttttgggaactaaaccgagccacatggtatttgtccattaccacaccatacttgtatgatacaaatgaaccaaacggtacgttatgcgatataaatattagaaaaccaactaaaaacttaatcaaacacgaatgacgtactaaaattccggcaaaaacatctttaattttcataatatagttaaagaaataaggaatattgtaagaaaaatatagagtccatatagaaatacaatttaaaaataactaaaattaggaattaaaaaaataaatattgaaagataagtttagagtccatatggaaatataatttagaaataatagaaatcagaaattaaaataagggatattggaagaagagtatagagtttatataggaatttagaattaattaaaatatggcaaaaaataaaattaaaagtagagtttagagtccatatataaatataatttataaataactgaaattcggaattaaaaataagaaatattgtaagaagaatatagggtccatatataaatacaatttgaaaataactgaaattaggaattaaaaaaataaatattaaaagataagcttagagtccatatagaaatgcaatttaaaaataatagaaatcagaaattaaaataagggatattagaagaagagtatagagtctttataggaatttagaattaattaaaattaggaataaaaataataaaattaaaagtagagtttagagtccatatagaaatacaattggaaataataaaaattcagttttctttaaaaataatattagaagaagagtctagagttcatatagaaatataatttattaatagtaaaaattcggaattaaaaaataagtctagagttcatatagaagaataatttaaaaataactaaaattttggatttaaaataagaaatataggaataaaatttataaataatagaaattcatagttaaaaaataaagtatgttggaagatgagtctggaatccatataaaaatataatttagaaataactaaaaattgatattaaaaatagttaataactattatgtgcatacaacacgatatgaatattgcacattgatagtttgatcaagctagtacaaaatttaaattatgttattatttttaagatatcttaataataaaatgagaatatgtatatatatgctactatatgagagaaaatataaaggatatgctagccgcacaatttacgtgggtaagcatgaacca

SEQ ID NO: 8287 - DNA, 1501 bp, Oryza sativa
aaggcacaacctgaaggagagggatcagaggagcattgacctaatataaatgaaaaggcaaaatttgccctaggacatccaaaaattgtgtaattggctgggagacactgcaaatttgcgtcgctgctgatagacaccacaaaatttgtgtaatttgctataggacacccgagacaatattttatcatttcttatcaaaaagaggagagagaaatttcaaaaagacaaaatttcccttagctctatctaatccccattgctggcagccgcttcccagcgccgctcgccaaccgtcaccatcgaagccgctgtcgccagctcgctgatcatcattgaaactatcaccaccgcccgcttcccagcgctgctcgccgctgcctccgtcactgcagtcgtcgggctcgtcaaccatcatcgaagcagccgccgccgcccgctgctgcatccgccgtcacctccgccgccgcctccacaaccagcgacgacgccgcctccacaaccagcttgatggcatgcgacattgttgttgggcgtcaccgtcgggctgagtgctagatgcgtgcaggcgctgaagatcccgcatgagaagagcgcccgcagcgacggcttgagcctcgccgcgccggcgccggtgccatccgatccagcctcctgaagtcggcctggagcagccgcgctcttggcgttgttgcgctgccgagcccggctgcccttgcctgcgcagcgccgccccagcgccgccctggcctctagctctgccaccacctcccgcatgaccgtgcagcgccgccccaaccgaggcactgcaccagcccacgctgtcgccagcgctctccctctgcctcgggctcacttgaagaaatagcagagagagaaagaatgagaaagagaagaataaggaagaataaagaaaaataattcgaagggtagaaccgtacttacacagctgtttctctctcctattcctctaaaaataataaaataatgacacgggtgtccaggagctaatgtccagttttttgcgatgttctatagcaaatacgcgtttttgcggtgtcccatagctaattatacgttttttgggtgtcctgtagcaaattttgccttcttaaacccattcctatgcgatcagtgtaagcattttctgtattatgccagtaagtttttgttccagaatccaggtagatttaatacccagatttttgaaagaaagcccaaacttgctaaatagagtctttatgccagcaattttgatgcgataagatgttgttgttaggatttaggacaacttattctcagaactttagcaatatttcctaccaaattggtgagcggtgagactagacaccctttcaaggtttctattgttctctcgctgggcttatgttttttttttgttgatttgactaggatttaacagtaggaattaagcttcgagttgacaagcccatggaaaaaggaaaattaacacatggtctaagtatgatgttatgattgtttt

SEQ ID NO: 8288 - DNA, 802 bp, Oryza sativa
attcctgcagccccttgttcatactcctcattccttgactgatgtatccattcctcctgtcagaaaggaaaaaaaaaacaatcataacatcatacttagaccatgtgttaattttcctttttccatgggcttgtcaactcgaagcttaattcctactgttaaatcctagtcaaatcaacaaaaaaaaaacataagcccagcgagagaacaatagaaaccttgaaagggtgtctagtctcaccgctcaccaatttggtaggaaatattgctaaagttctgagaataagttgtcctaaatcctaacaacaacatcttatcgcatcaaaattgctggcataaagactctatttagcaagtttgggctttctttcaaaaatctgggtattaaatctacctggattctggaacaaaaacttactggcataatacagaaaatgcttacactgatcgcataggaatgggtttaagaaggcaaaatttgctacaggacacccaaaaaacgtataattagctatgggacaccgcaaaaacgcgtatttgctatagaacatcgcaaaaaactggacattagctcctggacacccgtgtcattattttattatttttagaggaataggagagagaaacagctgtgtaagtacggttctacccttcgaattatttttctttattcttccttattcttctctttctcattctttctctctctgctatttcttcaagtgagcccgaggcagagggagagcgctggcgacagcgtgggctggtgcagtgcctcggttggggcggcgctgcacggtca

SEQ ID NO: 8289 - DNA, 1501 bp, Oryza sativa
gccgttgatctgatcagcatctgatcgctgtgctggaaactgcatcgatcggtaggacgtctggatatacatatatctgcatgcagttaatacggggggaatccatcgatggatgcttccaagaaactaacttttgccggccggaatggtcgaccaaagtccaattatatgtcatcatggcatatatatgcacgccagcagatatagaataatggtcaatatataacccggtcactgcaaaatggattaatcaaagtagcacaattaacttcatttgtggtcactatcaagctagaaagaacaatgagtatatacacattcgatcggccattatatattattatattcgacggtgaccagctagccgtctgatttcagctgattgatatgatcagctgagagaccatcttgcttatcatattcttaccgaccttttcaactactaacatcgatcttccttttcttctttttagggagaaagtaacaaagcggaattaagaaaccgtgcgcgctctcaaattaaaccagcggcagctcgtagtacctaggatcatgcttggccacgaacttataattactgtgttaagtagtggcccctacagctacttgtagcttgtttcgcaaggcccttcatgcatttacttagtagtactactgattatcatatcaagggtgtctctgtcaaggatgatctgagcttgaatcgatctatgtaatcagcagtcatgcatgatgtttctgtgttggtggacgccacggttttctccctcagctcatcgtttcaaaccgaaaaaaaagaatggaatcttgatcaagattcttaagacctaattaccactacagccgcgacctcgattttgttttcttccggcctgatccaacaggcatcgcaagttaagtacgtggttttcatccccatcaattcaattctacccaaatcaagtcttatgttaacggcatgcgttggtcgtctaattcatgctgaccactaattaagttactggctagtagcttagctactgacaacattctttcttaaaaagggagatctatatacattcatatatatgtacatgtgtgtgtcgctttattaaagtggatcgatgaaccgacgaagaaattaggtaccacaaattaaaggtagcagtactgccgccattgtgccaaaaaccagctaattaaccatcggttttcactaatcaagcacaatcatgctactaattacccttttcaacctataaatttatcacggtcagatcaatttttctaattactttaaagataatataatagtagtaatcaaccctataaatacacaaggggtgcaacgaccatgcatgtatagcaaaaacacatttccaacattcggtcttcactactagctagtagtgtttttttcctacatatataaacaataattattcattgacaggcatcaagctagctagctagccaactgtctgcaagaagaagaagaagaagaaggtgcaggataaatcga

SEQ ID NO: 8290 - DNA, 504 bp, Oryza sativa
ccccctttctctccctccttttcctctttttctcccctttttcccctctcgccggcgtcacctcctgtcgccgcttgggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctctaccgtccatcgccaagcgtcgggagagccggtgcgttcgtggacgcggaaggggactccgggcgcgccctcttcttcctcttcctcggcccgaggccggagagatcactccagcgccgtcggcctctcgtcactgcgccccgtcccgcacggtagtgtccctctccgttcttcctcctcgctccatctcctccccctagctttcggtagtagcttgagtagactccccgtagttagccggcgccgccccgaccgttgccgtcg

SEQ ID NO: 8291 - DNA, 1252 bp, Oryza sativa
gctagacaacttgaaataggtcagctatcaatcggcttatatttcgtggacaagatccagaccaggggagaaatcacatcagccctcatgatggatagactcctgaacatcccagggcccccactaggcagtatggataatattgtgctagccttgatgaggagttcaacttttaaccgatggtgggcagagtggaaaaaacatctttttcaccaatcagcttccatatacctgactaacatgttctgagagatggttccgcaagtaagtattcttccttttgtcaaattctttattgctaaccgatatctcttgatatttggccacttcaattgtttgcagaccacggaatcttcacctcctcatactagccaaagtggagaaaccatctgctatgtcgttattccaattttaagctcattcaacctaagtcattttgtgatttagaagtatcttctttaaaattcaatgaagaatacaattcttagtaattaaatccgattatttaccgcgaattaattacttatagagattacccaaaataatctataattatataaaattttgcaattctacaactaaaagaaatctacaactaaccccaattattttaattttctaaacctccttaatctctccctaatttcaatttacctttcctttttcttttttctctcttcatttctttctttttctctctttttctctctctcccggcttcttcttccctctcggccctctgcctacccgggcggcgacgacgaccgaacaaggggagggggcggcggcttaccgacgacggcggcggcgacggcggcgcaaggcggggtgacacatggcgcggcggcacgaagggcggcggcgcggtggagaggaagagaggagaaaagaggggaaaaggggctggggtggtgtgggatggaagggcgaccgggggggagggttatagcgcgcggggaggggcggccggcttaatggcgacgcgacggcgcggcacgtggggctcgagacgacggcgacgggcgagcggcgcgtgacgtgacaggcggggcgactcgacgcgcgcggcggcaaggggctcggcgcgatgggacgggcggcgcggcagtggcgcagggcgacagcgacgagacggccgcgcggcggggcgcaggcgcgaaggcgacgggcggcgatgcgacggcgcgcggcgcgcgggacgcgaggtggcgggcgcgcggcgcgaggcgtgacggcgacgggcgcgcggcga

SEQ ID NO: 8292 - DNA, 1371 bp, Oryza sativa
cagcatataaccccaaataatgatacccagtaatctaagcaccacgcctaaactaccaaatattactctaatatcaccatcgtgacatagagtatttgcatatgcaaacattatacccgtaccaatgcatctcctagataagctagcagtataatcataatatctcggacatagtgtaaagctggtatttatataatcggaaagtattacaattccatagtcgtatacagaagaatattctaaattaaatactagtcttacaaaagaacaaaggaaagtaactagagccatacccgaactcttccgaagacttccggactccgactactattctgttcttactccactagcttgagagcactaaactaaacttgagagagtatgagaagcttgcttgcttgaggtgtgttggaaatggagggagtgaaggccttttatagctgaacaatgatggttggaaatgtcggtaatatcctccaaccgccatagggaagccatccacaccgtctatccaaaacctggatccaatggtgcttcggttggttctgccgaacccagcccaaactcggtcagtggcctcctcttgctctccttcacccagacttatgaattttggtccaatttgatcgtgtcaattatggtttcatggcccatctttctataagtctatttctcggcatcgtccgattgattgatcgatggttttgatgccgattcttctccatttattgctcattctctgcaagaggttagtaaaccaagcaatagtggactttattttattataacttagacgtggtgtctagtttagatattacctttgtttgttgtgtatcccatggatttgtcagaggtaggcgacaggtggtgacagccctgaatcgcgtcctagtaatcttccacattcagatacatcatagagctatagccagaaccacgctggcagaccagcaggggtcggtgcctgaagcaatagattggaaattacttcaactcagtctagataactaaaacacttagaaagtcctctctagcctagcctagcttgcttaccattagttgttgtccttagatagtcttagatttatgtagattacacacgttccctgtgttcgatatcctttaggggtcacccgaagatgaagtactacagcggtattccgtgtgcttgcagatttatctatggtcttaaggaataccaacaagcatttctagcgtcgttgccggggaacggttgctaatttttccgagtctaggtcatcctcgtatctttttttatttcttcttcttttatccctttccttgatggagcaacccacaattcaaaacctttctgctcctcaggctgatctttgtgagccatctcgttct

SEQ ID NO: 8293 - DNA, 366 bp, Oryza sativa
ccatacgcatagaaaccatctagaagtcaaatccccgaaggaaatattcaaatccgacaaaacaactcgaaaccaaaacaaactggaacctgcctgtaataccctgaaaagaaacattttagtgtcggcttcgggatggtttataatatcatggtagcatttagttaaataaataatgtcttaggagtgggccaagccaacctgggccaaagcccatgaacccaatcactcctctcccatctaaaaccctagaggaggaggggccggattccctcttccccctcgcggcgcctcttccccctccactcctctcctgtgcgtactttcttctccctctcctctccatcaaaccttgctgtccgtaga

SEQ ID NO: 8294 - DNA, 1501 bp, Oryza sativa
ccgtcgtcgccaccgctccagccgtgcgccgccgtcgctccagtcgtcgccgtcgttcgggaagaccgccgtcgtggtcgccaagtcgccgccgtcctcgtccgccccttcgccgccgccgaagaccgccggagctccgtcgccgccgccaacccgatctccgccgccgcttcttcctcgccgccggcgccgtccgttgcccttccgccgttgttttggtcaccggtgagttcgctgcgtcgccctctacccgttggtgccctccgttcgcatcgtcgagccgtcgttcgccggcgagcatgcgcgcccgagccgccgagtcgccgccggtgctgacgtcatcgctgacgtcatcgggatcgtccgccgtgagccggtcgtggaccgtttgatctcggccgtccgttttggatagggttgatctcggccgttcgtttccgtgaaccgctgccgtgcacccggtccaccgcaaaccctagccgctgacgcaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttattgaattctttttaaatgggctttaaatagatttaatcttgtaaaattcataataaattcatttgaagtcagaatgaggccgttcaagtctcacaattcatctaaaattatgatctacatgtttgtttactttttatgtactgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggcctgtttgcattgattactttattccttgataccttgggtgattataacttgactagttgagctatatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttaccttttgtatagcatgattcattgcggagcactagactgagaagtggcggag

SEQ ID NO: 8295 - DNA, 1501 bp, Oryza sativa
tagtatcgacaaagaactgccaaagggtactccagtactcagggctcctttagaactgatgaattttgcataaatcttactactagtaaaagaaaataaattactcccgccatcttagtcgcttcgttcgttcccgggtgagaaaatatctcattttctgcacgcacgcttcccaaactactaaacggtgcgtttattgtaaaaaaattctatagaaaagttgctttaaaaatcatattaatccatttttaaaatttaaaatagttaatactcaactaatcatacgctaatggctcacctcgttttgcgtatcttcccaatcttctcaatcccctcctcctcaaacacaccctaaaactctatttctagccattgattaacaaattagtggcagggataaaagatcaaagtacctcttattataagaaataggaaaagatatgaattacacccctaaactatcatggtcgatcgaattatccccctaaactcgaataccggatattttacactctcaactatacaaaccagataaataacccccctagctcaatccaaagtggttttaatcctacgtggcagtctagtcagcaattttttttataaaaaatagtgtgggccccacctataagactctccctatctatctttctcctctcacatctcaatttctctctagtctctactctctcttcctcgatcccgatccacacacacacactctctctctctctctcctccctccttgcagcgagcggcagcggctggcagagtcggagctcgcacttgcgtgaaggtggcgacggcggtggtggagccgaagctcgcatgagtggctggggcggcggggcgtggctgggtgggtgctactgtcggcggtgtgcgcagtggggaaaggggaactagtcagcggtggacgcggctgggtggtgtcacaccccgaagttctttcccaagcctaaattgaagttataaatggtctcaagaaaataccagtgtaaagcaagagtagaccttaataaattaatgcaaataataatcggaattggcatgtggaattttttttgagttctacatgtcgaaattcgctaacaagatttttagtggaattttcagagctctcgaaataattttaaccaattaaaattgagcacatgcaattttaaatcccagggaaaatcttttcctccttttctttttcttttccctccttttcctcttcttgggccgtcggcccaatccaccccgccgccgcgcgcgccctcctccttgtgggccggcccaagccgcccctccctctctccccgggacgccgacaggtgggccccacctgtcggggtcgtccccttcctccggccgcccgccccacgttgccaccaccgccgaaaccgccgccgcgcccacatccccgcctcctccgagccacgtcggccacgcccgcgcatgcgccgcgcctcccgcacccactcctcctctctcccgctcgcgcccgcgcccgaga

SEQ ID NO: 8296 - DNA, 1501 bp, Oryza sativa
tctttgatcctgcactccagaaagcaagcaagcaatgatctgaacaacttatcaaagtagtcaaaaaatgtcctaagatcagactttttcagcacagtagcaacaacagtagccagtacgacctggttgatttggcccacagtatttactagctgggattatcacttcgtttaaaggtagcaagtttaatagtatatacaactaatagctctaattcatctatagccaattaaatagctaattcataaacagttatctataaaaatatactacacctttaatatagtctcacctcccacacacataatgtattggagtccgtgctgtagctggctgcaaatatgtagcacgctttctttctctctcctcttctcatctccacgtacgtgtgcgaacagctaacttatagcctgctattgtactcgctctaatttgataggagtagtagtagtatttcattggtaagctccggcgttgggctgcacctctctccttttgctgtcggtcatggaagcatcggcgcggagccccagcgagcgacgtcggcgacgcgaagccgcacgttctcgtcgactcgacgtcgtgccgtacccggccggcgcaggggcacatgctcccgcccctcgcctcgcgccgctgctggcgtcgcgctcgccttcctcggtcgcgccacggtcacgctgctttcccgtcgtccgcgtcgcggctcctcccggccgcgtgcgtcggctttttacctccgtttccgttagcacgtttttcaaattactcaacatacggtatgtttcatacgaaaactctctataaaagttactttaaaatataaaatatatctatttttgtcaagtttgtaataattaaaacttaattaatcatttgcgaatgattttctcgtattacatgcgccaacttaatctttatctcagtgagttttaaacaccaccttatttttatgttatatgttaagtttatttcttaaattaataatttatgcctataatcaaatcgataatccgtcgtaataatctactcgacaatctaaatcaaacgaaaagaatccccttaaattgccactaaattcccactcttatgttttcacgcacacgcttttcgaactactaaacgtgtgtgtttcgaaaaaaattctataggaaagtttctttgaaatatcatactacttccgtcccaaaatataagtagttttagagtcgtgcaagggtattgaatggagaagtgttgtgattgattaagaagacaaagtacgtggagaatttaaatgttggagggttgtaattggttgaaaacaaaatataggtggagataaattgctagaagtcgttatattttaggacggggtagcattaatctattttttaaatttgtttatctaatactcccttcgttcctaattaatcatcatataatattttgaggttattcccaaatgatcacctttttaatatgcattccctaaatctttctattatctgcgtatgaaagt

SEQ ID NO: 8297 - DNA, 1501 bp, Oryza sativa
gagttttaaacaccaccttatttttatgttatatgttaagtttatttcttaaattaataatttatgcctataatcaaatcgataatccgtcgtaataatctactcgacaatctaaatcaaacgaaaagaatccccttaaattgccactaaattcccactcttatgttttcacgcacacgcttttcgaactactaaacgtgtgtgtttcgaaaaaaattctataggaaagtttctttgaaatatcatactacttccgtcccaaaatataagtagttttagagtcgtgcaagggtattgaatggagaagtgttgtgattgattaagaagacaaagtacgtggagaatttaaatgttggagggttgtaattggttgaaaacaaaatataggtggagataaattgctagaagtcgttatattttaggacggggtagcattaatctattttttaaatttgtttatctaatactcccttcgttcctaattaatcatcatataatattttgaggttattcccaaatgatcacctttttaatatgcattccctaaatctttctattatctgcgtatgaaagtaaatggacattgatacatatatatatatatatatatatatatatatatatatatatatatatatatatatatatatatatatccatgcgcacaactatatacaatcaacatgcaacattttggtttattattggttacaaaatagtcgggattacatgtaatagagtttgttaccgaagtaaatatagtacgagagaactattaacttttattaatcttggcgtactcttttaatacgatgaccaattaaaaaaatacttaattaatcatgcgttaatctactgctcatgtaaaaaagaaagataccaaccgctacaatccatcacaacctagcttctgacagaattagaagctccccaaacaacatagctagctttggtccagattttaagaaactgtaattataaaatccagaaaatgaactaggagttagaagctgtaaaacccaaccttttcagattctcagaaactggctatcaatcaattgtttctcagaacgtcagctccctacacatatcctactaaatatgaaacggaaggacagggtacctatctcgacgtcaaagtcattcgtatacaagacataaaaaaaaaaaaggtcagtcgtacaatagaagcactttcttttatcctacatggatacagcgatgacaaaaattaaatcttaaactttaattttaattttttaagaccttttattgtagtttctttttcaagattaacgtctaaatcattaataacacatatttaaaatttctaactataaattactaccggaggaccgttcgtcggcagcagccagagtctctgacgttgcatcgattgtgtttgtctaagccaattcactccagttctagtgttgaactgttgataattgggttgcacctctcgttttgctgtcggccatggacgcgcacgcaccgcccc

SEQ ID NO: 8298 - DNA, 1501 bp, Oryza sativa
gcaagctagagagacatgttactgctaatcatattgtctcgagtttgtcttgttttgattgcaagaaacaggttgttttcagtggactacgcgaagagcaccatatggaaaaaccgaggacagttttccgtgaagaaggggaggatgatgtgaccatggctactatggatacgaccattgctcacatcattaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgtgtcacctgtattgggccaatgggcttgtaactttgtttgggaccttggcccatgtggggtgcgccccaatctggtggagcacgacccttggaccctcttggtcgtcctcccacctctataaatagttaggtaccccttcttgggtttcttgggttttgatagattaaagtttagccattgctacttgcttgcagcgcgcgcgtcggctagaccgtctgtctgcttgttcttcggaaccccaacttatcattcgtatttaactcctatttgcaattcagattgcttttatcttgttcttgcttgtttcttcgatttgcttgtaggaatatggttgatttgcaccggcaagatcaacaacccacggagaggtgtatcgatcgctaaagcacaacgcaacgtcttgtacggttgtagtcgggtcatcaacgtttcttccaaatcgtagttatcatcaactcaccaaaagatcggggcaagaacagccttgagtgtcgagaggaactcagggttcatcagaagagatcaagcagggatcggatcgtgggatggcacggttagtcattgatccggcaagatcgcgcatgtaacaacctcctgtgtggagaagaataaaaggaagaagagaactcagaaaagctgcacaatattgcagcaccaaaacattgttcttctctggttttctgcattgtcgtttttcgtcagacactattcatcattctgaaaccgtcagacaagctaggatagccactgaaatcgcgtgtgtttgctgatagctccgtcgtggtctccttcatgcagcggccggcgggaagctaccaccatgtcgcctgccacgacggcttcaaggtgctccacctgccgtagaaggcggcaacgagcgacgacacccacaacgacctctagctccgccgccatgggcaggagttcgacgatgatctcgggttcacgctatgcaatgattactactcgccgccgccgaagttggtggacttcgtcgccgaccatccgtttgcctccttctagctactccacgccacgaccccttcccgtgcggccgctcctcggcgctgctgcgaccggccgcctcgc

SEQ ID NO: 8299 - DNA, 1501 bp, Oryza sativa
gcatgggtgaaaagatacggtctcacaatctccgctttcgcgaaaataccatgttactataggatttctaaaacttacatataaggacacacaagttatgatacaattattctttcattgtaatatatttatgtccgataaattgttagaagaaaatttgttgataaatatgtagctgctcaaaaaaaaaagtacctggatgatgtcgccgacgttgatgatgaaggagtgagggacgggcctgacgcgcacccactcgccgtcggatcggcggcggacgtcgaggccgccgacatcgtcctggtagagcacggtgagcgcgccggcgtccttgtggcggccgacgccgagggcgaggtcggggctcgggcagggagggtagtggttgagccggatgaaggtggtctggtcgtccttgaagaagccatggaggcggtcgggtctcaggccgaggctcctggcgatcagctccagcagcttgaacgccagctcctccaccgcttcgccgtactcctccattgcctccctgctcaagaattcgatgaggttgaactgaattgatgcgaggatgaagaagacgatcgatcgatgtggtgacctgacctgaatcccggcaggtcgtcgggccacttgttgtcgaacaccaggtcgccgtcggccacggcggtcgtcggcggcggcggcgtctggcgcgggacgaggtcgaacacctccttccagtccctgacgttcttggtgtgctcggacgcgtagtaccccatcggcgccgcctcgctccgcgccacggccgccctccgctccggcggcagcgcgaagaacgtcctctgcgcctccgccgcgcgcgccaccgcctccgcgggcacaccgtggcgcaccaccacgaagaagccccagtcccggctcgccctcccgacctccgccgcgagcgcgtccaccccgtcggcgtcgccatcgccggcggcgaggagaggggagaggtcgatgaccgggatgccgtcggcctcggcgacggacgccttggggcggtgctcgggggcctgcacgaacgcctggtccatggagaggccgcccatggtcgatcagtagctggtggcgagaagctgtagcacaagtgttcgtctcgtgtgtcagcgtgtgtgtgtgtgtgcgtgtggcttgggtttgatatcggcgaggaaaaaggacgtgcgatgggttaggttggatagctcagttcatggctggattcaatgaatctggatgggtttcagtgtgacgcacatttggcttgtgtggtggaggccttctgatcggtgcgtgttgtctgtttgttgtagtgacgtcgatggatgatcgaccgagctagagagccgagttggcgacactgcgacacaacacacgatcgacaggaaaaaggtggccggccgggttgagagaaataacacgtacggtaccgatttgcaaatgaaaaaaaaatatataaataaaacttttatacacgtgttcataacgatctaaaagt

SEQ ID NO: 8300 - DNA, 1501 bp, Oryza sativa
tagcaacagactagcccagtctttgctgtgtccagatctatccagcaaacagtttaatttactcccaaagttatttcttctttaaacttagttcagaaaaaggtatatggatcactggaatgcctgtattttcagtgggctatcttaccatgagacaatgatgaaaactgtgtgcatgtgaagacaaagctcgagatctgcggaggcagtgtccaatcctttttgagctctgaagaatgattagattcccctccatgttcgtgcaagcctctcctggtagctccttgagtttgtttattggacgacttcattgcagcaacattctctacaatacaatctcataacatctgatcctgcattaattgctaagataagcccatgtttgttcctgttttgaacataatgcagtatatacttgttttttcattgtcctttgatgcatctaaactggggatgattttctctccaatcattgaaacatgtccttgtgacacttgcctcttgagctctgattggcttgacctcttaactgtgtctgatcttggggcaagtcactatcctgtctaccaacttgtaacagctagcagttgaaatttttttctaatcctcataatgtgcacaggggttgctatcacccccagttcatctccagccgtgggcatctatttattttaagcatgatttaccatttcttaatcctgcaagttgctgtgcttccattcaaccttttgtcttttcatcaggtataaatgatcctgccataacctgcatctcttcttcaccgagcacaagtgtatcaaactatcaaacacagcacggtcctcacaccacctctaacatctctcacatccaaaacttgtatcagaaatggagtccggaggggtgatcgcggaggcggggtggagctcgctcgacatgtcgtcgcaggccgaggagtcggagatgatggcgcagctgcttggaacctgcttcccctccaatggcgaggatgatcatcaccaagagcttccttggtcggttgacacccccagtgcctactacctccattgcaatggaggtagctcaagtgcatacagctctaccactagcagcaacagtgctagtggtagcttcactctcattgcaccaagatctgagtatgaggggtactatgtgagtgactctaatgaggcggccctcgggatcagcatccaggagcaaggtgcagctcagttcatggatgccattctcaaccggaacggcgatccgggcttcgatgatctcgctgactcgagcgttaatctgctggattccatcggcgcttctaacaagagaaagattcaggagcaaggcaggctagatgaccaaacgaaagtgagttaacctgatgattttttatcatttttgcgataacagtgtattaaggctgctgtttaaattgctggtgtgcagaatttgcatgctgattttgattgaaatggatataatgcagagtaggaaatctgcgaagaaggctggctcg

SEQ ID NO: 8301 - DNA, 1501 bp, Oryza sativa
tgtcatttcagattgtccatatagaaacgcacatttaacttatgtttaaggttatgaaaagtttgcatcagatttacatcatgtattcttattgggcggatataatttagtccatatactgcaaagggcactttgtgaatagatgtacctagtccttcttcttggttcaaacatagcagtaactaggtgacgcctagtgcgttggaaatattataaatgaatatattaaattatggatagaattggattaaaatattgcgaaaatgataagttagtatgattgtatgttaagattagatttaggtgcttacattgatgtgatatacttacatgttaggttttaggattaataattgctacgcttgcatattgagttttaggtaactaaaaaggtatagatacacaaagagatgtcttgtatgagtttgcctgcattagtagccaatagaaagttttagtaatactgtgttgagtttatgatgtattgctactgcagaataattacagagacttgatatttataaatatatcatgtattcatgtgttcgccctctagcttatttttttccgaaacaccccatacaaatgcatgagagacacacccgcactacttaacccttatgagcacctccgaagactggaccgatatattaacaaagtcatcatagacgtctcgttatcgatatgtaaattgtgtaccactggaaaaataatcagtcataaatataagcaccagtgtcaagtttagacttgagacacgttccaccataagggatcttgctagcagagttatgctaagttgacgcccttttaccttcatgattggttaatgccctaccagttaatacacaaaatggagtgaaaacaccactactctcaacttaacataaacataaaacacttgggaaccactcaaaacataaatagattttaacaatctcatcctatcattggaacagaaagaagatcagaatggccatgataagaaagccaatcgaactgaccaagcaaacaagggaaaataaaactcaattgatggtcgactgttgtgctcgtcagcaaatacacaattgaatttaatgttatcgtaggattgaaaatataatttttatagcaaatgctctgtgtagttagatttgttcggactctaaaaatttcctagctccgccgcttacctgcaatggtcttgaaatctgaacaaaccataagtaaacctggccattcccatcaaagtagccttcaagaatcattgtggagtacaatatggagtagtacaatacacaagaatcattgtggagtacaatatggagtagtacaatacacaagggataaatagatctttagacaagtttacaccaagaatggtcttttttctcagcgccagtaacctcggcaccaaggtctaacatctgagcgccaatacccttgcccctagcagccaaggtgtggagcggtcggcactaaatagaccagtggcaagaacctattagtaaaatatttt

SEQ ID NO: 8302 - DNA, 1501 bp, Oryza sativa
gctatcttacttgcatcacgattgcaaacctcgcatcatccaccgtgatataaaatcaaataacattttacttgatgagaactttgaagctcatgttggtgactttggattggcaaaggtgatagacatgccatactcaaaatcaatgtctgcaattgctggttcatatggatatatagcacctggtgagtcttctactgttactttgcatacttattcctgttatagctcttatctcttttacttgaaattgcttgtaaaatcctaggctactataccacttgattgctttatactagcagaaagtacatgtgattgtttcctacaaagtactaacctagttctcctttgatcagaatatgcatacaccatgaaggttactgaaaaaagtgacatatacagttacggcgtcgtactgctggagctgctaaccggacgtgcccctgtacaaccattagaactgggaggtgatctggtaacatgggtaaagaattacatcagggacaattctttgggtccagggattcttgataagaatctgaatttggaagacaaaacgtctgtcgatcatatgattgaggtcttgaaaattgcattgctatgtactagtatgtctccatatgacagaccaccgatgcggaatgttgtagttatgttaagtgagtctagagatagggccaggatgagctcttcatcctcgcctgcttctgatcattcttcaaagaaggataacttatgatgtatttatatatgttctagtcagggcaatgcccttttgctccctctctctgtttacttatgtaggaattttttgggagtttgcattcattctttatgtcatatttctagggagataaataaaactgactcatacaaatgccattctgtacatccagtgtctctcagcatatccttcagaacaacgaagaattaccggtagagccgcagagttcttcatgggcgggatggcagttcttacttctagagtttttttatctgactttgatgtgggtttttctagttccttcttcgagttcattgcccagttgttgtaaataatagtcgatagaccaaatacctgttaatagtgttcccgtttggaaagctctgattatctccatctacggttctgcttcaagcaattcagctagtatctccatcccttcctaaagttcgcctttgataataatcatataatcactgatgttactcatgtggtattagtactaccgggggccagagtacatataggagtaccagcagaatgcagtggagaactgcagacattgcatcgatcggtaccaatgtgccatcccttcgtctttctgtactccttttgataatctgatgaagctctgctgctcaaacctggacctgtttgatcatggcgtcagtgcacagttcagttggacgaaattgaagaattggagaaaggaagcggtcacatctcggtatctcacccggtgagtggagggcgcctttccagccattcagcgcatca

SEQ ID NO: 8303 - DNA, 1501 bp, Oryza sativa
ccgcccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatggagataatcagagctttccaaacgggaacactattaacaggtatttggtctatcgactattatttacaacaactgggcaatgaactcgaagaaggaactagaaaaacccacatcaaagtcagataaaaaaactctagaagtaagaactgccatcccgcccatgaagaactctgcggctctaccggtaattcttcgttgttctgaaggatatgctgagagacactggatgtacagaatggcatttgtatgagtcagttttatttatctccctagaaatatgacataaagaatgaatgcaaactcccaaaaaattcctacataagtaaacagagagagggagcaaaagggcattgccctgactagaacatatataaatacatcataagttatccttctttgaagaatgatcagaagcaggcgaggatga

SEQ ID NO: 8304 - DNA, 1501 bp, Oryza sativa
cctccgaactgcctttcacccctataaatagccggccatttccccccttctctacatacaactcgagctctctttctctctcttttgccatgtccggccattagtgccaccgctcgatctccctcaccagagcttcgcaagccaaaccctcgcgccatcgtgttcgcctcgacgagatgattccatttttcccctttcccctctttcctatccactccatcaagccaccataaccacctcctttgcagccgaagagaagctcttctacttgccgttccggcctcctctcctaactccttcgctgggcgaccacttccccgggtgcgcgttgtccggtaacacacttggccgccgccgtcgaggccgttccaccatcggagcaccggcgccccttctctctttctctctgctgttgcacgggaagaagaagagaaggaagaagaagacgggaggaagaagagaaaaagaaaagaaaagaatctccctgacaggtgggcccatcaacagtagcctttcatatttttcttagttaattcaaatcctatcctttagaagcacatatctcctaaaccgtagatccgattccggtgaaatttggacctaaattcatcttaattcaaaagctatattttgatatcaaatttgctatttgatcattttatttgataccgtttgaatttatatttaccttttcaaatatcttcttttagctcaaattaccctttgccactaaacaaccaccgtttgaaactttacaccttccatggggacgttcgtacggtctactgaccccccgatgtcgaaccgttggttgtaaagtcagacaaaacccaaatctaaagtcgaagtgttgctcctaacaccttacgcctcaatgcgtataacgttcagagcttcactattcagtcgacctcaactgtacaccacacagttagcttttaagctctgtgtaatcctagccgctccgtcgctacccacggttgccggagtaacacttccgccccactaaacctgcacccacctcctatttctctagctgatatattgtccaacgatatcggctagagaagataccaaacttagtcgtcatactacccaattctaatgacgactagcaaatacccaaaacccttgccgatgtttatcctacctcgatatcggcttaatcaaatgaaaccctagccatccagcctgctattcaaactccataccagccatttatcctccaactacccatagcttaaacatgaaatacgagccgatatgctatcctatttcagcatcgactcgagaacaactaaaccctagccactattccaccaaagcctaatcttgattccctcttcaacctagcctccaaccaactagagcctacgcataaaatactatctcaataacccattaaagagatagttataccccaaacctagcttttctcgcctttcatcattttcttgctattttatggcttttattgaatttggttattcctcttctttaa

SEQ ID NO: 8305 - DNA, 1501 bp, Oryza sativa
atgtcatggtgttggaattcgacccaaattagtactttgctttaaaattagtagggattacctttgtgctatgtattgttggtgttaatttagtatgtgtttacttgctgcatgcacaggattaggtcgaggaaccctgcatggtcaaaattttgtccatgaatttttttattttagtgtcgagaagcctgataccatagcttgtagttagttgtttatagagcaccatggacgaaggcttgctcgggttagagggaatggatgtacttataggtcactggttttagagtagatgtttttatagggcgaatggaattaatgtgcttaacttcagattccatcaggaagatactagaaaactatttttctatgacgtaattttgcttactgtagaagtaactttaggtgtaagtggttgttaacttttaggtgtaaatgatgaggattttttttttgttgcaggctatgagttcagaaaaaatgcttggtattatcatcactgaaatttttacattttggtcctttttgaaaatttattttacaaatagacccctgaaaaaacttaaaccgggaatggtcctttttgggacgccagagaggctggcgccgtcctccaacatagcggcgccagccacaatagcgccgcggccgtgccaccgtggcaccagggcctacgtggacttgctgactcggcagagcggggcgccagccaccctggcgccgcccctcataccacagcgctagcttgtctagcgcacccctcctctgcgggccccaccaactttctcccccccaattttcgccaagtctcttctgtctccgggcaatggctggcgtccccccccagaccgcggtgccagccatcctggcgctgcccccttcccccacccgaggaccttctgcctctgggccgaggctggcggcgccctcacagaccacagcgccagggtggctggcgccgccctcctcccccccgaaacccttctgcctcgcggcactggtgtaacgccctgaaaatcgccctaaatttaaatcgtgctttaatgcatttctagaaattttaaaagcctaaaagagcttccaacaattaaaattcaccaagatttatatcaaattggcttgtgggtatttttaataaattccccatgcttaaaaatgtttaactaatttttacttgaattttcagagcatcctaaatatttttaaggcaacaaaaactattaaagaattttataaaatggaaaatataagagaagtcctcttcctcctcttgggcctcttctggcccatctctccatctctccctctcttggcccagccgccccctctccttccctctctcccctcccctccctctccttgggccagcccagctcctcccctcccgcagaccgaagtccgaagtctgttttgcctcctccgcgcgcccagccagagacagctgtgctccctctcgatgacaggtgggtcccactcgtcatccctaacctccagccatcct

SEQ ID NO: 8306 - DNA, 1501 bp, Oryza sativa
agtgatgatgtgcatgcagtgagggagatgaaaagggagttagtacaagaggggcttgatctaagtgaacatttgtcggagagtgtgcattggttgtcgtacggaggcaaccctgaatacccgacggaagtagcaggccaatatgtgaatccagatgattactttgttgtcgaattgagtggtggtcacgattctgtctcagtagaagtcaatagagaggaggttgacaaggaggcaagtgttgagcaatatgatgttgaatttgctgaagactctgatgatgactgtcacgcccggaaattcactaataatttccgaactaatttgtgcataaaaccctcgtccaggaatcagccgaggtacacaaactgacaatttaatatacaaatccatcataataataacgttacatacttacaaaagaaaagaaaaacaacagcagcggaaataacggtctagcgatggcttcagctccactcccacaggcagctcaactggggtataagccaaacgtcttctccttctggatcctttttcttcaactgagattgattgattattgcaagaatgagcatacgacatactcaacaagccacacagcaaatatgcaagtgcacaaggataccaacggatggcataatataggctcatttgcaaaagcagcatttagcaaagatttaagagaagtaaaacagtagagtaattaatcagaaattttaattaacactgaacagcacactcatgctgcacaggcccaaccatcttgaacaaccatacccggctgtacagacctaactccaaaccaggaactacacaaattattaccagttatagcatcaataattattgtgagaggtgtgagactaatcacgaaaaacattgctcaactcgtccataaccacgggcacggctattcgaatagttttactctgaccagaggtgtaccactgtacccacaagacacagcctcaacatcatgtctaccatgcgtcgcgatactggaaagtacccgaatagaggctgtgacaataccccctgcacaacacaactcaccacagtgcaccattcctggatcataatcaccccctcaaaaaccagacgcatagactccccagcgacccccacggacttctcgtcgcttctcagtctggcaccccgtaatgaatcatgctatacaaaaggtaaagccgttgcccacgctggcttgttggcacggtaaatgtttcacaatagtagctcgcgaaccggtccttaattgccatgagcacgaccttcacaaccatgtgctcacaacccaccattgacaagttttaattctcaattaattaacattacacgattaaccatcgtgagctaccattaaatataaccataattaataatatagtataattcaccccattaatgatgctaatgtttctaagcatggctaagcaattatatatatatatatatatagcatttagctgaaccaaaccaatatataaggtccaagctaatc

SEQ ID NO: 8307 - DNA, 1501 bp, Oryza sativa
gatcccttctgctcggccaatcacgagtgtcgtatattcgatcaacacataaaacatgtacactatgatcctgataattaatgtcattttatgcagctgatgatatggagttcaccattatacccgtgcgtcgcatatatcatcacccaaaattgcagtgagagcaacaactaatcgaaataagtgctcgattgatgagcagctttggaagcttcctaatgtttttgttctgttgttccggtcaaatttgcatattaattcagctatttcaaattgttgccaggtagtagttgcaatttgcgccatgttgtttttttgtgatttattaccacatcacctgttcctaagctcctcctagccatcccctcgtgtaagcgtgtgtgatagtctactggcgaagggcgcagggttcaggcattatatttaattagtcttaaaaaaaggtaaagatatatttagcgtgctttcagtaagattatatattggtggaattacaacttagcttggattaacatgcagctagtaaaaggatggagtcatgcatgtttcttttaggaaaattaatcttcttgatatatattgggtcagccatttaaattggatccaattgaaatgcattccggtcaagtatatagcatttggtgttttggtatgtggccatggattttttttaatgggttacatatatatgcgtgctgtgtgcacatcatcagttactactccctcaagtattttttaaggtagatacaaatattaagaaagtaggtgaaaatgattggaggaatgatgtgattggttgagaagagaaaataggtgaaaaattaaaagaagggttgtggttgattgagaggaaggggcatgtggagaattagctttattttggagtaagttactttattgtattagaaatagttatatttgaagatgaaagtataataagtttgtacagtattattgtgctcacgtagaaagtagcaaattggattcatcacaagatcgacagcccggctgggtagagcaatttacttggattatttaatcatgatgactactgttgtctaaatttggtcatagttggccgtttacaaactaaacaatgccagtaggtgacatgcccacatatattcttcgtaaggatctgcgtatattttccctattaattagagcatctctatggagtaggtatgaaaacgaatcagaaagggatggaaaccagctctactatattcatttttatttttcttcatcggaatcggaatcgataatacggatacgtaaacaaaatcgaatattatcaagtacagatattgagagaatacaaaataaaacgaatacgataacaaatatttatcggattagaaaatcccctcaaattgagctttttgaatcaacgaagagatatagcattatttttctaaaataaaaccaacatttctaactattgtatcgtcgatttccctatatggttatataaccgtttgtgaaaatcgaactttatagt

SEQ ID NO: 8308 - DNA, 1501 bp, Oryza sativa
ctatagttcctatcataattaaatcattaggtagcaatctatcatcaaaagcacataaataagtacttaggaacgagctcacctataaattcaattgtcgggcgcgagctctagtaattggatcttgcataacaatttgagaggtagtgtgtgtattaaaaggagtgatgtcctcatcagcgggacagtagcaccaggagagagcggcagcggcggcgttgcgtggagggagaataagcggtgatggtgcggtgcattggcagtagcgcgtgaagggagatgcgctggacagtggttggggtggaccgggggagggagtggaggtgtgtggcaacgcaaggaagagcctgattggtggagtcagcgtggggaaggtgggccttgctggtgaggccggcgggtgatgcggaaaggagggcctctgggagagtggtcggggatggggtctcagacggtggcgtggcagatccaaccgccggtgtggtggatgggggcatcgtgggatccgggcataacaaacattactatttccagaaaggtgaaataaaataaacagtatcttcaatctagacagcaagagcaagatacgtgagatggcaagtaaactatatgaggaggatgatatcttgggtgaaattaagggaccaggaagtgaaaatcagttttacatacgtgcctcttaaaggaatcgactataaagttcgattttcacaaacggttatataaccatatagggaaatcgacgatacaatagttagaaatgttggttttattttagaaaaataatgctatatctcttcgttgattcaaaaagctcaatttgaggggattttctaatccgataaatatttgttatcgtattcgttttattttgtattctctcaatatctgtacttgataatattcgattttgtttacgtatccgtattatcgattccgattccgatgaagaaaaataaaaatgaatatagtagagctggtttccatccctttctgattcgttttcatacctactccatagagatgctctaattaatagggaaaatatacgcagatccttacgaagaatatatgtgggcatgtcacctactggcattgtttagtttgtaaacggccaactatgaccaaatttagacaacagtagtcatcatgattaaataatccaagtaaattgctctacccagccgggctgtcgatcttgtgatgaatccaatttgctactttctacgtgagcacaataatactgtacaaacttattatactttcatcttcaaatataactatttctaatacaataaagtaacttactccaaaataaagctaattctccacatgccccttcctctcaatcaaccacaacccttcttttaatttttcacctattttctcttctcaaccaatcacatcattcctccaatcattttcacctactttcttaatatttgtatctaccttaaaaaatacttgagggagtagtaactgatgatgtgcacacagcacg

SEQ ID NO: 8309 - DNA, 1501 bp, Oryza sativa
aatattaatcaccattcatcctcatcttcgtcatattctatattttaatttaaaaatctactcataccatgataaataggaatcacccaatgacatagcttctgaaccggaagcacagcacattcaaatgatttaagactcatctctgtagagactgcctagctttacccacctgatgtcaacagctagctagactgaggacaacatagccactcgagagtcccacttactactagttactgcccaatgggatattgatccgtcctagcagtcgggcacttgctgggcctaagcaaggctagacggttgctgctttcacgggttccaccgttgcggatcatgtcaacctggccgaagccccttccacatgtccaccccaaacctgctcatagagccaccctacagtctttcatatagtgggacaatgtactaggctaagtctaattactcagtcctgtggatgggcgcaaattacatcattttccatggcataagagggtagtccttatatccggggaaagccaccaaaactagcataggtccgtgcatacttcaagtgtaatatacactttccacaaaatattataacaatatgcacggcctcacataccacagcatccatcttcccccggaattgttcttccatatcactccaggcgagtgagtcatatcaaataacacattttatatcacccgacacgctaccacgtgacgacgggtaaaccatgtatatgagtatagatatttggtggtcttatccactagaatattattgtgaagtatataaatctacacctaggttatcaaaggacgtgatatagcaattcatggatttggccaataataacaatgtaataatgggtaataactaaactaacaagtttattaaaaaataattcatacgcaaaataattttataaatactcaatgcagaaaataactaagtggttctctactatatttcaatatgatcaaagattggaactgtggcttgccttgtggaacgtggccttctgaagcttgagcgtagccttctaggtccacttcagttcctgtgaatccggtggaatcttcaacacgatctaacatgcgcacacgaagaaacgaccaaataagcctataataaaaatattataaataaacgataaaataaatattgtgaatcggagcccgaacaaaagaaaatgataaatcaagagttaacttgatttggatgacaaaagatttattctagggttatgattcatggtatatgtagtagcgattgcaatttgcaattaatgctatagatgacaagggtgaaaactgaaattgatttggtgttttagagctcgaacatgagaaaaacatcataatagaattgtttggactggttttactgtggttaggcactatttaggtggttttgatggtaccaataggaaacagtgctgccattcatcttcttccggtggcttttcacgtgagtaacagaggtgagagaaaagctctagagctccag

SEQ ID NO: 8310 - DNA, 1501 bp, Oryza sativa
ctcttgatttatcattttcttttgttcgggctccgattcacaatatttattttatcgtttatttataatatttttattataggcttatttggtcgtttcttcgtgtgcgcatgttagatcgtgttgaagattccaccggattcacaggaactgaagtggacctagaaggctacgctcaagcttcagaaggccacgttccacaaggcaagccacagttccaatctttgatcatattgaaatatagtagagaaccacttagttattttctgcattgagtatttataaaattattttgcgtatgaattattttttaataaacttgttagtttagttattacccattattacattgttattattggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggggaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgct

SEQ ID NO: 8311 - DNA, 1501 bp, Oryza sativa
aaaaattcgatgtgatgtttttaggaaaaaaaaatttgaaaactaattgccctagtaggttcactggcattctcattatggacagaacggtgcatatatagctcggccggcattctcattctcattcaaatcctcctcaacacaggttttctcaccattctttttctttttaataatctgtgctaagtctctcattgttccttaatattaccttatcacaactactcgccaaaatacaagacgaaatcaagatatatatagagcatgcgtggggaaaaaacattgcgagaatatccgcttaggtttctttagtatgctttttttgtgttttcctttaccttgtttctttcaccttccttgttgacattgtaaatactttcttttctgcttaatattaatataacaccagcttagccttctgtttaaaacaaacgaacaccacgacaggatcaatgataaagtgctgccgttctgtgcttattagggcctagggcaccacccttagccactttgagcaagtggcattagtgccggtgccagttctcatgatgcttcgtatagaggtgcttgattagctagggaagaagcatcgtgcggaagataatttatttattatctctcttaaatataaccattattataatgataaagtatggtcaagtacatgaacacgtttgtcctctggctgaatataagttttattccctataccccaaaatattgtaatttttggttggatgagatatatcctaataatataaatctggataagagacatgttcagactcgtagtactatgatgtcctatctaaccaaaagttgatatattttggaacggatggagtacggtattttagtaaatttagacatttaacaatggagtgattttacaaatttttaagaaggtatcaaaaatatcatatcataccttccgtattagtagaaggtactaaaattgacattaaatttaggtatcttttaaaaactgtaaaattcctcttaactatgttccagcaaactttgccgaggtgcgtccagcctgcagccggctacgacagtacgaccttctcatttctcaatgactgcctagcttctccgacctcccgctcggacctccaacggctgagattaacctgggcagacacttgcctacagcgccaacgcgcaaacagcaaccactagcaaaccgtgtacattaccgaccaagcctctctccatccatttacgctcgatcgaacggcccaaatcggcgcattactagcacggcgccacggccacgcgcagcgcgtgtacgatgccacattgccacctcgccgctagctcgctctcgcggtctcgccctcccccgcgcggccgcgcctatataaatagagagctctcgcctcgtatgatcgtatcaaactcaaccatccttgctttggctgcgtagcgtgtagcgcgcgcgaacgaacgaacacaccaagctttgctctgcttttcctctgtccaaaacagccggcca

SEQ ID NO: 8312 - DNA, 1501 bp, Oryza sativa
tgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacttggtgtaacgttggacagtgattggttaatattgattaattactacagctgttttactgctttcaactactgctttgaaatgcctgctttatacaaaagaacccctagcttcctttggttatatcttgcatcatacttcctcttccggtatgacttgttgagtacagtgggtagtactcagtcttgctctcttttcccccacaccagagttgaagttcttctcagtggagccgtctcagagaggttggcttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctagacaggaatttaatgcacattcagcttagaaattctggttcgagaattttctgagtgtgacaagttggtatcagagccgaccttgaccgtaggacaagccaactagaaacctaagagcctctgaacccttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcggaatttattcggcagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgccccgaccttcttagtctgtttgcttgccagttttcgtgtttaggtttgttgcttgtggattagtcggcggtcgatatcatatgtcagtggtatgactgcctcaattaggagttacgtgcctctttttcagtgttttaatcaagattaagataattacacttaaatttataagaaagattagtttctgagccccctgtttttcttccttttctcatatttctacctatccccttcaga

SEQ ID NO: 8313 - DNA, 1501 bp, Oryza sativa
tgtatttgggattgattgatggcagaggacacattgggagcctgacatttgcactgagcagaatggtctcttggacatccaaacccgatcgacgcatcgtcacgggccgtagtcaactcgtgtactgcaaaacacacgcccgtacgtcaaaaagcagagcaaccagagagcgccgcgcgcgcatgcacgagctaggcggagtaccgtacgtactaacacgcccacacaccggacaccgctgccgtgccgtgccggccggtaggccggcccgcgcccgggaccatcgatcgatccaacgtcgactcagccgtaccgtgcgtgaaaagggctagctatagctagggcggggccgcgctgatctgtcacgcacgcactcacggtagtctcgcccgacgagcgaacgtacgagcgccgggccggcctcaccacatgcgcccggctcgtaccgatcgaccgatgtgttttttctgtacgttaacttccttgcgtgtaattgcatgcacgcacgccgacgccaaggagatgccgcgcccgcgagggtggctggccggtgcgtgcgcgccctggtggcttggctagcgaattagcgatcgatcgcgtaagcataatcagtggatcagagacatgatgcgccttgcgaacttgaatggcatcgtatacacacatttgcgaggaatggccgatcgatcgatcaactcgactgggagacacgggaccctactttactttgtttctcagcagctagcccatggctggcctagctatagataggtgactagcgatcgatggagaggatcatccagttgctatcgtcactgttacgtgttgcacgacggacatgacaccatcggtcttctcagctagctcatactagccgtctctcaagctcaagcgttgcccggtgttaaatccatgtctcttgcacagtgacagtgtcgagtgtgagtaggattgtcggagtatatcgatcatttctgctcgaataggcttctttgactagttatgatgatcagggttcctcaaaccaccggttaccgcgcttaccgcgggagtacttcctccatccaaaaaaaagccaacctaggagcacccctccacggttagtttttttttaacggagagagtatggtataaggaaaaccgcggtaacctagctccttaaatttaaataaatttaaaaaataatttaaaattttgataaactttttacggtttgccacggttaccatgcggtaaccatgcttaccgctggggcacggtaaccccggccccagtagtttggcatgttagataatattggttctattaggatagatagaaccgaatcttcttaggagtttgttgtaactaaacacttgagataaggatgtattctgttgagatgtaaacaccacgccgggggtttttcccgtgcctatataacacgtaagcgagcctagaggaagggcatcgtttcaccgcacatggtatcagagcctccaccctccatcgcatccaatct

SEQ ID NO: 8314 - DNA, 1501 bp, Oryza sativa
gacagcaagtaactcaggacttgttgttcctgcgcaacccattgcgcaagagcaggatttgccaccttctcagtggtcttcccatcgtccttggtgatgacgatggtggcttcaggcgccttgttgctcccgtcaaggaagcccgccatctgagcgccgcgcaacgtcgctaggacctgcgccttccagagcacgaagttgctcttcgtcagcttctcagagactgattgcccatggagagcaaatggaatggagctggacgaagatgccattgatttcggagagattggatgcgatggagggtggaggctctgataccatgtgcggtgaaacgatgcccttcctctaggctcgcttacgtgttatataggcacgggaaaaacccccggcgtggtgtttacatctcaacagaatacatccttatctcaagtgtttagttacaacaaactcctaagaagattcggttctatctatcctaatagaaccaatattatctaacatgccaaactactggggccggggttaccgtgccccagcggtaagcatggttaccgcatggtaaccgtggcaaaccgtaaaaagtttatcaaaattttaaattattttttaaatttatttaaatttaaggagctaggttaccgcggttttccttataccatactctctccgttaaaaaaaaactaaccgtggaggggtgctcctaggttggcttttttttggatggaggaagtactcccgcggtaagcgcggtaaccggtggtttgaggaaccctgatcatcataactagtcaaagaagcctattcgagcagaaatgatcgatatactccgacaatcctactcacactcgacactgtcactgtgcaagagacatggatttaacaccgggcaacgcttgagcttgagagacggctagtatgagctagctgagaagaccgatggtgtcatgtccgtcgtgcaacacgtaacagtgacgatagcaactggatgatcctctccatcgatcgctagtcacctatctatagctaggccagccatgggctagctgctgagaaacaaagtaaagtagggtcccgtgtctcccagtcgagttgatcgatcgatcggccattcctcgcaaatgtgtgtatacgatgccattcaagttcgcaaggcgcatcatgtctctgatccactgattatgcttacgcgatcgatcgctaattcgctagccaagccaccagggcgcgcacgcaccggccagccaccctcgcgggcgcggcatctccttggcgtcggcgtgcgtgcatgcaattacacgcaaggaagttaacgtacagaaaaaacacatcggtcgatcggtacgagccgggcgcatgtggtgaggccggcccggcgctcgtacgttcgctcgtcgggcgagactaccgtgagtgcgtgcgtgacagatcagcgcggccccgccctagctatagctagcccttttcacgcacggtacggctgagtcgacgttggatcgatcga

SEQ ID NO: 8315 - DNA, 1501 bp, Oryza sativa
tatttctatataaactctaggcttttcttccaatattatttatttttaattcttaattttttattatttctaattgtatttctatgtggactctaaacttatcttttaatattctttaacttttaatttcgaattttagttacttctaaattgtattcctatattgaatttagactctctttttttaatttataattttagttatttgtaaattgtatttttatacgaactctaaactctacttttaattttattatgtttattccgaattttagttagttttaaattctatatggactctatactctacttctaatattccttattttaattctgaatttctattattttctaattgtatttctatatggactctatactcttcttctaatatttttttattttttaattctgaatttcagttatttataaaatgtatttctatatggactctagtctcatctttcaatattccttattttttagttccgaatttcagctatttctaaattgtatttctatatgtactctgtttttctttttctctagttaatatgagaatttctagtccatgagagcgaacgtggaggctcctttttctattcctttaataagttaatagataccgagtttaacaagtctgcacaaaaaagaaaacgtacttagtgaatttcaaaatgctaagaccccattgaaacataggaaaaaccatagaaattatagatgattttatcctatagagtcgaaacaaaggactatcacatatcaattcctttagggcattttttaatcgcaggattgagaaaacagaggaatagaaaaaatataggagttgaatgccacatttattggattcctatgggattttgtaatacaggaaagtcttcaaactgtcatttgattagcacacagaaaaaacgcaggaaccttagacacatgaataggaaaacatgaggtgagacctcatgcttattttcctccaaattgctctagtaaggttcattccataggaatttcaaaggaattgataggaaacaatcctttgtttcaaatgactctataggattatttttcataggataaaatcctctataattcctatggtttttcctttgattcaaagagggccttaaagttcctatggaatagatcttgctagagcaattttgaaggaaaataagcatgaggtctcaccttatgtttttctcttcatgtgtttacaattactgcgtttttcctatgtgctaatcaaacgagagcttggagactttcctgtgtttcaaagtcccataggaattcaataagcatggtattctattcgtacattttttttctatttatgtgttttctcaatcattttcttggtcctgtgtttcaaatgggtcttaaaatattggacaaccaagtagaaacttggtgaattcaacatcggagaaccatgggattgaaatttgaattcacgtacaccctggactaacaagtgcatgcgtctctactaaaa

SEQ ID NO: 8316 - DNA, 1501 bp, Oryza sativa
atagcattggccccgttcgatatgaccatgtcacgatcgatcgacggtacagggcactgtaaccggcgagggctgattcgctgaaaagagagcgagcagtcgctgtgcccggtcgtcggccgccagttgtacaattcgatacttgatagccggtccccgtgaacgggtgaaccgcgggccgaccggcgcccgtccgatctatctaacttcggtcgatctatcgatctcagtacgccatccatcagatccatccgcctcgatttacggctgtgaccgtggggcgttgccatccatctgttgtgcaagacaatctggtagggtcgccctgcgtctcctctaatcattcgtccataattatgcacgtacgagtgcattttagtagagacgcatgcacttgttagtccagggtgtacgtgaattcaaatttcaatcccatggttctccgatgttgaattcaccaagtttctacttggttgtccaatattttaagacccatttgaaacacaggaccaagaaaatgattgagaaaacacataaatagaaaaaaaatgtacgaatagaataccatgcttattgaattcctatgggactttgaaacacaggaaagtctccaagctctcgtttgattagcacataggaaaaacgcagtaattgtaaacacatgaagagaaaaacataaggtgagacctcatgcttattttccttcaaaattgctctagcaagatctattccataggaactttaaggccctctttgaatcaaaggaaaaaccataggaattatagaggattttatcctatgaaaaataatcctatagagtcatttgaaacaaaggattgtttcctatcaattcctttgaaattcctatggaatgaaccttactagagcaatttggaggaaaataagcatgaggtctcacctcatgttttcctattcatgtgtctaaggttcctgcgttttttctgtgtgctaatcaaatgacagtttgaagactttcctgtattacaaaatcccataggaatccaataaatgtggcattcaactcctatattttttctattcctctgttttctcaatcctgcgattaaaaaatgccctaaaggaattgatatgtgatagtcctttgtttcgactctataggataaaatcatctataatttctatggtttttcctatgtttcaatggggtcttagcattttgaaattcactaagtacgttttcttttttgtgcagacttgttaaactcggtatctattaacttattaaaggaatagaaaaaggagcctccacgttcgctctcatggactagaaattctcatattaactagagaaaaagaaaaacagagtacatatagaaatacaatttagaaatagctgaaattcggaactaaaaaataaggaatattgaaagatgagactagagtccatatagaaatacattttataaataactgaaattcagaattaaaaaataaaaaaatattagaagaagagtataga

SEQ ID NO: 8317 - DNA, 323 bp, Oryza sativa
atgaattggttcctatgccttgtctactttagatgtcagtcctatccctcgtttgcaagcgccgccccgagcttcagagtcgccgccccgaccttcttagtctgtttgcttgccagttttcgtgtttaggtttgttgcttgtggattagtcggcggtcgatatcatatgtcagtggtatgactgcctcaattaggagttacgtgcctctttttcagtgttttaatcaagattaagataattacacttaaatttataagaaagattagtttctgagccccctgtttttcttccttttctcatatttctacctatccccttcaga

SEQ ID NO: 8318 - DNA, 1476 bp, Oryza sativa
ccccctaaacctcgccggcgcatcaatggcggtcgatcttccgcgcccgtttccccctcatccggccgccctctctcactcccaaccctatataaaccctccccgtgcctccctccaccgtttccgccactcgccgctctctctccccgctggaatcgagctcgcgccgtcgccctctctctccgtcgtcgccgccgagctccggtccgccgccgttgtcgccccggaccacctctcccctcggcaccgcctccttcggcttcgccgcatccccggcgacctcgtccacccctccgtttcgctcgccgaccgccggagcaccgtcgaccccgtccacccgagctgcgccgccgccttcctccgctccggtcgccgtttccgtcgtcgccgtcgacccggggtgagctgtggaccgccgattcgtttcccctttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccagccgtcagccgcccgcgccctcgggtgcggctgacgcgtgggacccacggcgccggccggtgtgagcccgggtgcgcccggtccaccgtggactgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgcagacgctgcagcttcggaggatccgctcttcgtggaagttgaagccggcgtttgggaaagcgagcaaggcaagtcacatcatctttgaacatattgaatcccagtttataaaattatgatgatttaaattattgcattatcgctttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggt

SEQ ID NO: 8319 - DNA, 1024 bp, Oryza sativa
ggtgtaagatagatagatagatagatacattgattgatggatggattgatttagcatttttgaaaccaaataaaatgtaatttaatagaaagaaagaaagaaagaaagaaagaaagaaagaaagatagatagatagatagatagatactccctctgttccagaatataacaagttttagggttggacacagttattaagaaagtaggtagaagtgggtgatggagggttgtgattggatgagtagtggaagtaggtgggaaaagtgaatggtggagggctgtgattggttgggaagagaatgttggtagagaagttgttatattttaggacaaatccttaaggctaaaaattgttatattttggaatggagggagtagatagatagatagatagatagatagattgattgatttatggatttatggacggattgatttagcatatttgataccaaataaaatgtaatttattattcgagaatagaacaatcaggatgaaaattttcaaaaccgatggatagaagtgatattaatcaattgtacacattatgatatgacaacaaaaatattgaagcagtaattcactatcataaaacaaacaattaatcataacaatttggaaaacctatgtttagaagtggctttaatataagataacttaaggataaggataaaacataccagaaaatcctcagcttacaaaagtaattaagtcaacattaatttcttccatatataacacctatctttggtctatatatatgaaccatggatcctgaagttcacactcatcaacattcaactcaatagtcacaataagacacaaaacaaaacatagtagctcactcttcacaatatgaagcacgcccaccttggactcatgttgttctgcttggttcttctagttttctttgctatccctgcacaaatacgaggcaattatttttttttgaatttgtatgttttttcatcattttctttgcactggcaagataataaacatatgactccttatgtctctagg

SEQ ID NO: 8320 - DNA, 1501 bp, Oryza sativa
tgcaaagcagagccaagttcactagacttctttgatattattttaatattatttaaaagttttcttctcattttagccgctgaaccagtgtgcatatccctcttattttatctccgcattttataaagagctagattactagtattttaactttgtgcttaatctatcttcgacgagctagaatgataatagttctttaaggatggagggagttgtaataaatttgttagcacaatataatactctcgattataagtcgtttttactctggacaaagtcaaactgctttaaatttgactaagtttgtagaaaaatagtaatattttcaggacaagcctaccgctcgggcgaccgatttacgtgcaaaactactctaaactgatttttctcctaaattaattatccaaatcatgatccgattgcaccattaaattcgttgcaattaaatcttcaaaacaagaccacacattgatatattccgacaaaaaaaattagcttattattgaattatttttaaatgttgcacgatgttccaccaggcatatcgggaatgtttcactaagtagatcgaaaatgtttcactcgtttaaatcgggtgttgtttcaccttatataaaaacaatgtttcagcaaatagcgaaagaatgtttcagttccctgcaacattagatctatatatagtgaaacattgtgagtacactatgcgaaacatttttggtggaacaaaaaataaactaaattcccttaatagagagtttccaaaatatgttgattttttgttgcaaaagaatattttaattcactgcaacattagatctataaatagtgaaacattgtaagtatactaagtgaaacatcttttgtggaaaaaagggagagagaagtaggtgggtccagcatatacggacgtgggggaggggcggtcgctcggagtagagtattatcgatattttcaactcaagacaaatatattatggaaatatattgaactatagatttaataaaactaacttggtgttataaacattattatatttatccacaaatttaattaaatttgaagtagtttaactttgaccaaagttaaaattaacgacttttaatttgaaacggattgagtagctagttaaacaaaaggaaatagtgaagagaagacgaaatggttgagaaaattagagaggaatgtcaaggagagacgacgacgcttctcctttgtccccccgattctcaagcaccccatgcaacgcaacccgccggcgagttgaggccccacgaccaccggccaggcgtggccccacatgtcatcctcacacccggacgcgcccccgcctcgccgggatcaccccacgctcccgggagctctgcgcatggcgcgccacgtcacccaccaacacaaagcctaaacccgcgccctcccgcactttactcgtccttgtccgatcaatggcggggcttggccggagctcgcgcggcgcctccgggaagcgcggcgccgcgtcct

SEQ ID NO: 8321 - DNA, 1501 bp, Oryza sativa
tatcgccatttagaagagcatccagaacaaaacatggtatgaagtaatgcttatttatcgggggaactgacatttcaattaactgagcagaaaagggggagatctactaaacagtaaaatgccaaataagtcagagcagaggaaattttcagcatagagtagggaatacaacattacccaaaattgatatcgacatagtcgcagtacggttccacaatctttgctgcttgtaacaaaatgtcaggatcatttgcacaaaactgaacaaaaagtggacggtcctcctgtataacataccaccaattgtcacattctattttcagtatgttccataaccaatacaaagaacgattaatggattacagaggtaacaggacaataaaagctagtaattatcaaactactatctaaaataaaagctaattatcaaactactatctaatcctttgtgtagtgatatgacagatgtatcgctcggaattttctcggtaactacgaattatcaaagcatcatcaaaattattactccagtgaagaattagcttaaactactccgggcgctctaattgaaggatccaagaattgaatagaaaagaaatcgtataaaccaaccatcaaggagaatttaccttgcatgtggtgaactccatggccctgtgcttctcgttctcggagaagatgcgggagtggagcatgggcgtgtatgccccggtcgccccgtagcggcggcacagcatgcggaaggggagctccgagttgtccaccatgggcgccaccaccatcttcggggagcccagccgcctccagtgcgcccacgcgcgctccaccctctcctccgcggacaccggcggcggaggggcgggcaagggcggggcggtctcctccgcgggcgcgaccgattcggtggtgaagcagaggtcctcgtcgggatcggaggcggtggcgaggtgggcggcggccggcggcgacatggcggcgaggctagggtttacggagcggaggaggcggcggcggcgcgggttccggaggatgggagcgaatcgcatgctagtgatttgcctctgggctctggtcctggtgtgtgggccctacttgtcagtgggggagagacaagatggattccagttatatgggccttttcggcccatgaatatttatccggcccatgtagagagtagtaaaatttcatctgatctagtctgaactgaacaatttctgcaacacatgtctgaacaatttctgaaactgaactggtgtcatttcaaaatttctgcaacactttcaatttagagccatttcgaaaatgaaatttgcaattgagtaattattgaacccaacttggtgacagatgtcttgctgaattggagcttggaagcatcttgaagaaagaaaagttcatgaaaaattgacagtaattctgatgtgctcctttcatacccttgtggaaaatctatatggagtatatgtttagatgatctggattctaaagcttacagtttcc

SEQ ID NO: 8322 - DNA, 1501 bp, Oryza sativa
cacatcgaacatatatattaaaatctccacctaaatctttctttttatcaacataataatagtacggtatcactgtataagtataaattgatggcttacagttgatgatatgcaaatatattatattagttatttaaagttgttcgtttaagcttttaaaacatgcaaaaccaccattcaaaaccactttagggggggtaatatgaacgtttttgcaaagtttaaggggttgaatatccggttttaaagtttaaggtgctagatggacttccatccaaagtttaggggggtatttgaactttttcctacaagttacaatgcttcaaggtgtgtgcaacatgtaaaaaaacaaactttggtgcataactggtctctcagaattataatgattttacagatggatgaatagaagactaacaatgcaaaatccaactagttaatgtggagggaataggagttgactgcttatgtatggagttgctgtacaaatccaaggcagcattaaccaatgagataggaaggggatgatgcgtttgattcagcttattgcctgagtcgcctcatttgttaatgctgcctctccgccgcctgcctcgcccgcctctccgccgccgaccgcgccatccgccgtcgtcccggcacagccgtacgtgcgcatgccgagagagagagaggaagaacgagagagagaagagagagaggaaaaggggaagaggagtatgataggtgggtcccatattttttaataaataaaatgctgactggattgccacgcgtacgccacgtatgataaaaccgctctggattgggtcgaggggggtaatttgtccagtattgaaagtttacgggggtaatttagttgaccacgatagttcgagggggagtaattcgtactttttccttataaaaacgattttgatgtttcacttgcgacaaatttttgaacctctatctttcagtttttcggttgtaaaatcttacattaagattcatatttatgtatatccaacctacatctacactaagtaacattagattttacaacaactttttatctctcttttaaaaaaaaattaagacgggctatatctattggttaaaatttctgcaagatttaaaactataaatatgttgaaagatgaataggtgcagtcccttgtaataaaaatgatgtaaaaaaagcttgtttccattttgttgggtaatggaacccaggtacaatgggaaaaaaataatgagaaaataataaaaaaaatctctcaccatcatcctcttcctctgttttattagcagtagccagtagctagctgagctgagcctgagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggcca

SEQ ID NO: 8323 - DNA, 1324 bp, Oryza sativa
ccacctcccccatacggccatagatatgggaacatgagaggagaggtcactggtcagcttgtgtttgtgtggtgctaagcgaagctaacacagcagcaacatgtatgtacagccaggctgcaacgcgggtagccgcgacgttgggtcgccgttgcctccacacaatgtacagagcacagctgcacaggcccatgcggctagcttttaggcacgacgtgtacacatgcatcaggggactcaggatcactcatcgaactagctggaaattattatagcgttggtcgtcgttgcaaaaagcaaaagaaaacgaggattttttttccgtgaacgcttaaaagaattacatgttaatatattataaaaaaaatctgttgcacgacgcaatcagccagattggcttttgccaagggaagagaaaaacacacagccaagaaaaagggaagagaatgctatgacagttgagcgcaactctaatcagttgggagagagacagagtacactatactcccaagaaattctaaaagaagcaacgccaactaacgaccacagatgacccttggagagaatggactctacgacctcggagacggaagagagagcagagtcgaagagcatagaggaagcacatttagtattacctgttcttccgcaatatatttttttatattataaatctaagatacatatagttgtttagatttatagttagatataattatattctgggatggagggggtagtacttgttagttttagttttcactatttacgtctacaatgcgagatcgagacattcagctgtgattaagtcatctatatctataaatataagtattttctagcatccaaaatttatttataaattcaaatatttctctattactattttcccagtccaacatctcccaataattccatgtatttattgatgtgtccctgagcatgatcacttctaggcaggcaaacttctatgagcatcaaagtgatttcacttttaaccttagtgcagaggaaccttatattgattgatggatagaggaagtgcgtcattagtgcagactgcaacaaaattaacccgtacgtcagctgtgattaacaaattaaggataacaaagctagtgcacaactgtgcaatgatggatccactttatgacaacataaaacgaactacacgtcagttaacttgcgtggtcaccatccaccagaaaggaagaaaaaaaatgctgtaaaacgatcgagttgacgaactctagctagcagctggtacacatatacaatctcatttggctgctgctgatgctttttcattctgtgactcaaaagc

SEQ ID NO: 8324 - DNA, 1501 bp, Oryza sativa
tccatcatccgatgcagatcggattaaagtttttttgttctaatttctgatctgtcatcgatccagactcgattctgagtgcgcgtttggtgagagggatgctaatccgagcgacgaacagcggaaactagaactcacccgaaggagaagaggatgcagcgcgcggagatccgcgtgatccacatgaggcggcggcgccacgccggcatgggcccggcgccctcctgcgccgcccgctcccgcacgtcgacccacccgcggagcgccacccacgtggcggcgtaccccaccgcgatggagagcccgaacagcaccagcctcgccgccgccaccggcgcgcacacgagcgccctcacgagctcgtacgccccgcaccaccccggcgtcccgttgcggaacgggtcggccggggacaccccccgcggcgaccaccacgccggccgatcctccgataggaacgcgaacgggtccccccctcctccgccatcgccgccgcacaccgttggcgactcctcgtcgtcgtcgtcgtggttatggtgccccgcgtggccgttggtggtgggcgtgggcgagatggagtcggagaggagcggcgtggagagggaggcggggctagggtttcgagaagccatgggtggcggaggcgaggcgagaggaggcggaggcgggaggccagcaatggaggagagggagtaatggcttttatgaaagcgaaagcttatagcaagaggaggaaggagacgttccttttttgtggtcgtaaatctatttaatttatttctttaatcgtcttcaaataaatcctttatttatttttgcgttctatccctcgcatttctgggtttttttcttctcgcgttgcctatagtcaagggagtggtcggtggctgctagtactattttttaaaagaaaattattggtctcttttcttaactgatttataaaagttttttcttctcttcacatgtgtttataaataaataattgaggtccttattaagttgaattgagaggtttaaagaatgcttatatgtgaaggttgaattagctttgattgtgtggacgtggatgctctagtcttccctcttgtatgctaaaggattaatttagatgaaattagtctttcaacacgtaatcctaatagcctttgaaagctgacattatatgatagagcctgttgttttaccaattactgcaacgttgccgtttgtagatttttgtgcagtttataacatggagtaaatcaggaagttttcgatgtgacatgctagattaactctaaatgtgggaataatcaaatgtgacaaagggtggaatagtaagaatgctaacgtgcctggtaaaaaagagaataatacatatgctatacgtgcttctacggttcaaaaaatttcaaaattaaccactttatttttgtcactgagttccatattctagaggacaatatatttaatcttacgattgtatttcagattgcattttccgtattccaaattttac

SEQ ID NO: 8325 - DNA, 1501 bp, Oryza sativa
gtgatacagtacatattgaactagctgtagtagtttacacttcacacgcaacattttagatatacgttactgtgctctggaagtgacggttgatgacatttgcacaatggctaggaagagccatttgtgtccatcaacatggctgtgtcataagtaagcctttataaattgggtatccaaatggtgcctacattgttgtttcaccaggtggattgcattttacccagccatccggcattgcctagataatttagtgaaagcacctactgaatatttggccttaccaattgattatatgggtctactagacctttttctagaacagcatgctctgacaagttttagggtccatacccgtcaggccatcactgtttccaacgagaacatgatatttatagggaaaataactactggtgtcatcttcgtaatgcctaggaacattttgctggaatttcaggcatataattttatcctagacataagtgtttgttatactccacgcaatttatagtcttcatgttgcatcccagtgacatatgctgacaaagttcagggtttatatatatgctcgcgttttcttgtgttcagagttaaagttaatcagtttactcaaacatataggattcgtgtatgacctgaccacattaccttatcattacattttttctgtacggcattgcttgccatttagttttggaagcaatcaattctctcagtttttgaatattgctctcacctgttaagaagataatgtcccttcatcattctattaagttctctgtttaaagtttaacttactttggggttggacttggaagtgattgataaataaactttaccccttctgttcacaatttatacgcttgtgttagcttgttaggaacaattttctcatgaaatgtttcctcattatacctaagccatccaatcaccttctggacactcgtgatggttttagagcatatcccatcaagtcattctaataagtgttcctgctttgtgcagcccaagtggacccactttattctagtaaacaggtttgaagacttatccttcatttctacatctttaattggtgttattgaagcatgttttcttactgccacaattttgtgatactaggtactggactggagtagtcaagccaacattaaactacagaatttctccttaactgaagaaggtgataattagtgaacaatgacagatctataattctatatgattgcatctactaagatcaatccattcaatgtgggtgctttatttctcaatgcagatggacttcagctgctggtaagaccagaagaagtaactcacagggtaactttcttctacttaaagcccttgcaaattaactagggatattctagcttttcttgtattacaattccgaacagaagtgtccatcctttttatgccatttcttttagcattactacttgtttccaaatgagaccttatgtttcttaagcatttttttatatttccttactacaga

SEQ ID NO: 8326 - DNA, 1501 bp, Oryza sativa
aaattaaggaaactatgctcttttattcatatattaatttaaagcagcaagacattgaattcatatacataagttggaagtcgaatatatgcgcacaaattccaaattccaacgaaaccaaagtaatgaaactacttactcccttcttctaaagtctaaaacttattccattctttggtttttccaaaagtttaagtcctatttatagttattatgtgttaaattaaattattgatcagaacccaataaaccattttattacttattggttgcatgtttattggttttgtcacattgtaaataaattaattactccttggtcttggtgccaaaagaaataatccctccgtcccaaaaaaacttaattcctgggtttttgtgtctaacgtttgaccatcaatcttatctgaaataaaatgaaaaatttaaaaagataagtcatgcataaagtattatttatgttttatcatctaacaataataaaaatagtaatcataaaaaatttcatataagacggacggtcaaacgttgggcacgaaaatccaagaattgagtccttttgggatggagggagtaggtcttggacttttggatggagggagtattttcattttatctcctggcggagctaaaaagattttttgagcccaagcaaactatacttctagtatttgttatataaatttcatcatcaattcattcaataacatataaatttaatggagtttttgttggtgaacttgcgcggccacctgcgatagccaggtgtggcttcacccctgcctccacatgtctataaaaatcaagaaaatccctttttaaaaaataattttatcttctaaaagtgcataacattaaaaaattctatttgcacaataaagaagagtaaggaattaattatttgtttgaaaatttggaattgcgttgagctcaagctaaagcaaaagataccagtgcctccttattctcttctactacttaattatatcctggatactccctcaaaaaattataccctggataaatgattgcaaagaggccttatctgcccattgcaacttgtatgtgcagccgaactgtggtccccactgtttggcttattttctaataagccgttagaaaataaaaatgaatttgtagataaaacttttataaatatgttcttggtgacttaaaagccaatgttgaaaaagaaactactttgaaaatatctcaaaattatacttaaaaatttaaaatttggctttttctttagctgattaggccatccgataggagcctgtaagtgtcaactgagagcacaatcaaatgatataataagatctttagtttttctgccctacactatctgaatgtaatgctcactgatttttcatttagatggcaacgtcatgaaaaaaatcagagccgtccgtctgtacattgatctagccgttcgtacgctgtcttcagttgtaggcttgcagctaaataaagtcattttttttttgtccttcccagt

SEQ ID NO: 8327 - DNA, 1501 bp, Oryza sativa
gcatgcttccatattgtatatatagaactggttcaacaaaaatggtagtggatccaaggcgtgtgctttgaaccggagtcttcatcaaagctccaaaaatgttgaatccgatgacccaatacggccttgttctgctaatcccaagagaaaggattggaggctaatctgaagagaaaggattggaggagattgagggctttgttcggttaagcccaaaaggaaggattggaggagaaaaagattgaagaggattaagagaaagggattggagggggttaattggggttaatttcatatcataatatgtgcggaataagtcccttcaaatccccatcaattctcttatgggagggactaaccgaacaatggcctataacatctgtcaggacgggcacaacttagagatatgaactgagccagcccattctaattttcttgtgagatcaccctatcatggtggaaatttgtcaactcccatgggcttttgacttcaggccctggggtatggcctacggtgtctatggtctagatccgctccatattccgtcttcattgagccaaatgatcagatccaatgcgaaggagatctaatgcgatgatgaacctattggaatgtttccaccaaataattaaggtccttctagaactagtaaattaaaggggaaaaaacaggacttcgatatgaatgcatatgcaaaaccgatgattatgaaataaaatacaaactcatgaatggcaatttgaataaacagtaagagcttgttcactttgctaccattttcaaccttatcaagttttggcattgccaaattttggtaaggttgccaaaattttgataatgttgctaaattttagcaagatttcatatgtacttactaaaatttgggaacaactaaatgtagccaatttttttggtaactttacttaaaaaaaagtaaggttgaaaatggtagcaaagtgaacaagccataagaaaagcatagtaattggataaggcagatagacatttccaagaggttaaacctcgtgctaactttccttcggaaatctccatgcattgaggcagaaatttccaataggattcaatggtgtccaatcttttgtttcaaggaccgttttgggcaaaacaatcatatagaattcaaatccgggaggggagctaaaactggtagtacccttttcagtttcccattgccctgcttagtttctttcaacatttcagtctgtagatgccctgaaaaggaggacatgcatcagcttcagcttcatgatcaagcaaaaaagatttgcaataataaataactgtaaaagaaaaggttgtaaaatggagttgcacaaaagcaaggaaatccatctactagctaggagttggccccattgatgaatacatgctggtcggcaaggtgaggtatcctcccctttccttcatcaccattaccagacttggcatgccttccatctcacgtcccaatattttactgctccatggattagccattta

SEQ ID NO: 8328 - DNA, 1501 bp, Oryza sativa
cctttacaacgtttaggactatgtaactcttatgcttttattaaccacattaaacttctccttcgacaaagatgttagctgcacgtaaataaaggagattatcagcatgaaggtgtcgatatgttcgaggttattgatatgcgcatgaagagagtttgagtggtctaaaaaaagataaatatatagcgtagagtgaaaagatgaagtaaagagtggtgtagagtaaattttagataataaaagatagtacaaaatataattcactttataaaatataaatcttgttcttcaatctagtcaacatgtgaaagccaaagtgagatatatatgctgtacactacatcgaagatatacgtgagtgttattttgtggctagtccataagcaatagctattttaattttagtgtcatgttatatgatatctaaacttgaagctgaggttttgggagaatgctagctatcacgcgcctgatgggatcatgggataacaaaatattgggctcttttccaattgccggctcacacaagaggatggtagcccctcccaaccttcatcactatcaacaccgtttcgccgctgccagaaacccccaagtcatgtcaccactgctttagcgccaccgacgtggtttctccagcctgccaccggtgataacctcaagccctatcacccctgcttcgtcaccaccgatgccgtttctttggtctcatcctccgctagcagcaaagccgtattggagctctacagttcggtctactcctctctgttgccaccgaaggagaagaagaagccgtatctgactggtgtattttgtgattcttttttttatgtttcaaccaatgtattttgatgtttatttgtgttggatcaaaatgttgcagtgagaatttttatgatgttttaatttttgtcttcagttcttgtggatttgttgatgtttcagtaattgaagctttgatgttttgtgtatctagacaaagtgttttaatccataattcaaccgtgtttcatcacttaaatagtttgaaagctagtggtgaagcattcttctccaaatactgaaacaacgcctgattttgaagataaaatcagaagtccgatttgtagtttcctccatatttttatttcgaaaacactgaaattttagcatcacgaagttctcaccgagaccgacccgcgcgcttgtgcgtttgtggcactaaccaaaccagctcggtggtcggaatcggatcatgccgaagaatacccgactcaacccaaccccggtcggttcagttccgttccccttctccataaaacgcaacgaaacgaaacgaaaccccccaaatcccccaaacccccacgaagaagtagaagagagaaaaaagctctcatcaatcccacacccatggcctccacaaccgccgccgccgaggaccacaagggcaagcgccccctgccgccggaggaggcggacgaggcagcggctgcgccgccccccgccgccgcggaggaggagg

SEQ ID NO: 8329 - DNA, 1501 bp, Oryza sativa
ccatgtcccctctctctctgtctctcgccgacatcggccaccagaggccaccgaggtcaggaaggatggagaaaagcagcggaagttggggacgagacgcgcgatggccaccggtctcagggaggatggaagggagagtagtgatggctgccggtcccgcgcgaacaagctcgccggcgcggccttctccctctccatgcggtgccggactgtcgtcacctcgccgccaccgaccacacacgcttgctcccgcgtcgccgccgtcgacgccctcttccatggcgttgttggtcgctgtcgccgccgccgagtggcccctcgtgcgtgcgcggcgccgctaggcctggagcgccgcagcgtggtccgggcatggacaacgacgaggagtaggagggtgatgcgcggggcacggccgaaggagctccaattctgccgcccgccgcccgggaagctccgcctccgccgtcggccgcaccgctccgccttcgtctccgccacccgccacccggggagctctgcctccgcctccgccacccgctgcccggggagctccgccttcacctccgccgctcgccgctcaggtcgcctccgccggcgctgccgcggtcctcgcgctactcaccatcgcgaccgcgttcctcctcacaggccgtgcgcgccgaccgccggccgtccccgcgcgccgctgcccggggagctctgccttcgcctctgctgctggccgccgcgtgacctccgcctccgcctccgccgtccgccgccatcctcggtgccgccgtggcctgtgctagtgaggagagtgagaagagagagagattgggatagagataggaggggagctgacaggtggggtccaccgattttttaattaaaagaattgctgattgtattgccatgtaggaccaaaaccaacgtggattgaagcggggggttagttgtccgttttgcatagttggggataaaaaatattaggttttgtggtttagggggataattcggtcgaccgcgatagtttagaggataattcgtactttttcctttaaattcaatcgaaatccacatgccacgcccccgaccccctctacatttctctctcacacacacatacaagtcaagacaaattaatatagcgtaaatagcacgtcgagactaaaaatggagattagacaaggccgaatacatcgaaacatcgaaaaatgaaaggtaataaagcaaaagcaaaagccaaaagaggcaaaggcacacaagaataaccgaacaagggagccgtgaaggaaagaaaaaggcgggaatcgaagcgcctagcgacactccagtactccactcctctcaaatccccttcgaagcaaagaagaaatccacctgaccccgcgccacctgtcgcctccgagcagccgcctcgccatggccgcctcctcctccaaccccacgcctctgctgctgccaccgccgccgccgcaagagcccgcgcctctgtcgccgccgccgccgctgcctacgc

SEQ ID NO: 8330 - DNA, 1501 bp, Oryza sativa
tcaacccggaacacgccgccgccgccgctgccgccgccatcgcgacgcccccggatcccgacctccttcgacgacgaaaccacctccggcggcgagccgccgcgtggcgagatgaagaagaagaaggcgagcaggagcaagaaggccacgttgacgctggcaccgatcagcaccctcgccgccggcggcgccgccgccgccgacgtggcagaaggctttgccatgcataatggtgggcgcagcgcgagtggcgtgctgaagatcacagaccgtagccgacaaaacggatcaccgctattactgaaaatccgtcagtagtagcaaacgtcactccaagcccccaacaaacattcaccgaattttggccgaaccattttcaaatgaaatgactacggaactccacttgaaatctccgtgtttcaaattactatacataatcaggatgtcaaatggtgtgtactactccatgaagataacttttactgttctctctactgatatatactatatgaaatgaaagaaaatgatagaacggggataagtgaagagttgggtgaaggaaaaatgaagattgggttggatggttgcaggacgacaaaggcaaaattcatgataggacgtgagcctgcacctttggatgtcccttgcagattggttcgtgacgtcgacgcatcacgcttggatcatatgggggttacagctcaagcgattaaggggggcacagcatcaacttgggaagtgtgatgtcaacatattttgggtgtattttggttggaactagcacaatttcgaacaaatcacaaaacagtagatagcaaactataagctatttataaacatctctactattataaaaattgaagatgtttttactgattgtttggtgcgtcgtccaattcgagtatgaatacggtagtctaagttcaaatgtacatgtctgtttcgaattttttgcttgcatgtatagaagaagagaacaggtcatcagatcgattcgtgctagaatactatgcatacgtaaatctctctttattagtttagaaagaagcgcagctagcaccggctgcatgctcttcctgatccgattatgatatggatgagatgatatggcttggctatttttcaaaggttgctgcataaacaaccatgtaggcatatcttcatattatttctattatttatgtatttagaatattcctattatgttttttttgtgagattttcataatcaggatgaagcgatcgcaatgcaataaccagccacgtgagacaatttcacaattcacaatgctcaaatactgcataaaaaatatgtcacgatttagtttttccgttgtaacacacgtacactttttctagtatattaaaaagataaaattagttccctggactaaaattagttcttggactaaactttttagtccctactatttggatctaggaactaaaaaggactaaaggcacgtggaccgagggggagagaagagagaggctgccactt

SEQ ID NO: 8331 - DNA, 1501 bp, Oryza sativa
ttaacaacctcgactgctcccatatgcccaaaattaattaagttaaccaacatgtacatctagtgttgatttggttgaagaagcaggaaacagaggatgcgcatgtccgggaggagaaaattgcatatctaccatcgcataagaatggattcgctagaataccatcactaaaatgggcttcgctagaataccattctcaaagcgtgggtgttcgctgcaatgccattttttggtttcttgcatctcaaaattatttttcctcaattacacattttctcggaccattctacccttggagaagcggcgacgccggtgctggtgcagatgccgaaattcaacctttaaaacaccaaattatgttcttgttatagtgtactccgtatggagcaagcaagatcacggcaacttcataatttcagaaaccatccagaaacatttacgggtcaaagaggaacacaggtcaaagatccaacccaatccaatgcagagtccacacaaaatccgaattcccaaaagaacagaatcctcctgttcaattcgcgcagagaaaaactagaactagggatcgaatttctattacagctcaaaattcgaatattttgattcaggcagattatgaatgtggcaagacaagcgaatgaacagtctatctgaaattccaattcgagagcattctcccgacagaagcaagtggcgaggagagacaccacttcttcgacggcgagcagcagcaggacaggacgaggaacacgcggatgcagccgtagaagcgcgttcgcagcgccgtgttctcccccggcgcggcgtcggagtcgttcctccccgccgccaccctccttcgcgcgacggaggcgacgacgagcgcggcagacgcggcacccgtcagttgccccgcggcgcggcgtccgcacgagcaccggcatcgccgcttcaccctccgctcgcgagattcacaccagccaccatgtgattcaacatgtgacccaggggtagaacggtccaagaaaatatgtaattgaggaaaaataatttcgaaatgcaagaaatcacaaaaatagcattgcagtgaacacccatggtttgagagtggtatttcagtgaagcctattttaatgatggtattctagcgaagcaattcttatgcgatggtagatatgtaattttctcgttcgggagccatttgaacttcaagatgccgtcagttttgtcgccaatcaactcacgccattttaacgttttcacgccgtggcggctggagaacgattaataaattgctaatttcgtgggagaatagtcatcagtcgtcacgttcatgcatgatgcatacatgcgttccctataaatacatattcgtcagatgatggccatctcaggcaaagcagcagcttacggcactagctagttagctactgcgaagaaccaaataactacctcgcgcgtacaagaatctcaattagctctgtgtgttcttatacgcttggattggagattgaatactgtg

SEQ ID NO: 8332 - DNA, 1501 bp, Oryza sativa
tactacgaggtcccacctctcctcccgcggcataggtacgcacctacgtacgcttcccctccctttttttcattttttctccttcttttttttcctatgcatatgcttccctccctttattcctatatcatacgcctttatgagacgatttaatcaaaagaattttgagtatcttgcactcgcatttttcatttacggtcatactacacggtatatatatagatggactatataataattaactagcaataccttttaataatataagtgcccgcacatacgcgcgggccaacttcctaatttataagtaaaacttttatatacatgttcttagcaatttaaaagtaaggctgaaaaataaacttcgatgaaaaaaaacgccaaaatgagttttaaatttaaggttgaagatttaaattttgtttgataagaggctttgcagcgggtggcaacggatgtggtttaccagtggatggtgatgtttttgttgccgttgttgtggacgttgacgatgacgaggtcgccctttcgcgcgtagatggtcgggccagggaactgcccgttcacggtgaggatgctcttcttgtggcacagcctcgtgtagttagtctccgtaatctgcagatctcatcacgcatggttaaaactcaaaactcatttcgtgcattcattaattcctgtacatcgacgacattgatccgcgaacacgctagaattcaagtagatcatcacttgcaaagaaatcgtagtggcgagtcttggcgccatgagcggggttaactactgcaagtgctaacaccatgcctgctagtaaccaaagcaataatgcaggtatcttgcctgttgatcccatcgccgaacgcacacagtattcaatctccaatccaagcgtataagaacacacagagctaattgagattcttgtacgcgcgaggtagttatttggttcttcgcagtagctaactagctagtgccgtaagctgctgctttgcctgagatggccatcatctgacgaatatgtatttatagggaacgcatgtatgcatcatgcatgaacgtgacgactgatgactattctcccacgaaattagcaatttattaatcgttctccagccgccacggcgtgaaaacgttaaaatggcgtgagttgattggcgacaaaactgacggcatcttgaagttcaaatggctcccgaacgagaaaattacatatctaccatcgcataagaattgcttcgctagaataccatcattaaaataggcttcactgaaataccactctcaaaccatgggtgttcactgcaatgctatttttgtgatttcttgcatttcgaaattatttttcctcaattacatattttcttggaccgttctacccctgggtcacatgttgaatcacatggtggctggtgtgaatctcgcgagcggagggtgaagcggcgatgccggtgctcgtgcggacgccgcgccgcggggcaactgacgggtgccgcgtctgccg

SEQ ID NO: 8333 - DNA, 1501 bp, Oryza sativa
atattcatgtgccatcttaccaacttctatttgcactgtacattctatttttcacataatcagctgttacattacttgctgatctcttaatcccataatctctctacatgcttcactaaataaaaaaaatcattgctttttactggcggaatcttttcattataatcaaactaatcaaatcaagggcaataaggaaggacaactattgtgatgtgaggttagcacaaatgtaaggtatttagcagaacactaaccaatggatggacaacacgggaaccatcatcgctcttctcaagccatgaatgctcgaatggcttgctcgagttgtccaccaatatgcggtgcacgtcctgcggccgcgggatggtgggaatgtggaatggcaccttcgccttcgcccccggcgcggccgacttatccctggtggccatcttcaccgagccagaaccaccaccaaacgcctcaccacctctaccaaccccctcctcgccgccgccgccgcccatcaccttcttcttcttcttgccgtaaacaacctggaacccgtcctcctccgtcgccctccggccagtcgcctcctcctcctcccgcgccgccttgaactcgtccatggaggcgccgaactgctcggccaggtcgtcgatgacgccgacgacccagtcctgggcgtcgtcgaggtcgtccccggggaacggcgggtgccgcttcgggtagaagggggcggcgccgagggcggcgagggaggcgcccgccctggcggcggcggcgccgacgggggacctgaaggaggggaagttgttgtagaagtggaagtcgcgggaggatgggagcgcgcgggagcggccggagaggcgcgcggcggcggcggcgaggggccccgacgagccgtcgatggccgccgccggcttgctgggcctccacggcggcggggcgtcgtccgcttcttccattgaggtggggattggggaaagtgggtggtttagggtttagggaagtgaaggcggacaagggcggcttgtacggtactactactactactaccaccactactactactactactactacggtgtgtcggtgtgggaagcgatttttgtgtgaattgaaaatgaacccaattttgggcttttggcccctcaaaatacaaacaaattttcggccccttcgtcaagcatatagaaggaaaatgcgaaacaatatatttgcaaatgaaaaataatttgtgaataaaagttttatatacgtattcttaacgaattaaaaacaaaggctggaaaataaaatacaataaaaaaaatctcaaaatcaactccaatttaaggttgtaaatttaaattttggctgataaacataaatgaaaagatgaagttattttctttttttccaattattatgtatgttgttttcagtccactcttttggtgctagtttagattgcacaaatgtgattatactacaaaatatagcactccctccattctcttttatagtataaataacc

SEQ ID NO: 8334 - DNA, 1501 bp, Oryza sativa
tagataacagagtatttcattaatcaatgagaacgtctgacatttgcactaactagaagtgcacatagtaaaaaagaaaataaatgtaaaaatgctagacaacatgaacatattatgttgctatatgctgcaatgtgacggctttgctctactaaaaaaagaagaagacatagtaacaatgtaacataaacacctttctaactatttacgcttttttaagctcttttccgttcacttctggactttttggctgtgtgcctacgagtagaggaggcagaggccggagatgtaatccatttccattattaaaaaaactatttacgctgagcgcttctctattgccaacattatgggtgtcattattgttgtctatcttgaaaaaagaaattacgatttgtcatcggagaagaggaattcattgtcaactaaaattcaagtgtttcttaggagattcatacctatataatagaaaattcaatccgttgaaaatattgaaaatatgcagttctcatgttctaaacttgtcattgattatttgttgtagcaccttaaatattggttttgattgcttacgtatggctatcaaaagtgtattaaactcgtttcacatctacactttctttatgttggttatttatactataaaagagaatggagggagtgctatattttgtagtataatcacatttgtgcaatctaaactagcaccaaaagagtggactgaaaacaacatacataataattggaaaaaaagaaaataacttcatcttttcatttatgtttatcagccaaaatttaaatttacaaccttaaattggagttgattttgagattttttttattgtattttattttccagcctttgtttttaattcgttaagaatacgtatataaaacttttattcacaaattatttttcatttgcaaatatattgtttcgcattttccttctatatgcttgacgaaggggccgaaaatttgtttgtattttgaggggccaaaagcccaaaattgggttcattttcaattcacacaaaaatcgcttcccacaccgacacaccgtagtagtagtagtagtagtagtggtggtagtagtagtagtagtaccgtacaagccgcccttgtccgccttcacttccctaaaccctaaaccacccactttccccaatccccacctcaatggaagaagcggacgacgccccgccgccgtggaggcccagcaagccggcggcggccatcgacggctcgtcggggcccctcgccgccgccgccgcgcgcctctccggccgctcccgcgcgctcccatcctcccgcgacttccacttctacaacaacttcccctccttcaggtcccccgtcggcgccgccgccgccagggcgggcgcctccctcgccgccctcggcgccgcccccttctacccgaagcggcacccgccgttccccggggacgacctcgacgacgcccaggactgggtcgtcggcgtcatcgacgacctggccg

SEQ ID NO: 8335 - DNA, 1501 bp, Oryza sativa
catgggccccacccagaacccgcgaggtggaccgcgtccacccggccgtttcccccccccctcgaaccctaatgggcccgctccggcccagtagctcggccgagccgcgcgcctttccttgggccgcgcctaagacgcccgaggaagtccaattcgcacccctccttcctttccttttccaaaggaattgataaatcctttttccctttttccataaatcaattctctattccaagattccataaatcatttccgttggtcccgcacatcaacgaatgccaataatattcttgagaatattatttctataaattccgataaatcatttctcgtccagaaaatccatttaaacttccaaaattcatatctctcgatccatagcttcgtttgactccgttcaacttccagtaattccgtaaaattaagatctatctaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatctcacacttaacttgcttggcctcggtttgcgtgccaaaccgacggacctatccagtagtcgcactaatttccgtaggtcatactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcggggggttgtgcctatgtggcactgtcccgtattcgcatataaggaccgattcctgtgagaaactcatcgaacataatgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctgtatcttcatattccgttaggaatatagattatcttttgtaacccggactccttcccatatataaggggggtccgggcgcctctaggggcatatgctgatttctcctgaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggttgcgtcaagcttttcgccgatcagtgcaa

SEQ ID NO: 8336 - DNA, 671 bp, Oryza sativa
tagggtgttacgctctatagcggcccgaacctgtataatccgactgcgtgcaagcttgccggtaatcttagggacgagcgagtgatttccgagagacgagcctccgcccccggccgaactcacaaatggggggtctcacgactccccgctattgtggatcttccctcaacaaggtctcttcgagaggaaaaagtcagtatggaagcacggatcttaaacacagatccaacggccagagaaccgactataatcaacgaaaaaaatctgtcgacacaattatagcaaatccgtttcatttttgacgaaaatgttaccggactggcttagttcttttaggctaccagctactaagattattatgggtgcgcagcatgcttctcaagtcttagtcgctaaacggttgtttttctaaaaaagtttcatatgtaatatttaaaaaactaaaataaatttatttttaaattaaaaataattaatatttaattaagcatcatctaatcgaggcgcagccggctggcccgccggctgcgatttggtcgtcgcatgtagtcaaagtcaacaacgataatgatgtacactagcttattctatctgcaattctgccaccacgacgcccacgctaagtagccgcagcaataacaatgtaaggtggccagcaaagcagatgaaca

SEQ ID NO: 8337 - DNA, 1501 bp, Oryza sativa
caacccctacctggcgcgccaactgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgattcaggagaaatcagcatatgcccctagaggcgcccggaccccccttatatatgggaaggagtccgggttacaaaagataatctatattcctaacggaatatgaagatacaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacattatgttcgatgagtttctcacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtatgacctacggaaattagtgcgactactggataggtccgtcggtttggcacgcaaaccgaggccaagcaagttaagtgtgagattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattagatagatcttaattttacggaattactggaagttgaacggagtcaaacgaagctatggatcgagagatatgaattttggaagtttaaatggattttctggacgagaaatgatttatcggaatttatagaaataatattctcaagaatattattggcattcgttgatgtgcgggaccaacggaaatgatttatggaatcttggaatagagaattgatttatggaaaaagggaaaaaggatttatcaattcctttggaaaaggaaaggaaggaggggtgcgaattggacttcctcgggcgtcttaggcgcggcccaaggaaaggcgcgcggctcggccgagctactgggccggagcgggcccattagggttcgaggggggggggaaacggccgggtggacgcggtccacctcgcgggttctgggtggggcccatgtgtcggtcgacacggtgcatggtgcgg

SEQ ID NO: 8338 - DNA, 488 bp, Oryza sativa
ttgcctgtgaagtgaagtcctctgccccggttattctaattttccgctgtttaaatcttaatggatggaaaggacctatctacttttgtaatgacatttaattcgttaattaattagagtaataatggtactctattatctttgttattgtgtgcctcggctgattcctgaacgagggtttacacacatgtaagcgtttggaattttggatagaaattccgggcgtgacatgtacccacaagacacagccccacgacacgtttctgtgcaccgacatgccaccacgacataccggatagagaccgtgacaggacccttcgcataaccccctctaaccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactaga

SEQ ID NO: 8339 - DNA, 1501 bp, Oryza sativa
gccaactgataacaaatacagagcagtatatggtatatttttttatctaatccttacatggataatctatctatctatctatctatctattatctactaaaagtctattaaactttctacaaacactcctaaaccaccacgtgttattcctataaatactccttgtcggtgacatgggaccgggagtatcatgactagaggcttggggcaggagcaatcacccacgtggcctgaccccctcgggggggtcgggcccgagggtgatgtggccgcccccctctttgtctccccgaggagtcggaccgctctcgtttcggccccgagggctgaggcgccccgaccccttgtgggttttgcgccgcgtgtatgggttaggtgagcacaacggggctcacctaaccgcatttattgcggtttggacgagcgcgtcacgccgcatgtaacgcagtgcagcgtgctcgtttatccggtctgtgactggtcacagaccgatcagatcgtgggttaggtggcgacaggcggtctgacgcacgcctcgccccatcccgtcaggatgagagcctccgagcactcgtccctagccggagccggcgtgttagctcctggagatggcacgttggtcccggtcagatatatgccaggcttcatcccaaccattacaagcaagatattgtatgaagaagggcgaacatgcagattgctagactgacacgtggtggacaagaatgaccgatttgtgaccggtctgacactggtcatgtcgtcggcagacaaccatgtacccacgttgcacctgcttctggcggagtggaggtaggtatgggccatcccatcagaaggtcattcggacagcagccattgcaagtctccgcccatttatgaagagatgacagggtgatccccgaggttagacgagtgaggacgcgtggccacactcaaaaacaagcagtgtttttagctttctagagaaggcaagccaagtttgagtaaagataggataaagtccccaccaaaaagagagataggtagaggtggtgcatgtggtatccccttgagatataaaaggaggaccttgcccactgaggagaaaaaaagaaagggaaggaaaggagagaggatttggagagtagatcccaggagaggaaaaaaagggagaagagggtttctagagtaagagctctctggctctccagctctttggagctttttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcatctggcgcgccaggtagggggctctgcgtgtgtttttctaagctctcgcattctttcgtgtgcgccaagcttttcctgttcagcccaa

SEQ ID NO: 8340 - DNA, 1501 bp, Oryza sativa
tccactggtcggtggtctcaggttgtaggcaggagaaggtgatctcatagcagggtgcagtggcaacatcgtaccatccctcgcaatgcctttggactaaaggcgatgctgctggatacatgtttcattttctgtatacatgttgtaggttgatttcctataagtaggttaattacatggttgatggaatcttcatggcatcacgttctactttgcaaatttacaaattatttttcctctatagttctgcccctatggactgacatatattttgtatctgaaaatgcattttgggcttgatgtgaccacgtggattcttgggtgaaatatgcagcaagttccatgggtgcaggaaaattgaatatactgttgaatagtcccgcattggttgtggaagggcaaatgatctaagatataagtgggggagcccctcaccacattggctagcttttagggtgggaaaggccctttagaatcctacaattggtatcaaaccctggctagttcaatatctctagctcgagagacatagtgtgtgaaggcctgatgaatcgtggtgcctgcagggcccgtatacctaagggaccgtggggaaacggtgaaggggcgatggagggctgagggacaccaacttgtgaaggggggagattgttgaatagtctcacattagttgtagaagggcaaaggaactaaaatataagtggggaagcccctcacctcattggcttgcttttgaggtgggaaagaccctttacaatcctatgtataccatgacatctacaaacgggcttcaggaattaagaggaagccaagggcctcctgagctaatgttgtgtattgtaggtacttctttgtgtctcaatttgggcaactgtgagttcttccaataaatacatgtgtttgagcattaaagaaacaaatgttttcaggtatgcactttcatgaattctgagagaagatatggacctccctcagctagctatgaagaaatatgcatagtttagacaaaatgtcagagtgcctaggaagacatgttgggtttctttttctataaaataaagggacaattgtttatttgaccctattttgaactctaactgccaaattgactctactttttgcagtttgtttatttaaccctccttttaaaaaacgaagctcccgtttgaccctgtttccactactccgttcaggtttgtttttttttcaaaaaaaaatgtaattaatattcataatgcctagaatacccttagaaacccctattcactcaaccctatccacgcttctgtctctcgtgcgagttgcggcggcgatgacatctgagggtgcagcggcggcgcggcgatggcatgggagtgcaaggtggtgacgctctgagggggcggcgtcgggtgaagcggacccacgccagtgcccactcgtggaggggatccgcactggcgcccggtcgtgacggcggatccctagcggctgcggcggcagcgcctgtgcacggtgggag

SEQ ID NO: 8341 - DNA, 1501 bp, Oryza sativa
tttccgccacctcagtacgtgttcgacatgttgcgcatatttgatctgttcatgttttactgcttagtttacatgtgtagatctaatgatgcgttaatgctagtatacgtccgtaatgtcatgatttatgtatagaatatattaaatcattatatgtctatattctcaacaaggttccctttgtaatatttcaacctacccatcctactgattaaccacgccgcaaaccatctcccttaatgttgttttagtggtaccatcatcgactcaccaattaaccacaccaagataccgtccgtcctttaccgtccctctccctcgcaaccgcttagagcatatacaagacaatgagaggataatatgagattcagcaacacgtgaaataaaacaagccataaacatataattaattgaaaattttatttatttcatctttttagtaacttttatctagatctttttttttaaaaaaaacaccatttaacattttaggaaacattctcataaaaaaaggggaaagcatctcagccgttgagccgaaccgaacgtagcctaagacatgcttatatttacacatagaccggtcactgatccgttaagcagtaagatttaaaccctagcaaatgcactaaggtttaggttaatgaaacatcataagtatgacgtacgtgttcaacggaagagggatgggatcgatgtggatatatgctggccgtgaaaaccaaactaaccaactacggagtagtagtaaccaccaattacactgaatccagagtgagtacttgtgtagttgtgtttgtgtagttgtgtatgctcccaaatcctgaaaccactagctagtggcatcattgtcactcatggattccatcttccctcctgacctcctcccaacttgccctgcagcctcctgcaacgtactccagtctccagcacactataaataggcacgaacttggcatccctatgcagcaagagccaaagcctaaacaagctacctctagttcgtagcagcaacaagctccagctcgcacactccggcagctagcgaacaatggcggcgagcgggtggtggtgcgggctgtcgctgtgcgccaagccgaagcaggtggcgagcgagagcgtccacggcgcgcagctcgcgctgcagcggctcaccgcggccaggcgctgcggcggcggcggggacgccgcttgcgtcgacgtcgaggccggcaagccgtgcaagtgcggcgaggaacatacggaggccgcggctgccgggagggtcgcggctgtggaggccgttcaccatggcaagccgaccagctccttcgcccactccgtcatcaacatggtcggaatgctcataggtacaacaagtttctggccacccaaaaatcttcagcttcgtataatccaaattatttctctatattctcaaactccaacttaatattttaattagcattaattatactcgtaagctgcttatcagaatcctaagctcctaattttttatgtc

SEQ ID NO: 8342 - DNA, 1501 bp, Oryza sativa
tgccaaaattttggcaaccttactaaaatttggcaatgccaaaacttggtaaggttgaaaataatagcaaagtgaaccagccctttatttatccccggctatgttcttttggagggttgagaacccttccctccacacgaaaaacgaagcgatagattaacacaagattaattaagtattaactataaaagatttgaaaatagattaatatgatttttttaaaacaactttccgatataaacttttcgcaaaacgcgtaccgtttagcagcttgaaaaacgtgcacgcgaaaaacgagggaaatgggtcagaacccatgggaaaaaaacacagcctaggctattgtactaatatgcctttgagctctagctattgtcttggatggtttatccattattagaaaatgtttacctattttacttttaaaatagttttatattttaaattaaatagattggactgagattgatgatacctggtccatttgctaggtttgttggaattaatagatgggctaaggcccattcgaagattaattctttggaaaatcacaaaaacccacctcatgggatggcatgcatgtggagtttactaccaccttgcttattctaggagagcgggacctccttagaagggaggatgccctcctagccacttgaagcatgtatggtggagagaagagggggaacacacgcgctcgctcgctcgctcgcctcgtcgggccgggtaggcggcgtgcgtgcacaacgtacgcgtcgaatggtccgcaaaattggctcctcacccttgcgcagatgcagcctccttttgcagttttgttttgctgcagaaaaattcggatttgttttgttgttggaaacattccaaaaaatcatgtgcgtgaaaacggcgtggagtccggataagttacgcgcggcttatccggttcggttacgcggagtggagatcgtgcgggcgccctgatcaagcgacctatctctatataaaccgagccgcggccttcacgcaactcacacgaaatcaatctagggtttgcctcctactatgtactgcccgtcgctcgtagactactccatcccgctcgccggcgtgcaccggcaatccggagagcatgtctccggagcctctgccttcgtcgtcttgcaccgggagaaggcggcaataaggtttttgggaagcgcttcgcgcgactactccctgtttgtccgcgatggctcgccttcctctccgctcacgtgcttcgcgccttcgtcaacgctcgcaaccgcgagtagttcctgccgagcaaccggtctttcgccacctcggtacgtgttcgacatgttgcgcatatttgatctgttcatgttttgctgcttagtttacatgtgtagatctaatgatgcgttaatactagtatacatctgtaatgtcatgatttatttatggaatatattaaatcattatatgcctatattctcaacaatccaaaaaccttattataggcgctgtgattttacta

SEQ ID NO: 8343 - DNA, 1501 bp, Oryza sativa
atctaaaataaatagatagagcaaacaatccatgaattacacaattagttcgtcatgcacttgcctccaatgaatggttggtatcatgcatgatctgaagtaccaccacctaatcacaaacaaaatctcagcaaacacattcaaacatgcgtataaaacaatgaaaaaaagtgaacctactgccctatcccatcacaacgcaataacaaggaacgccgcttggactataaacaagactgctgcttcaaacctttatatcttgaaatatgaaatggctatgaccgcaaataaatacattttggaaatctgaagaacaaggcctacaactcttatgtgaaatcatatttttattatgccatttaaatggtctaattagcgcttgaaagcaggcttcagaatctgtccagaatttcagactgtccacactaaaacaaccataactagagttctactcgcccaatcaaagtgtactttaccaatatggaaagctaagaaaaacctctacaactttgtctagaggcggcccaactgattccgctgtttagcccctgcaaaaacagtttttcaaaggatttttaagataccttaagaaaaatagaacccttaaattattacaaaataacattatccgaactttagtttttccttaatctatgagacaaaatttttgaacaaagaatacaaatcttacttttcaataatataagtgcccgcgcatgcgcgcgggccaccttcctagttataataaattttggctagaaaatatgagtatgacgcgtgtgccaaaatactaataaaatatgacttaacccaattatgacatttaatcaaacactaacctaataaattgtgacacgactaaggtttggtgtgcaaactgtagccaccaaccaaacatacccttaggcctatgggtccatgggtcctaaccaattaccatccttagttaggggatacatacgggggtgtgagtataatgttgtggctgtattggtatgtcgattttgctatacatcactcgggttattctttgcatgatatttgacgttttttctcgctgctattatctccagggtggggtggggcccatacggccaggataaagcaatgcatgcaactccagtgggatcattagaatccgattttgctatagcttttgcgattttgctatacatcactcgggtgattctttgcctgatatttgacgttttttctcgctgctagtatgtctgcgtgtgcctgccgtgcattcgaattttttttttgaaaacccagaaaaaatcgatttattttttcttgtgctcccaacggagcggaagctagaaatgaaatgccagcccagaaaaccaggtgggcttatccagagcccacgaaccggcccatattcctttcctttccccgccccggccgccgcttgcaaggtcgccgccgacgacgcgcggagaggagaggagaggagagaggaagagaaaatcttccgattccggcgaggaggggatgg

SEQ ID NO: 8344 - DNA, 259 bp, Oryza sativa
acgacggcgaccggcgcggttcccctccactcccctcccagattcagccggagggaggcccgggagggcggcggcggtgacgacgacggcgaccggcgcggttcccctcccctcctctcccagatccggctggagggagaccgggggagggcggcagcggcggcggactatggcgcggcgcggacgtgcggcggcagatgatggcagggcggggccgtgatttattttaggaatgtttttattttttttctttgctagt

SEQ ID NO: 8345 - DNA, 1501 bp, Oryza sativa
ctaagtttgtacttagggaataaatatgaaccccatagcattgtaataagggagccaatccaatacaacttcggcgcatcgccacccttttacttttctcgttttccggtgagttcttcgcaaaaggtaactcgtctcaatggcccgcgctaccgggctaacatgtcgctttagacgtgttaggctcgacatcgcgagtcattgctatcatatgtcttagttaatctattcttagcttctcaatttagctctatcggctgctgctcgctttagggtttatgctggtttcggttaaattgtcttgctagattagattagctaaggcatctaccgtcctaaaagtgcctaattgcttgattgtctagactgcatgtttcctttcatactttgagatgcatcatccctagtcatgcttagaaccatgcaaactagcctgcaattaggcataataaggatagtatcagggtttcagctgatcttacctaatatgcatatttcaccccctgtttcatgtatattcgctacttatatagatagatcattttatataagcatatcaagctttagtcagtatcggctagattcctacacctgcatgcttgatttttgtttaatatgtttatatggatcaatctatttatataagttgttactagagtattagctagtacgttatctttctttctctaaatactgtcacgtcagctactttcataatatcgttttaaatcaatctgttaaactacatagatagtattacatccgattggacgtgtttagggtttattattctttgatatatccagtccatagccgatttggtctaactccatcggctgagaccataaacgatacactatcagtcgactaattctacttttattctttcttgccgattgcaggaccaaatcagctggcacgcccttgacacactcggggctagcctaggacctgcactggagttaagcagatctcccagggcaccgtgttttcacatcaacaaatggcagaaataatctaagcaaaacccgactctaaactataacaactactgaataaatatgatttaggatgtcctagggttgccctagggcacacacccccttgggcttagcccatgacacaattacatggcccaagacccatatcagattcggactggatgagatacgtggtttgtttcgcagattcctgatagcttggtgggaattttgatgtggtaccaaaaccatctgaaactaaacttcataagctttccaacaagtactcatgggtcccgagattccttatagatcagcggctaggtccgtttgaagttgatgctgtcaggaggcctgaatccgaatccaaatccaaaatgtgtagatctttatttcttgtcttctatggaccaaaagtgacgtggtgaagtaggaattgacttggagaaggtcttggtttagtccccaatcaacctctgcaaatgaaaacacacgaaactcattgtgtagcaatgtttgtt

SEQ ID NO: 8346 - DNA, 1119 bp, Oryza sativa
  unsure (1)..(1119): unsure at all n locations
aaccaatttttacttgaattttaagagcactggaaatattattaatgccacaataacccttgtcagctttgttaaaaagaataaattgatttaaatcccctcctcccccttgggttgtttttggcccactccctcccacctttcccctcgcggcccagcctagcaagcacctccccctcctccttctcaaacctaggccgcctccccggcccatctctcacatgctagcctagctctacccaagccgagccaacgccctcgccaccaccgctgacggataggccccacctatcagggccacctccctcctccggctcgtctcctccctccctccttggcgcgcccggcctgcttgccaactgcattcccctctccattggagctagggaaaatgctccccacaccctcctcttcctctccctccctatttaccccctgcgattcgtggtcggtggggagtaaatgcctgccagcatgctggcgccattgatggctgccggacgagtgctcctcagccgttcctcctcctctgcagcctataaaaggaagccccgatccaccttatccctgtttcctcgcctcccgaacccgtccgcccatccctcgccatcgcgccgctccgccgcctccaccgcnnnnnnnnnnnnnnnnnnnnctccacttgtgccgacgaggccgcctacaggatcgtcatctccgtatgcccctccgttcccctcggtgagcatgggaactccctctcccattatctacccgggctggctgctctctcccctcgctgcgccgccgctcccctctcccctcatttgataatgttggttagcggttgttcttccgtgaaaagtagctctctcttcgaaatacctcaaaacctattttcggctgggcttgaggtgtttggttttgcttgtcacacctcggccgacatatggaccggacttcggggcacgactgcaaagcattttccatccgaccacctgtctagtgggtaaggtgtagtgtatcgcttagtgtggccttgatcaagaaaggcatggatagggatggatgaggcccaagttttgtgttgatgttcctagcagtcgcgcctaggggcataatctgtccacctgtcccaga

SEQ ID NO: 8347 - DNA, 1501 bp, Oryza sativa
gagacgaatcttttaagcctaattgctacatgatttgataacgtggtgttacagtaaacatttgctaatgacggattaattatgcttaatcaattcgtctcgcggtttactgacgaattctgtaattattatttattagtacctgaacaccccatacaataccctatatagtatccgatgtgacacgttaaaactttacacccctggatctaaacaccccctatatatccttacgttaaaacttcctctgtccaattttaagtggagttgtaaatttaacatatccaatatttgtttgtccgttttatttgaatgttttttatgattagtatttttattactatcatatgataaaacatgaatagtattttatacgtgagttatttttttattttttcataaattttttaaataagacggatgatcaaacattggatatagaaacccacaactacatttaaaatgggacagaagagtacaacaaatctcatatatataaagtaatatgcaaataaatcatacatatatatacctaaaaatgcttatatattttagaaaagttatataaaaccagttgagaacctatcttatatatatcctccctccagtcatgattacatgacgtttaattagaacgtacagtatcttatattttagattgaaggtagtactacacatgctcttaatataacaacgaaatctcttttatgggaatcttattcgtagaaagtagtatcaagcataaatatattattcatttgttgggttaaaacctatagtgcatatatttgagattcattgtggcgactaaggccatggaaaatatccaaatcctagggataacagttgctaattagatcagcattgccacaccagccaaaacggtgtcacatcccctctgtgcatgcatgcaaagcaaattaattggtgcagcaacatgtcgttttggttttgtcgtaaatcaattatatgtaactttaataatcaatttttagaaataaatatattttaacaacatatgaattatatattacatatgaaagcatttcttgtggtaaatctaaatacatgaaccttacgattttaaactatataaaatttcaaaaattaatggtcaaagtttagaatgttttagtaacaacaaagctaaaatgaaaaataatttgaaactgaggcaatgccattttgtagcgatatatggtttatatgaatggcactacttttcctagctaacttggctcttcagattttaaaaaaaaatcattttaggaatattgtttaaaaatactttagaaaattctaccacctacaattggacaccttgatgagaaaaaaatatatagaaaaaacagttcgtccgtatcctggcgcggctatatatagcggggggaagccacggccattgctcttcatcacaagcctcgccttccaaagctaatcgagatcaaccacaccaaattaatcaagctcagttcatcgcagatcgatcgatcgatcaaca

SEQ ID NO: 8348 - DNA, 1501 bp, Oryza sativa
tggaattcaaaatttgctttggacttggactcaatcggtctgaccggccacgtatcgccggtcaaactagccccatgtatacaattcaaaccataagccatgcaccttgaaacagtactcaactgaaggggttgttttgtgaatagtttaaagatgtgaaatcactgatagggtgcggaatcatttgaattcaagagggcatttcagacttttttttactagaaaaaaatgtccgtgtattgtaacaagtgatggctattatactcttattattgttatatggtttatttaagataaaattctctattaaattcgcttggatatatattttgttagaaaatcatgagctgcattaggaatccgatcgtctcaaattagcgtgcgagtttttttaagagatttcctatacaattccttttatattttcaaaagcgaacaaacttaaaagccgactcaaattcgtatttatattttcaaaagcgaacgaacttaaaaatagactcatacacaaataacgtatcaaagtaccgacaaaaataacttcaatttataatagtagagatttcttattataatggagacaaacatgttcctcatacatgaacaccacatgcacacatatgtggacgtccctcttaacgcaggccacaatgctatgatggtttaaactaagaagccgagttatggaataacaattccttgaccacaccaaagttttttctttatccgaacgcacgcaaatgacatattctctttttacaatattgttttaagacacaattatgtgtgcgctttgatcagttggaaatttgtgaggttcacatatctatataggttctgtctcctaaacacgtgtttaaagtactccctccgtacaccgttgacttttcaaccaacgtttgaccattcattttattcaaaattttcgtgcaaatatgaaagtatttatatcatgcttaaagaatatttgatgatgaatcgagacacaataaaataaatgataattgtataaattttttgaacaagacgaatggtcaaatgttggataaaaagtcaacagtgtcatacattaaaatatggagatagtagtatatttaggtttgtaaatacatcagcacggtgtacaggaagtacaggttatgtggtgtggtagagttgtgagtgtatgatttcaccctttaagatatcatacatacgtcggtgtgttttcaataggtttttaagtcaaaatatggattaatttagaggacttttacggtacattctactgctagtatatactaccagtatatttgatctaacggtgtaaattcatctgatcttcctcccaaatatcctgtagtataaattgtttagggtatatttgtctttttatctatttgtgtggggggtaattttttaaattcgcgtttcctcacttgatctgatccgatcgatagccgcccgcccagtcgaagccctttttttctcgatgttgcgtgcatgggcgaccgtcgccgct

SEQ ID NO: 8349 - DNA, 1501 bp, Oryza sativa
aaattaaactacataattacacatgaaacgatcaccagcaacacacacatatgatccttccgcgaaactcatcgactgatcgaacaaaaagaaaaaaaaaggagatccaagaacatcatcacatcacatatatataaatatataatcatcatcatcagcagcatgcatataaatacaactaatcgattaataattagccaatatataataataatgcatcacacacacatatatatatatatatatatatataatcgatccatccatgcattcaccgaccgaatcaatggattggacgaattgggaattggggaatttggatggacaatgatgtgatcaccatcatcatcatcgtcagttcatgttgcgggagcagcgggtaatggcggagcagccgcggcggtagggattcgccgcctgctgcgacgcgcagttctggtagtaggtctggcctcgcttgttgcacggcaccttgttcgcgtccagcgccgagtagctgacgtaccggttcgtcggcttcctcgccgccagcgcccgccggagcagcccgccgtcggcccccaccgccgctgagcactgccgccccagcctgccgccgcacgacgaggaggagatggcgccgaggtgggccgtggtgaccagctggctgtagccgaggccgccgccgctgtaggcctcggcaggcgacgcgcgcaggcaggagaccaccagcgtggccgccaccaccgccgcagccgccgccgccacgccgatgccgaggcgagccatgggatggattcacgccgaattccgaggtggtggggggctggggaggttggcgtttggagcaatttggggagggggttctttgagcggggtgggtgtctctctctctttcaagcgcgggaggaggagacgagcggcggtgagagaacgcgggggagacaaacgcggccattcgcacaagcctccacggacggtaaaatgcataccattagactcatctggtcagaaaaaaatcggacgtccaatctaatgtaggtgcatggctaagcagttcgttaagagtacaagggagcgtgcatgcaagcatgtttcaaaacttaaatgattttttctcttaaactgtttatccagatttcaatctaattatattactggattcgttacaattaaatctttataacaagatatcacatgactatattgcgacaacttttctttttactttttaaatgttgcacatattgttaatgaaatgttccaacaagtatttgttgatgtttcactagtgcatttgcaatgtttcatattatctttttatatgttttggcaaatactttttttatgtttcaacgataactataattcgatgtttcaagctaaatataaaaaatgcttcagtagttgggacataatgtttcatgtaataacgattactgttgcagtcaattgcatcactttttatatgttgcacagtttatgaagtgcgttgaaacatctccacaggtgatgaaacatt

SEQ ID NO: 8350 - DNA, 1501 bp, Oryza sativa
atgtccccaatagatcggcttcgatggccatggtgctagctagagaactacgtgaacgattgatttatagctcagttaccctccgacgttatctgccgctttggtaccatacgtgaaatttgattggcacaacgatcagccgctgatttgagacagacaaggactatgtacaactttcaagccgctttgcagatttttgccaaccatagatatataggaatttaacaataggtgttatctttgtctttaggctggtattttaagtagttttattacttttaatcaagttatgattttgtacttcacagtcgttcaacctataaactctataaataactggttatatatatatatatatatatatatatatagaggttcttagaagagaagatggaaattaattctgtaattaagaaatggaccacgtaacatatatgaaattatgaaagaaactactatcttcattttaaaatatagcaatttaagatgagtctaattacatcctaagttgctacattatgtaacggagggataccaaataaaagatatatagctcatatatttttttacataaaaatattttaaaataatagtgcttattagacaagacccacctcaccatcacaactttttttaagaatgtttatatacttaaaaaaaaatacccgtgcgttgcaacaggtaaatgctattttaattttattattgttatatggtttagctagggtaaaatccactgtggaaattcgcttagatattttttcagaaaatcatgagctgcaattaggagcccatattgtctcaagttagcatgtgagttttttcaaaatatttcttatacgactccttttatacttcccaaaggaaaaaaacttaaaatccaattcaaacacggatctgtatttccaaaaatgaacaaacttaaaaaccgtggatgacatatcaagatactagcaaaaatatttttaatttttataatagtagtcataatgtgggtgtgtgtcggtgaggtgggcctatgaatcagctggatcatcggccagtcaggtgtgaggccctcgggctcttctcagtgggctgcatttggacttggctttttacaaccatgcatgggctcatatacagttgataacctacactttttttttattggagagcgcatttggtagaaaacttccgcaagttttttacaccccaaaacttttaagatggaagcaatttgatctggtactacatacatacgtgatgaaatttcaacaacattttctcttgtgctaacaaaaaaatcaccatttttcttcttcagaaaagaaaaaatgaaagcagatgaagtgatgagatgtaggcgtctggctataaatacggatctagtgggaaactcgagattagtatcagtatcagtataacctaacaaatactaattattaatcacaagctagcgagaaattaatcatggcgcccgccgccgccgcctccgtctccgcggccgcagatgcggcgg

SEQ ID NO: 8351 - DNA, 1501 bp, Oryza sativa
tcgccacgtgcgacgcgatgaaccccgccgcgccagtgatcaggatgttcctcggcgtcgtgtacgacgccgccgccgcatctgcggccgcggagacggaggcggcggcggcgggcgccatgattaatttctcgctagcttgtgattaataattagtatttgttaggttatactgatactgatactaatctcgagtttcccactagatccgtatttatagccagacgcctacatctcatcacttcatctgctttcattttttcttttctgaagaagaaaaatggtgatttttttgttagcacaagagaaaatgttgttgaaatttcatcacgtatgtatgtagtaccagatcaaattgcttccatcttaaaagttttggggtgtaaaaaacttgcggaagttttctaccaaatgcgctctccaataaaaaaaaagtgtaggttatcaactgtatatgagcccatgcatggttgtaaaaagccaagtccaaatgcagcccactgagaagagcccgagggcctcacacctgactggccgatgatccagctgattcataggcccacctcaccgacacacacccacattatgactactattataaaaattaaaaatatttttgctagtatcttgatatgtcatccacggtttttaagtttgttcatttttggaaatacagatccgtgtttgaattggattttaagtttttttcctttgggaagtataaaaggagtcgtataagaaatattttgaaaaaactcacatgctaacttgagacaatatgggctcctaattgcagctcatgattttctgaaaaaatatctaagcgaatttccacagtggattttaccctagctaaaccatataacaataataaaattaaaatagcatttacctgttgcaacgcacgggtatttttttttaagtatataaacattcttaaaaaaagttgtgatggtgaggtgggtcttgtctaataagcactattattttaaaatatttttatgtaaaaaaatatatgagctatatatcttttatttggtatccctccgttacataatgtagcaacttaggatgtaattagactcatcttaaattgctatattttaaaatgaagatagtagtttctttcataatttcatatatgttacgtggtccatttcttaattacagaattaatttccatcttctcttctaagaacctctatatatatatatatatatatatatatataaccagttatttatagagtttataggttgaacgactgtgaagtacaaaatcataacttgattaaaagtaataaaactacttaaaataccagcctaaagacaaagataacacctattgttaaattcctatatatctatggttggcaaaaatctgcaaagcggcttgaaagttgtacatagtccttgtctgtctcaaatcagcggctgatcgttgtgccaatcaaatttcacgtatggtaccaaagcggcagataacgtcggagggtaactg

SEQ ID NO: 8352 - DNA, 1501 bp, Oryza sativa
ccttatgaaatgaggcaacacttattcggacctaagagggttgaaacgaaggcattgtattgtggatccggatcaccttagtttagagcctaaaaatataggcgtgcagtaccatgagtcaatcgctatggtagtaaacaattatttttgtagttatttacagtagcaacagtataaaacatgaattgtactatatcgcattattgtttattatatattgtagtatactgtagtgatcgatctcgttcgttcgttacaaatcggatggctgggaaaaccctagtcatggtactgttcacctctcactttaacccctaaagtcaggggggtctcaatccattgttttgattgtagaagcagaacagtgctagaggaaaaagattggattgatgctacaagcaaggcaaattcaaagttgctactagtacaaagaaatgaatcaccatcaaagataagttcttgaacagtgtgagtgatacttaggtccacatggtgctgagtgtttgcaataattcacatgtgtagttttctatcagtattttaaaagggtagttttcttttatgctactccctctatccacaaaagttacacatattacttttgacaataagaccaaggagaaattaaatcatcttggatgttacaaaatcaaggagtgaatgcaagcatacaaccaaagagtatttatagatgatttcttgggttctaataaaatatttaatttatctcttcatttaagttttgaatgcataaagattacaaatatgaacaacttatttgaaaaaactcaaatgtgaaataggtgtaacttttctggatggaaggagtagctattaataatagctaatttttggattaatagcaccctaacttgtaaattaaataaaattgcttgttggaccaatcaagatgcacccaactgatgccaggtcaatgctcccaggctcccagttggtataggtaatatgctaggattgcaagggattattccaccatgattgcacggctttattctttctttttcactacagcgaagattccgtcccattattgtcataatttatggccatataaataaataaataacttagatattacgtacttcaaactggtttcgacagaaacatgaacctcaccagcacatgctaattaaatcgctttgaaataatgagtcctttttcatgaaaaagaaaagacgaactctacaccccatttacatatttcaccaaaatgttataacatacaatatatctacggcccaaaatataacgatttttatcttttcgaataaatgtagtaattatctttagaactaatctcaattggaatttaattgaattcatggagaacgaagattgcatttaaattattgtagggaaacaaagaaagctcatcaacaattttttttcttgaaattatcattaaggaattcatcatccattaactttcttctatgtacaaagaaatggatcgaggttgatcggaattggatgggagtga

SEQ ID NO: 8353 - DNA, 471 bp, Oryza sativa
attccttattccaaaattccatgaatcattttccttggtcctggattcaatgactgtcaataatattcttgagaatattatttctataaattccataaatcatctctcctattccagaaactccaattaaactttcaaaattcatatcacccaattcgcaactccgattgactccgttccacttccaataattccgtaaattgagatctatttaatggcactactaattagtctaaataggatctttcttttggtcttttgtttaggttttcgattatttgcgtatagttgtggttatcggattttcgtcgatcgcgggttttctcgaagattcgtgaagcttcgtgaagaccttgagcaaggcaagttaccctttgatcaattgcccctataattgaaaagtcattattattttgtttacaacttgcattattagaatcacacacttaacttgcttggcctcggtttgcg

SEQ ID NO: 8354 - DNA, 1501 bp, Oryza sativa
attcaccctccctcttccttacactagaagggttcaatcctatccatcaaccctcagtgatatttatctgtcctcctcccaaaacaattcaagaatgtataaatggttccctgctgctattattcactactactacacatgctgatctccgtgacgtctccttttcgccataccaatatgatgggatgccactcgtctatgtattggagcgtcactcatctacatcaacatgaagcaagaacgatgtcatctgtgatgccaaggagtcgttcatgcttgtgctacaccaatgatgctattgaccgttctgtcgacgaggcatatacttcttccaaggttgttgttgttatcgacgctctcatagagcccctttttgggctcatcgtcatatcaataatcaattgaattagtagtagatccaccatctgaagtaggtaccaagccacattcgtctagttgttgtctgcatcaacatctcgttacaagtccttgttgtacataggacttgacaagccaaaaggcagctggccacgtctaatctggtttccatctacagcagttgtattcatcaactcttcattcttttaatctcatctagctaggagatacactaactgactccaccaactcctcttcccatcaacaccattcccacgccactgttgtgacgtctaagctacatgagattcatgcatgctgaaaacctatccatccacaccaccacatcgttcaaagaccgatgagcacgaagcgacgagggcatgcagaggctatatgaaggctaggtcaccaaccgataagaccatggatacgttgccggggcccaaatacatttaccattttcacaaacactcatcatgcatggagaacgtgaagcgaagacgaagagacgaccacaagcaccttaatcgaaggtgctatgcaggcctaaacttgtggaggtaattaattaggagcctagacttgtactacctccgttcgaaaatacttgtcgctttgagtttttgtttgtaatttttgatcattcgccttattcaaaaaattatgaaattattatttattttgtttgtgatttgctttgttattaatagtactttaagtataacttatcattttgtatatttatactaatttttcaaataaaacgaatgggtcaaacattaaaaaaaagtccaagcaacaactaaactagtacggaggtagtaaaacggaggaggtattttacgataggggagtactacgagtactgtgctattgacaaaacgaaactgttgacttgtgagaaagcgtcgccactgtcgcattcactgacactgcgggcccacccccactcctccctgtctccaacctcggtttccgcgcataaagaagagcttccgcttccgcccccacctccgcccccaaacccctcaaaaccctcgtcgtcttctcgcgatcgctattccctcctccattcctcctcctccacctccgagacctagggttccaatgtcgagcggcg

SEQ ID NO: 8355 - DNA, 765 bp, Oryza sativa
aaagagtgatgtaaacagtagctacgaaaattaccataccatctatctcttcagttttgttgaatgatgtaaaatccaacaataagtattttattcacccattttacactagtacagatcattccatctgtgacggcccataacaagactggaatttgcgggctgtcacaaggaagtaatctcaatcaggccgaagtttcgcccgattgagatatggtcgcacagccatggtatacaggcataaaactaaagcccatcacggatgacacttatctgtgacgggccatagttgaggcccgattgagatgagggttccatatctcaatcgggccctaaaagaagcccgtcacagatgagggtcatctgtgacgggctccaactagaggcccgattgagataagtttaatgcccgtcacagatgacactcttttttgacgggcttttattaaggcccgatagagattacttgtatgcccgtcacggttcattgttttagggccgttacagatatttgttgcacagtataaatacccccccaccacctagtgtaactgtatcccactgttcactattttagtgggaggctgtagggggcgattttttgtcttttttccaaggaaaacagaaaattcccaaaagtgatcaaaatagatctatcaagtgagtaatattaatcattaattgagcaatttcatcacgtcttacttttgtaatactgatcttataagatgtgcatgtaatttgtttttttattttgtaacaatt

SEQ ID NO: 8356 - DNA, 970 bp, Oryza sativa
agggaatcacggggaataattcccccctattgattgcacacggggaggacgggggcggcgggattcgcggcggcggtggcgctagggcgcgggcgaggcagcgggagcggccggaggaaggggatgacgggtgggccccacccgtcagcgagggtggcgggcgggcccgcccgtcagcggcgcgcgcacggggagaggccggatgggccgcggggagaggagagggagggggagggagatgggccgagccggcccgagagggagagggagggaaaggggactttttagagtttttttttataaaaccttttcaactttgtttatttcttaataattattatttgtactctgaaaattccactaaaatttatttacgcattttaggcttttaggaaatatacaaaaaccctctaagccttgtttgacttttaactttgcacattttaattgttggaggctttcacacggattttaattattctaggcaccatttagaggatatattttagggtcgttttgggacgtgacaaaattttagcaaagtttgtcgttaggtttgatattaagattttggcaaagttaatttttgtctagtcttgccaaaatatttttgttgccatgtaataaaccaaatatttttatgattattttaggtattgaaccaaacacccctataaatatccttctgatatacgacaaccattgcttttcagagggttgtattatactgcagtatttgaaagccgtctgaacatgagctgcagtgccgccacgaagtttctagatagaaaggtggtacaatgacgaggtgttctaaacttctaatatatcttatccatctagaaagttcataaccttgtttctctcaaagggaatcactctacgtgtttctagtctagtttcttgtcaaaaagaattgaaaattgcagtagtgtatagcagagaagtcttctcctcagtcctccaacct

SEQ ID NO: 8357 - DNA, 1501 bp, Oryza sativa
acgacgccgaccatctcctcctcccgcgcaacgtcgacgcgccgcccgccgcccgttcccgccagcggcggcaccaccaacgatggcgcgggcggcggcacgccggcgccgctgcctccacgcccgccgtcggcaatgacgcgcgtcagcgcagccacgatggccgccgtctccgcggcctcgaagagcgccgccattgccggcgaccgcatcgatcgatcaaggcgacgtcgagatcgaacgtgcacttgatcttgctgagggcatgatcgatacgtgggggagggaggcctatttatagtggagtttgtgagtgaggcgtgtgtatgatatggccaacgcgataaggaaaagaagcgtatgggcagcgtttccagttccatgcaatggaaggagaagaacttccagaagttgctcgacttttcccagcttggaaacggacggatcatgtatggcttcctgacctcactgcaattggccgggagtgctttcagaaagtgttttcgtgctgctttttcttattatttcacgacacctacgacatatttttaaattcctctaggtttaccggattattagtactacctccgtcccaaatatagatatttttaggatagtgacttatctcaatttctgcatctatcatcttctattgaccaatcataaccattcttcatttattttttttatttttttcctcaatcaatcataatatttctacaaccatcttttagtactttattaatacacgtgtccaccaaatactggcattttgggatggagaaagtagaatcgagtgacgttggtcaacgccttggtgatgttcgctccaagcagaagaggaaaagtatacaatttttcacgctcatgcttcctaaactggtaaatggtgtgttttttaaaaaaattctatagaaaaattgctttaaaatcatataaattaactatttaaatttataataattaatactcgattattcgtacgctaatggttcacctcgttccatagccttggccactcttaaggctgagtttgattctacgttttctcaatttctactctctcggattctgcacatacatttctcgaactaaatagtatgcttttttgcaaacaatttatatacaaaagttgtttaaaaataatactgctagaattttaagtgttttttttctaatacttaattaattatgtgttaataaatcgatcccttttacatgcatagatgattggaaaccaccacatttgttgaacacagcctaagttgttttttcgagggataggacaggaaaaaaatttcgaggcaattcctaagctaaccattggactctgagctttataattaattttcatgtactaaaaattttacattaaatttgttttctaagaaatcaaaatgaagtggtgataaattcagtagcaacttaactctaatttggtggtatcagggcaatgctcaatttcctactattgattgaaaattagagtttgcactagtga

SEQ ID NO: 8358 - DNA, 1501 bp, Oryza sativa
tatttataaaagatctcgcgtgactatattttggataaaaaatatgtctaaataattaggcattgtttaaccacgtttagaaagttgtttcatcatttgataaaaatatttttatttcactttataaaatactttagagagacgcaacatttaaaaatattgactgcaatatcatgaactactatatgaaacattaatccactatatagcattgagtcccaataatgaaacattcaaaaaaaacatttgaaacatgcaatatatttgtagcactttatattattgagaaacattgttaatcatgtatgaaacattaggttctaactgttgaaacatcataaaatacttgctgaaacatataaataaaatcatttgcaacacttaaaataatacattaagaaaagctaaatttattctttatcagaatataaccatgtgtggttttgtttaattacaataaatttaatggagcaaacggatcttagattacataagtaatttaagagaaaaaatagtttgaaatttatcaaagaggtggttatatatagggacaatatatagacagaagggagagaaggaatactgcacgctatagttgtagcgcttgggggcaacatgcagagagtgcatgcgcagcagtaattataatgaatacaatggcattattatattataaatcgaataataagtagtttaggtgaaaaattattttgagaattggtacaaagttgttttatcacttgggacagaggaagcggtcgtaacatgtattgacgcttgctgtattgggcatgcagatttttttttcttaggttggaggactgaggagaagacttctctgctatacactactgcaattttcaattctttttgacaagaaactagactagaaacacgtagagtgattccctttgagagaaacaaggttatgaactttctagatggataagatatattagaagtttagaacacctcgtcattgtaccacctttctatctagaaacttcgtggcggcactgcagctcatgttcagacggctttcaaatactgcagtataatacaaccctctgaaaagcaatggttgtcgtatatcagaaggatatttataggggtgtttggttcaatacctaaaataatcataaaaatatttggtttattacatggcaacaaaaatattttggcaagactagacaaaaattaactttgccaaaatcttaatatcaaacctaacgacaaactttgctaaaattttgtcacgtcccaaaacgaccctaaaatatatcctctaaatggtgcctagaataattaaaatccgtgtgaaagcctccaacaattaaaatgtgcaaagttaaaagtcaaacaaggcttagagggtttttgtatatttcctaaaagcctaaaatgcgtaaataaattttagtggaattttcagagtacaaataataattattaagaaataaacaaagttgaaaaggttttataaaaaaaaactctaaaaagt

SEQ ID NO: 8359 - DNA, 1278 bp, Oryza sativa
acatgcagctgactaggtaagctgcatgcagctgataatcaaagtctacatgcacgcataacgtacaagaataaaccgtgatagttacaagttggtttaagtcttttttttagcaaatttcaaactactttttctcttaaattacttctccaactaataatccaattgtaccattaaatttattgtaattaaatctttacaatcagaccacacatggttttatttcaatgtttttgtttagctttttatgcatatttttaaatatacacatggtttttgttaaaagtttcaactaatatttatatgatgctacactaattattttgcaaatgttacatgtggtatactaggaatctttcagtaagtattttaaaacttaatgtttcgaacatgatataaaaatgttttaacaatataaagtttttgggatatattgtatcttttatatgttttttccatgtgtttactcgttgaaacttaatgtttcatacaatgtttgctggtgttgcagttagtatttgagaaatgttgcatctctctgatatattttatacagtgaattgaaaaacctgaccaagtgatcaattattttctatatgtggtgaaacaacgttcaatttttttcatcaaaatataaacgtgtgagatcttgttgtaaatgtttaattgtgaggaatacactagtgtaatcggatcgttgataggataaacgatttaagataaaaaaatgattaattagtacatatgtacattgttaatatatcgagcatcatgcattagcactatacaaagcatctaggtcacccgtagcagccgggagtgtgggggagggcgcctgatatcttttcattcagatcaggcgttcaatccgaagtattctccaatctactagcatatttttagcagtatatctccggatacaatgaagcaatgccactgcttagtttgatgaggataactgataacacaaacgtttttaagtctaaccagaaaccaaatcaagaatacatggaacctatataaatacaaggaatggtgtgttctcatggagggaaggcgacattaatgaactttctagatgccccacaagaggttgaagtatattttatttctagaaattcagtcgtgacgatactgtagtgtactactcaagtatggacctggattgtagccatgcttaactttattgacaagctaaaaatttataatgtcaaaatttgtcacgaccggaattaacccaacaggcgttccttacgtgcgtgtattattccttgttcc

SEQ ID NO: 8360 - DNA, 1100 bp, Oryza sativa
ttagctgccttgttttcagtgaaccatgtcatataggagcactgccctgattgtgatttttaaaggcagcgccaccattcaagtaacatggcaacaacaacattctaaaaattcacatgagatgcacccgcgacaggttcccagtggatgcatgatgtattcgagagatgcactcacgacaggctctagtggatttatgatgtactcgttagcctgattctagttggaatagtgatgaatcaacggggctatttggtacagctccaactcctaaatattacttcaggagttgagtctggagtggagttgttgagctatctaaacccagctccacaactctagtatattttgtgagatagctccatccaactccactcccaattttggtggagctaaaactgtttggctgagctccagctccaggaggggtggagctggagctgtagctgtgccaaacaggcccaacatattaatccctagtatataatagcgcaataaatataaaagtgaagaatatactacaacctacttgtctatctgatcttcttttcctctctctccacacccttattttaattaactaactgatgccatgtgatgtcatgtaagtaaaaaagcactcctcatttaagctcgggaattaaatatatatggatggtaaccaattgtaactagtttatatttttgttttgttgcgggtaaccagtttttatagttagtggactaaaatcgaaggaccatagtcgacggatcaaatatgtacttttccaaaaaaaaaaatgtccggagaactgttaattgctgagatgcggaatattgcatcttgcttccttaatgatgtactgatacaagcaacttgatcatatgttagacatgaaaaattctagcaagtttcaaatatgataagcacaagttgagtggaaccaatacaatggagggctttttctcagaggatatgcatggataggaaggagatcctctggcgtagaggcttatatgttagagggacgtccaactttggatcgccgtttgtagcgcattcgactgcccataagtgcaacaaacagctacagcatgctcggtttctacccattcacagc

SEQ ID NO: 8361 - DNA, 1501 bp, Oryza sativa
ctagatagacacggcaccgccacggatgcgtagagacacagcgatgagatgatactcacgtgtgacaatagatcgatcgatcaagagttcgccttgcaattacgtcaaaatccgcgctagctagaggccgtgtttagttccaaagttttttttcaaacttccagctttttcatcacatcaaaacttttctacacataaacttccaacttttccgtcacatcgttccaatttcaaccaaacattcaattttggtgtgaactaaacacagccagagctaaccagctgccccgattgccgcgatctcatcagggaacagcgccttgtcgctctcttgtatgttgtgtgatcaactcctataattggcagtgcatgtcggtgcaatcactctacctcctctattcaacgtgcaccgtgttcacgcgctcagtttacttatagcctcgctgcatcggtgctgcattctcctgattactcaatcctagctacatttatatataccggagtcgtggacacaaccgttactccaattagtacgcactcattcattttgcctctgatcaccttgttcgattatatttgtcgctgcagtttaacaagctagcccggcatgcccatgatggcacgattttgctgttgcttttaattaacaccaaaatagtctttgcttccactggcttcatcacctttaacaaagactccactgttttgtgattgaaccaacttgtctcggtccctggtgttaaatctccatccattaatcatataacttgtgtaatgggttactcgagcatcaggacctcttgctagagcaaacaactcttctgatgtatctggagatcctttggaatgtttctcaaatatctggaagaatgtttatacaggttacaaatagttgtaaaatctaaaaaaaaatacttttattatggcgtgtacatacatgattcttgaaccatacaaaaaattctttgtcatggcacttttccacacctttactgttctggatgctaagttggtctttgtgaatgctgcaagacatgtacatgtatgttaaattttgacagcatttacatattagaaaatgagagtaagtagtagttgtttactctgcgtattctgatatttcttcacaattctttagaacatatatccgagctttctccaactcattcatatccatctggcagtatttgttaccaaggagtggcctgccaatagtaccaaatatctgaaattttgtactgctgttgtcactctgcacgtcctcgtttcgacttggttgattgattcttgtttcaactccttgcaggtacatagaacaaaaatttacacattcttgcaaaatatatgcctcagctatcgatccttcagggcgagctttgttttttacaaaagacttcaaccttcgcaaaaacctttcaatgggatacatccaccgatactggacaggtccaccagtaatagcttcctgggctaaatggattggtagatgcaacattacatc

SEQ ID NO: 8362 - DNA, 217 bp, Oryza sativa
tgatccaagagggtggttgaacactattacatcgattggttggcgcgcaaaagggcggctacgtattcatagggattattgtctaataataatataatataaataacaaattagtgtaaactctatctaatgcatccattattcacattcacatttgttattttttaggccgggcccgcttacatctgatagcttataggtcatagactgccctcac

SEQ ID NO: 8363 - DNA, 406 bp, Oryza sativa
attcctgcagccccgccactcgaccgcctgttatcatgttgcatgaaataatttggtacaatttttttcatgttgcatgaaataagttatggaattatataaattgttattacttaattgaaaaatgctacaggacggtatttcattcggataagatgatacctttaaagcatcacctagtacctctgataggtatcggctgatataccgttcggacgggataatatctctgagatatcagctgatatctggtagatgataccactgtcttattttatcggttattaatgctcagtgattatgatttagtacacggcttctaattaaatttcacgggcacccggtagcctacctgtatttttcgaacagtttatcatcatttctttgtttttctctagacgagaca

SEQ ID NO: 8364 - DNA, 542 bp, Oryza sativa
atgcttgtcatatttataataagttcattttttatatataccgcaaaaaaaaaagaatcctatgctgtgcctgtttactgtttcaaagctttagttgaccatcatagtagaagattaaaccaactgatgcagtgttagaaagggacttgtatatacggagtactggcttgtttctctaaagcaaatgtgaaacataaaggcagctggaaaggaatgtgtcttgaaagcatttatgatctgatgtatttttttaaaaaaggtagcccatgatatccaatttggtcttattttcctgtagcccattcatgaatcgcctatgcggctatgctatgcatgatgccacgagtccacgatgctcattcagtctatgacagttttctccaattatgatattgccagtcgatctacgtctctgtatattaagtctgtgttagatgctgtgacaccggagattcattttttcttgttttgggtttagttgcagaacactataactattgattgatggtacaagtatccaatcgaagtttgtagtatatttt

SEQ ID NO: 8365 - DNA, 1501 bp, Oryza sativa
aaacagcaattaattaatgttaacgttaattacctgttatgtttgagtccgcggcgagcttccatacatgctttcgccgcaacgcggggatgcatacccctggtatgaaaacaaagtagagaagtacgtattagatacgggcagttcggcgtgcggcacagtggatatatagtcgcgattaatcggtccatttcattcgtttagcaaaaactgattaaatcaaaatgagctgctcccctaaaactctaactgaagcattttatataatcaccgaaaacatgggcttaagatgaatttaattaaatttatagctcatattctttctttttataactgggaattttttatggatgttgaggcaatgttttagaagaccaaaagttaatttgtgacgaaagatcggttcaaatatgaaaagtgtcgttgtgatccttctgcggtaataacagcaatgtaaacattaattacctatacattttttttaacgaagctcctccgtcctaaaatgtaactatttttaagattggtacaggttaagaaattagatgagaatgatttgaagaagtgtgtgattggttgaaaagaaaaaataggtggagaaaaatggttgtgattggttgaaaggatgaggaaagtggagaaataactttattttagtataaaatactgtgctaaaaatagctatattttgggacgaatgatgtacctgttaagtttcagtccaccgcgagcttccatacgggtttccgttgcaacgccggaatgcatacacctggaatgaaaacaaagtcgacaagtattagatataggcaattggacggcactggggtctggggatggaggagaggctctctcaccgtctcatccgccgaccggccggccggcggcagctgacaaggcttttcttgcctgacgaaactgggagcgaacagtacaatgtgagatgcaggaccaaaaaagaaaatggcagcaagaaaggcaaacaaatggaaaccggggacactcaccggctcactgatggccagatcgacgagggccgcggcagataggccccctggagctacctgaaactgtgagcgaacagtaaattgtgatgaatctgagagcagagagcagcacaaaaaaaaatttttgggtgcaatgcgatgggagtaaaaacccgggacactcaccggctcaccaacgggagaacgagggaggccgcggcagcggacaagaggctccagagcgaacatttaaaaccggagcagcgaggacgactgcaggtggtcgtgtggcatgatcgcggcaggtgaggggttcgtgtggcgtgatcgcgaccgggtcattttctcgggtgcgtctagcgtgattgcgaccgggtcatcttgtgggtctagccattgagtggcagtgtggctgcaaaaactagaattacattcatgtgctaggagttagaaacatgccatcctttctttggatacaagtgcatccaactaatgtgaccatggttactgaaaga

SEQ ID NO: 8366 - DNA, 1501 bp, Oryza sativa
ttctcatagacatctgcgagccgcctaaccgctttgaaaaactgattttagctgtccgctatctgcagaaatcttttccataaatcttttctatggtagtggcttaaacaaatctctaatattataaaaattgaagatgtttttgccggtattttggtacgtcgttcttgtttgagtcggtttttaatttcgctcacttttaaaaatatagattaatgtttgagtcagtttttatatttgttcgcttttgtaaatacaaaaggagtcgtataagaaatatttaaaaaaaaactcatatgctaacttgagatgaaagtcggactcctaattgcagctcatgattttctttaaaaaaatcaagtgaatttctagagtaaattttatcttagctaaaccgtataacaataataagattaaaatatctttcaccagttgcaatgcacgggcattttttctagtaaggatgatgtggcacaatgtgagagctggtaatgggttagagatgaaccctgagctcctttcgataagctcatggctttgattggcatgatatttaggcgagttgatgataactataatttggaagaaacgttaacgacatgactacaaccgtacgagacattattgtgttgcgctttagtgatcaatatacctctccgcgagtttttaatcttgccggtgcagatcaaccttatttctgcaagcaaatcaaagaaacaagcaaaacaagataaaagcaatctggattacaaatagaaatttaatacaaataataagttgggtttccgtaacgagcaaaccggcgatctaaccaatcacaagattacatggcaaatagcgaagctaaactttaatataaacaatacccaagaaaccctgaagggtaccttgttatttaaggaggtgggaggaccgccaaggggtctctagggtcatactccaccaggttgggatgcacccacatgggctccacttgtgccagggttccaaattgaagttacaagcctataggctcatcataggtgatgtagcatattgtttttgtgatttcaactgactaagatggaatttggagatgatgctagattcattggaaagagaactctgagagctttgcatcatgtactcacaagttaaaaacgaagcttctatgtatatttggtggctgttcgaaatcaatattgttgtaggtgactgaactagattccgtaccttttacggcttgatctcgatatctttcagtaaccatggtcacattagttggatgcacttgtatccaaagaaaggatggcatgtttctaactcctagcacatgaatgtaattctagtttttgcagccacactgccactcaatggctagacccacaagatgacccggtcgcaatcacgctagacgcacccgagaaaatgacccggtcgcgatcacgccacacgaacccctcacctgccgcgatcatgccacacgaccacctgcagtcgtcctcgctgctccggttttaaa

SEQ ID NO: 8367 - DNA, 1501 bp, Oryza sativa
ggctccacttgtgccagggttccaaattgaagttacaagcctataggctcatcataggtgatgtagcatattgtttttgtgatttcaactgactaagatggaatttggagatgatgctagattcattggaaagagaactctgagagctttgcatcatgtactcacaagttaaaaacgaagcttctatgtatatttggtggctgttcgaaatcaatattgttgtaggtgactgaactagattccgtaccttttacggcttgatctcgatatctttcagtaaccatggtcacattagttggatgcacttgtatccaaagaaaggatggcatgtttctaactcctagcacatgaatgtaattctagtttttgcagccacactgccactcaatggctagacccacaagatgacccggtcgcaatcacgctagacgcacccgagaaaatgacccggtcgcgatcacgccacacgaacccctcacctgccgcgatcatgccacacgaccacctgcagtcgtcctcgctgctccggttttaaatgttcgctctggagcctcttgtccgctgccgcggcctccctcgttctcccgttggtgagccggtgagtgtcccgggtttttactcccatcgcattgcacccaaaaatttttttttgtgctgctctctgctctcagattcatcacaatttactgttcgctcacagtttcaggtagctccagggggcctatctgccgcggccctcgtcgatctggccatcagtgagccggtgagtgtccccggtttccatttgtttgcctttcttgctgccattttcttttttggtcctgcatctcacattgtactgttcgctcccagtttcgtcaggcaagaaaagccttgtcagctgccgccggccggccggtcggcggatgagacggtgagagagcctctcctccatccccagaccccagtgccgtccaattgcctatatctaatacttgtcgactttgttttcattccaggtgtatgcattccggcgttgcaacggaaacccgtatggaagctcgcggtggactgaaacttaacaggtacatcattcgtcccaaaatatagctatttttagcacagtattttatactaaaataaagttatttctccactttcctcatcctttcaaccaatcacaaccatttttctccacctattttttcttttcaaccaatcacacacttcttcaaatcattctcatctaatttcttaacctgtaccaatcttaaaaatagttacattttaggacggaggagcttcgttaaaaaaaatgtataggtaattaatgtttacattgctgttattaccgcagaaggatcacaacgacacttttcatatttgaaccgatctttcgtcacaaattaacttttggtcttctaaaacattgcctcaacatccataaaaaattcccagttataaaaagaaagaatatgagctataaatttaattaaattcatcttaagcccatgttttcggt

SEQ ID NO: 8368 - DNA, 229 bp, Oryza sativa
ttgagatataaagcgttgaaatacactttattggatgatgagctttactatcgaacgattgatggggtgttgctcaagtgtttgagtgccgatcaggctaaagttgcaatcggcgaagtccatgaaggaatttgtcgcactcatcaattggctcataagatgaagtggttgcttcgacgtgcggggtatttttggccgacaatgctggaggattgtttttgatattaca

SEQ ID NO: 8369 - DNA, 1501 bp, Oryza sativa
ggaaagaggccgtgacaggacccttcgcataaccccctctaatcaagcacaccatacctcaggtttcacccccgtccccagcgggcaacgggcagtcccctctcgtgcctaggtgaatccggaagcgacagaggccgtcgcagggcccgccccactccatcacgcccacccttgcctggatgcgtcagctagaggaaagctacactacaagcccagccgttgcccacgctggcttgtggtgagtacgaggaattcttccagggtttcccgcgaaccggtccttaagtgccatgggtgcgaccatcaaaaccatacacccacagcccaccatttagttaattttaattaaccaacaccggagcggtgacactaaaccaacatgaacactaaaacctgaagtctagtcattaatgtgattcccccattgtgtgctagttgaactaagcatggctaagcaatccctagtccaatatctagtcatgttatatcccaggctaacaaaggaacatggtacaaatatcatggcggtaacagtaggtaaacatcccatggtaacattataaaacaatgcaatatttaagggaaaacgatagagcatttgtaatataggttcaatatgttcaagtgacaagcatgacttgccttgctctgctgctggaggaaactcggcgactatttcaaagtacaccggagcgccggaagagccgcaatctaagcgacatacaaagcaaacaatacaaacaggccataagactactgaaacaaagaacaaaattatttttaatggattctttgcatttttcttgatttactgagacttgaatgggcttaaacagagctcggatgaattttctatgaattttagaagattcactaagtttttactataaacagaaaaacccttaaatgatttattgtgcaataaataaaccctgggagagagagggggcggcgccgacatgcgggccccacatggcagtgactcgggtggcggtccgcggtggaccggttcgacggaccgggaaaggggcggcgcaccacgtggagctaacgtggcaccgatgcaggggccacgcggcagccacgcgggcggccgaacggacggccccgatcgacccggggtggatcggacggcagaggggtggcacgtggccggcgcacacgggtggctcaagccggcccggcggccacggcgcgcggcgacgtggcattgacgcagcggtggcgcaaggcggcgaccggctggcggtggagggcggcggcgcggcggctaagcggcgcgcgagagagagagatggagaggaggatgggcctcaccgaagaatattgacgacggcgagcgacggagggcgatggcgacggcgggacgagctccgggatcacctaagggaacaaaaagggaggagttagagagggggagagaaaccatggatggctagggtgccggccatggcgaagctcaccggcgtgcggtgcgaacggggttcctgcggcggaaaac

SEQ ID NO: 8370 - DNA, 1501 bp, Oryza sativa
tgaatcatttgtattattattttattaatggaggctttattttaattatgtacatatttcacttgtcaaaataaattataaaaggttaacaattacccctgctttgtatgttagaattgtttaggttaatcatattatggttacggattatcccatcacataattttacaatgaataatccaaatttacagttgatctgtaattatacgaggacaagatgtatagctagtatttatctaatattcatgtttgtcttatactccctctaaattaatatatgcaacaagcaaattaatacgataccatatatctataatgggatgtacaatatacgtgtgcacaatatcttaatatattgaatcatttatttgaatagtttctatttactgcttggttaactaagggttgctcacctctcctaatatatgctattatatgggatatgtcgttgattaatttcatataggtgatttaatcacactagctctgttattatttgccataaacaagcttaggaccgatctatgtgtatctatattttacttacctaataattataaggctaactctatttaaataactaataagtcgtgggttttaattatatttggacatagattaataaatggcactaatattttcctatatatccattaatttcaaacattgattatacttaatttatgtggttgctacagtgacaaaacatattaaggataattattctactgtacaatatccatttttatttattggcacactatttaggttaactattatctaatcatttgatattaattaatttataattataaatatattttattaaatagttaattgtataccattggtaagcttatgaatttagatgaatttaggttcaagtttcactcgaatcggagttaaaacgaataagttacgctagtttatggattcaaattggaataaatccgaaaaattgtaaaaggctactgttcctaattcatttatttatactacaaccttatccacaagctatagtgactgacaggtggggcccactctaccctctcttcttttttttcttttctcttttcttttcttccttttccttctctttttctttcacctttctttcttttctttttttccttctccctcccggcttctcccttcctctctctctcgactcaagctaccccgggcggcgacggcggcggaacgagggaaggggcggcggcttaccgacggcggcggcggcgcaaggcaaggcgacgctcggcacgacacacggcgcggtgcggcggcaccgagggcggcagcgcggcggcaccagggcggcagcgcggcggcacgagggcggcggcgcagtggcacgagagcggcggcgcggtggagagggaagaggggaggaggagggaaatgcagtggggaaaagtggggagggggtggggtatttatagggaagagagggagaaggagaggggaaggggcggcggcttaatggcgatgcgacggcgcg

SEQ ID NO: 8371 - DNA, 1501 bp, Oryza sativa
aaaagtagagtatagagtccatatagaaatacaattaggaaataatagaaattcagaattaaaaataaggaatattagaagtagagcatagagttcatgcagaaatacaattaagaaaaaaaatagaaattcggaattaaaaaataaggaatattagaagtagagtatagagtccatataggaatttaaaactaactaaagttcggaataaaaagagcctccacgttcgctcttatgaccgagaaattctcacattaatcggagaaaaagaaaaaaagcagagtccatacagaaatacaatttagaaatagctgaaattcagaattaaaaaataaggaatattagaagtagagtatagggtccatataagaatttaaaactaactaaaattcggaataaaaaggagcctccacgttcgctctcatgacctaaaattctcacattaattggagaaaagaaaaagatttataaatagctgaaattcggaattaaaaaataaagaatattagaagagcagactagagtccatatagaaatacaattaggaaataactgaaattcggaattaaaaataaggaatattagaagtagaatatagagttcatatagaaatacaattaggaaataatggaaattcgatattaaaaataaggaatattagaagtagagtatagagtccatatagaaatacaattaagaaaaaaaatagaaattcggaattaaaaaataagaaatattagaagtagagtatagagtccatataggaatttaaaactaactaaaattcagaataaacataataaaatgaaaagtagtgtttagagtccgtataaaaatataatttacaaataactaaaattcgaaattaaaaaaaacatgggaagaagagtttaaagttaagataggaatacaatttagaagtaactgaaattaaaattaaaaattaaagaatattgaaagatgagtttagagtccacgtagaaatacaattagaaataataaaaattcaaaattaaaaaaaaatattaaaagacaagtctaaagtccataaaggaatatatatgatttacaaataactaaaatttgatattaaaaataattaataactaacacgtatataaaatacaatataaatattacacatcagtagtttcgtaaagttattgcaaaatttaaaattatgttgtcattgtaatatattttaataatataatgacaaaacgtatatgctattatatgagagaaaatataatgatactatccgcgcaatttacgcgggacaccttgctagtttacaatatataaacatataagatgtttaaaccgttacaataatagttcacagcccacactggtgcaattgggctaatcagagcgattcggcatcaacatgtcttatatatacgtcggacgtccgaaaatttgcgaaatatcagacgatgctccgcatgcccctctacccctgctgttgccgtttttttgacaaattggtccttataga

SEQ ID NO: 8372 - DNA, 1501 bp, Oryza sativa
aacatgctcgaccagtttcagactttcagtaccagttcactttaaaaaccaaaagtgataccaatattatttttagtgatggttttaaataactaggaatgctgtggtggtcgggattgatggttgtgtggtaatgtaaatttcataataatataatactccctccgtcccaaaatataacaacttttagcccttaggatttatcccaaaatataacaacttcttcaccaatattctcttcccaaccaatcacaattctccactattcacttctacctactttcttaataaccgtgttcaactctaaaacttcttatattatggaacggactccactattcacttctacttattttcttaataaccgtgttcaactttaaaacttcttatattatggaacggactccactattcacttctacttattttcttaataaccgtgttcaactctaaaacttcttatattgtggaacggagggagtagtttgctttgtttctacttcccgagttaacttatatctgttttatgcttatttagaatataggtttttttagtctttttggaaggacccacaccaaagtaatatatatatatatatatatatatatatatatatatatatatatatatatatatatatatatatattccaagctagaacattaatctttgtttcatctggatgtgtgtgttgttggatgtcgacactatttggtttcagccggaaaaaaaacggcattacaaatccgagaatttccacactggtgcttgccgtgcataaacttacgatatagatgcaatctatctattatattactagcaaaatgcccatgcgttgtactgggggaagaaaaaaatagtaattagtgtgtgggagcataaacaccaggttcattgaggtctttatagtcgaatcgaatctttctagtgcaaataagacgctaacatgatataattatttgttgctctaaatccactgacatggatactaaactttgaaaccacaaaaaaatatttacttttttgtcatgtattattatgagtcaattgcagtactttgttattttttttactcgatattgataagcactttttttcatattgtaaagagtaaccataatataagatatattttttgctagctatcagattaacctcactgcactccaattgcataaccactcacttaaataatcagaaggaaagaaaaaaatgtggtatatcgcagaataactttcactctaaataatagaagaaattatacgatgaatgaaaaaaagtgatgtgattaggtgtcctgtggcgaatgagcaattgatgagggaaaaaaaatccaaatgtaaacacgattcaatttgttggtgattactttttttttaaaaaaaagaaagacacatgtgattatttttatttttaaaaaagaatttattttgtcggtaaataattcattttattggtgactacatgttttaagtaataagatctcttctttactttatt

SEQ ID NO: 8373 - DNA, 1501 bp, Oryza sativa
aataagaagccaaattagactttaaataggtctcgaaggatttcaattctacaggaaaattttcctatgaaagtgtttgaaacaaaagattgaatcatatgctattctttgaaatttctattaaatggacaatcctatcgagattttaaaggaaatttaacaagtgctctaacctcttggaaatttttctttgagtctatctctctcatataattcttttgtttttcctgcggtctaatcaaaagattatttctgtgttttttttgtgtgttttgcaatcctctattttgaacttgcattcctatcaaaattctgcatttttcctattcctttttttttttcaatcctgctattcaaaatagcccttatgaattttagggtttggattaggtgagttgggttaggctaatagacttttaattctaagtttgaaaattagtttcttaaatattttagttcatgttaaggttttagaaaataaataatatttatttcctttttttaatataatttattgatttaaattaattcgtaatcatgtttttaataaatgttgtatgaatttcatattttaatttagaatttaaatatgttttttaattatcctctggatttatttattttatttttttgcactggcacagaaagggaaaatccaataaataccagcgtgatgcaatttgaaaaaggttttattattctaaatgtttgtctccaaattttcagatttaactattcaaacttgacaaataacgatccccccacttaatctgaagtggttttggttctacgtggcattcgcgtcacaatctggtcattatttttttattaaaaaaatcaatgagccacacctattagattctctcccttttcttatatattttcccttcttcagtgattaaattgaattaaactccaacatgctcgaccagtttcagactttcagtaccagttcactttaaaaaccaaaagtgataccaatattatttttagtgatggttttaaataactaggaatgctgtggtggtcgggattgatggttgtgtggtaatgtaaatttcataataatataatactccctccgtcccaaaatataacaacttttagcccttaggatttatcccaaaatataacaacttcttcaccaatattctcttcccaaccaatcacaattctccactattcacttctacctactttcttaataaccgtgttcaactctaaaacttcttatattatggaacggactccactattcacttctacttattttcttaataaccgtgttcaactttaaaacttcttatattatggaacggactccactattcacttctacttattttcttaataaccgtgttcaactctaaaacttcttatattgtggaacggagggagtagtttgctttgtttctacttcccgagttaacttatatctgttttatgcttatttagaatataggtttttttagtctttttggaaggacccacaccaaagtaa

SEQ ID NO: 8374 - DNA, 876 bp, Oryza sativa
ataaaggagagaagaaaaataaaaagagaaaaccttgtttgtggagcagtccatccaaagcagcccggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtaaagaagagatcttattacttaaaacatgtagtcaccaataaaatgaattatttaccgacaaaataaattcttttttaaaaataaaaataatcacatgtgtctttcttttttttaaaaaaaaagtaatcaccaacaaattgaatcgtgtttacatttggattttttttccctcatcaattgctcattcgccacaggacacctaatcacatcactttttttcattcatcgtataatttcttctattatttagagtgaaagttattctgcgatataccacatttttttctttccttctgattatttaagtgagtggttatgcaattggagtgcagtgaggttaatctgatagctagcaaaaaatatatcttatattatggttactctttacaatatgaaaaaaagtgcttatcaatatcgagtaaaaaaaataacaaagtactgcaattgactcataataatacatgacaaaaaagtaaatatttttttgtggtttcaaagtttagtatccatgtcagtggatttagagcaacaaataattatatcatgttagcgtcttatttgcactagaaagattcgattcgactataaagacctcaatgaacctggtgtttatgctcccacacactaattactatttttttcttcccccagt

SEQ ID NO: 8375 - DNA, 1501 bp, Oryza sativa
gcactagaaagattcgattcgactataaagacctcaatgaacctggtgtttatgctcccacacactaattactatttttttcttcccccagtacaacgcatgggcattttgctagtaatataatagatagattgcatctatatcgtaagtttatgcacggcaagcaccagtgtggaaattctcggatttgtaatgccgttttttttccggctgaaaccaaatagtgtcgacatccaacaacacacacatccagatgaaacaaagattaatgttctagcttggaatatatatatatatatatatatatatatatatatatatatatatatatatatatatatatatatattactttggtgtgggtccttccaaaaagactaaaaaaacctatattctaaataagcataaaacagatataagttaactcgggaagtagaaacaaagcaaactactccctccgttccacaatataagaagttttagagttgaacacggttattaagaaaataagtagaagtgaatagtggagtccgttccataatataagaagttttaaagttgaacacggttattaagaaaataagtagaagtgaatagtggagtccgttccataatataagaagttttagagttgaacacggttattaagaaagtaggtagaagtgaatagtggagaattgtgattggttgggaagagaatattggtgaagaagttgttatattttgggataaatcctaagggctaaaagttgttatattttgggacggagggagtattatattattatgaaatttacattaccacacaaccatcaatcccgaccaccacagcattcctagttatttaaaaccatcactaaaaataatattggtatcacttttggtttttaaagtgaactggtactgaaagtctgaaactggtcgagcatgttggagtttaattcaatttaatcactgaagaagggaaaatatataagaaaagggagagaatctaataggtgtggctcattgatttttttaataaaaaaataatgaccagattgtgacgcgaatgccacgtagaaccaaaaccacttcagattaagtggggggatcgttatttgtcaagtttgaatagttaaatctgaaaatttggagacaaacatttagaataataaaacctttttcaaattgcatcacgctggtatttattggattttccctttctgtgccagtgcaaaaaaataaaataaataaatccagaggataattaaaaaacatatttaaattctaaattaaaatatgaaattcatacaacatttattaaaaacatgattacgaattaatttaaatcaataaattatattaaaaaaaggaaataaatattatttattttctaaaaccttaacatgaactaaaatatttaagaaactaattttcaaacttagaattaaaagtctattagcctaacccaactcacctaatccaaaccctaaaattcataagggctattttgaatagc

SEQ ID NO: 8376 - DNA, 1501 bp, Oryza sativa
ttccgtgagccgccgccgtgcacccggtccaccgtgaaccctagccactgacgcaatatccccttttccttttcaaaaataattcattattgcgtcataattcaattaaaatccatataaatgatttaatccgatttaatctttgaaaattcataactaattcatcttagctcggatttagttggttcaagtctttaaatttttctaaaattgagatctacatgttaaaaatatccacatgtattgttcatgcttgtttatgtgctgttttagtgatttttttcttttctctttagattccgacgttcccggaaagtccgattttgcaggagaagattttgaggaattccaaggccagcaaggcaagtcacacagatcccaaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatatattggttcagctagatattagatatgattgctcagccatgcttagaaacactatttcatataaatgggatacttatgactcactattatttaatgatggcttaatgatagctcacgatggtcaatcgtgattggttaattaattaaattgccaactaaaacctgataatggtgggttgtgagtacatggttttgatggtcgtgctcatgacaattaaggaccggttcacgattttcggttgtgaaacatttaccgtgccaaccacaagccagcgtgggcaacggctttactttctgtatagtatggttcatagcagagcaccagactgtgaagtggcagagataagcccacgggggtcgctgaggagtccatgccttgtttataagggggtgattatgatctgggaatggtgcaccgctttgaattgtattatatagagggtattgtcacaatctctattcgggaacttgttaagtatcgcgacgcatggttgacatgatgttgaggttgtgtcttgtgggtacagtggtacacctctggccagagtttaaactattcgaatagccgtgcccgcggtaatgggcgggtctaacaatgtctttcgtgattagtctcatatttcacaccataataattgatgatgttaataatttgtttagctcctggtttggaatggtacattcctggtttggagatagaactgtgcagccgagattggttgtttagaatggttgggcctatgcaacagggtatgttgtatagcattggattaatactgtttaattaaatactttactgttttattaaattctgaaatatttattaaatgctatttatgcaaatgagactatactatgccaccctttgttatcctgtgcacttgcatatttgctgcgtggcttgctgagtatgtcatatactcaccttgtaatcattcatca

SEQ ID NO: 8377 - DNA, 1501 bp, Oryza sativa
aaaattaaatccatcaatgctttaaatttaggaaattttatttcccacatttaacttcacttgtaaattaatgaacatttaatataaattctattaataatttattagataatttataaatcctaaaacgaaaatctggctgtgacagccgcccttcctcctcgtcggattcgagctcgcgacgtcgctctctgtctcggccgtcgccgccgagctccggtccgccgccgtcgtcgccctggaccgcctcccacctcggcgccgcctccttcggcttcgccgcatcctcgccgacctcgtccgcctctccgtttcggtcgccgaccaccggagcgccgccgtccccgttgacccgagccgcgccaccgcctccctccgctccgaccacctcctccgtcgccgccgtcgccctggggtgagccgtggaccgccgcctcgtttcccccttccctcccatctctcggccgccgctccgccgcgccggtggttgccggcggcgaccatcggggctcgggcgcgccgcctcccgccaaccgcgccggcatggccgccctcgggcgtgccgagtggctgccgcgtggggcccggccgtcagccgcctgcgccctcgggtgcggctgacgtgtgtggctcatggcgccggccggtgtgagcccgggtgcacccggtccaccgtggaccgtgaggctgccgcgtgggccccactcccgtggacccggtccgcgcgccccctccccctgggctgacgcaataaaccctttttaaattaaaatttaaatgaagaaattcgcaaatattcatttaaagagcatataaacttcaaatggccataacctggtcatttgaactcggaattggaccgttcaagtctctaatttttccttaagaagtcaagaacccatatttgtgctttgttcctgctcattatatggagtttattagagtaaaagcctttttcttttccgttggtcgtgtagacgctgcagcttcggaagatccgctcttcgtggatgttgaagccgacgtttgggaaagcgagcaaggcaaggcacatcatccttgaacatattgaatcccaatttatgaaattactttgatttaaattattgcattatcgctttacttaaattcccgcgttatcactgttttatttagccatgcctatttacctttgttatgaccatattattattgctattgttattattaccttgttcaccctagaataaaccaaaccccaactagtgggcactctactcaaggttcccctagtatgaatttaggtagatgcttcgctggttaattaggcaacattaggtggttctacaactctagacattgggaatattctcatcacttggacactatggaatggttggattattgtggaaattggattcacacctccacctctattcaaaacccccaaaatggttttaggctgggctcgaggtgcgtggttgggttttgtttgtcgtacctcgggcactataaggattaa

SEQ ID NO: 8378 - DNA, 1466 bp, Oryza sativa
tgggagatgatccaatgggaaggaactcatcaaggtcaaaggtgtaaaggaatacgttgaatgctaaataatgacaacctgaagataatagtgggaagtaaactaaatgtaaagaaagtgaatccgagctgcttgttcgtgggagctattcccagttatgaaccaagtgatatgttcgaagatagtctacagaggtcagaataaaatcacatctaacaacgaagcttcagatttggcaggataacgatcagacaataagaagtccagcagtaaagccatttgggaagacgtcaaagcatgtcaagtgggataagttggttctgttgagaaacataattcaaaggcaaaagttatcgaccctcgcatcgaatagcagtagtatctagcacctggagagcaggaaagctaatatgaggcagttggtggcaagttagaagtaaatgacaaacatgatattctcatgatgacaagcatggtatcctagtaatgacaagctgatatcgacgcataacgtgaagtgggtaacttgtatgaggttgacgccaaagatatgaattataagaagttctggaactgaagccccatcttcaagtgccgcacccagttgaagtcagctaaaggttcaactagggacaagtcaggtgaagagaagattccatctgcaacaggagatcaagccaagcagtccagagtggagaagttttgctaggcaagtttgttatagaagacgcgacggatgaagtcagacaagaagagaagaccgcccaacctatcttcttgctagcctcgaatctcggggatgagattcctgtaagaggggtggatttgtcacgttctgataaattcatcccgaaataaaaaacattccctaaaaggaataatagaattaattaaaattcgaaaagaaattggcaaacactaaaatacgtacaagaaaatttcgaatgtagcccggagaatttttgttaaattctccttggtctaaaaggagccctcaaattttacttgaattttcagagtaccaaaaatatttattaagcaacaacaacaattatcaaagtttattaaaaagaaaaagctaaaaataatccccctcctccctttgggcccgcccgccacccttgctgacgtgtggggcccacccgtcatccccgacctcccgccgctccctccgctccgcccgcgccaagcgccgccgccgccgccgaatccgccgcatcccgtcgtccccgcgtgcaatcaataggggggaattattccccgtgattccctctccctttccccaaattttccctccctctctcccttggattcgtttggaaacccctcccctaatcccgccggcgccattgatggcggccggacctcccgcgccggtttccttcccctctggccgccctctcccccttccaaccctatttaaaccctccccgtgcctcccccgtccgtttccgcctctcgccgct

SEQ ID NO: 8379 - DNA, 1334 bp, Oryza sativa
tatcaagacaagaaattttgaaacatgagttctcatactccaaaactggggggcatgtgttaacagtgaaatttggtaagcccaaagttaccattggcttagagtcagtatcgacttcaaagttctagaattagccgatgggagtcaagtcgccatgatgtcgtgttcttggtggagttggatcaatcagagttggggtcatcggcccttggttgaacaggaaggagttgatggtgttggaccagaaataggtggcagcggccatcaagtgttcatctttggccgaattagctatggtgagagcgagggcttggccaattccaattttgtcccaatgggtgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaacataacaggagctaagccttgacttgaactgcagcgggaacaccactccacaggcatcctcgatggcacggacgaagcctactccccggagaaaccaccatctgacacatactcatactctggggttggggaaaatagagcaagactgagtactacccactgtactcagcaagtcataccggaataggggtatgatgcagggaattatcaaaggagagatagagcggtgaaactaatcacggtgaatctggttgaccgcccataaccgcgggcacggctattcgaatagttttactctgatcagaggtgtacaactgtacccacaagacacagccccacgacacgtttccgtgcgccgacatgccaccacggcataccggaaagaggccgtgataggacccttcgcataacctcctctaaccaagcacaccacacttcaggtttcacccccactcctcgcaaggcagcgggcagtcccctctcgtgcctaggtgaatccggaagcgacagaggccgtcgcagggcccgccccgttccatcacacccacccttgcctggatgcgtcagctagaggaaagctacactacaagcccagccgttgcccacgctggcttgtggtaagtacgataagttcttccagggcatccggcgaaccggtccttaactgccatgggtgcggccaacaaaacaatgcacccatagcccaccatgtgattcattttaattattcaacaccaaagaggtggtactaatccaacattaccattagaacctgcagtctatactttaataggatttttccccaatgtgtgctagttgaactaagcatggctaagc

SEQ ID NO: 8380 - DNA, 1501 bp, Oryza sativa
atttggaaacccctcccctaatcccgccgacgccattgatggcggccggacctcccgcgccggtttccttcccctccggccgccctctcccccttccaaccctatttaaaccctccccgtgcctcccctgtccgtttccgcctctcgccacccttcctcctcgccggattcgagctcgcgacgtcactctctctctccgccatcgcctccgagctccggtccgccgccgtcatcgccccggaccgcctcccacctcggcgccggcctccttcggcttcgccgcatcctcgccgacctcgtccacctgtccgtttcggtcgctgaccgccggagcgctgctgtccccgtcgacccgagccgcgccaccgcctccctccactccggccgcctcctctgtcgccgccgtcgccccggggtgagccgtggaccgccgcctcgtttcccccttccctcccctctctcggctgccgctccgctgcgccggtggtcgccggcggcgaccatcggggcgcgggcgcgccgcctcccgccaaccgcgccgacatggccaccctcgggcgcgccgagtggctgccacgtgtggcccggccgtcagccgcccgcgccctcgggtgcggctgacgtgtggggcccacggcgccgaccggtgtgagcccgggtgcacccggtccaccgtggaccgtgaggctgccgcgtgggccccactcccgtggacccggtccgcgtgccccctccccctcgactgacgcaataaaccctttttaaattaaaatttaaatgaagaaattcgcaaatattcatttaaagagcatataaacttcaaatggacataacctggccatttgaactcggaattggaccgttcaagtctctaatttttccttaagaagtcaagaacccatatttgtgctttgttcctgctcgttatatggagtttattagaataaaagcatttttcttttccgttggtcgtgtagacgctgcagcttcggaagatccgctcttcgtggaggttgaagccgacgtttgggaaagcgagcaaggcaaggcacatcatccttgaacatattgaatcccaatttatgaaattactttgatttaaattattgcattatcgctttacttaaattcccgcgttatcactgttttatttagccatgcctatttacctttgttatgaccttattattattgctattgttattattaccttgttcaccctagaataaaccaaaccccaactagtgggcactctactcaaggttccccttgtatgaatttaggtagatgcttcgctggttaaataggcaacattaggtggttttacaactctagactttgggaatattctcatcacatggacactatggaatggttggattattgtggaaattggattcacacctccacctctattcaaaacccccaaaatggttttaggctgggctcgaggtgcgtggttgggtttcatttgtcgtacctcgggtactataaggattga

SEQ ID NO: 8381 - DNA, 1501 bp, Oryza sativa
cgtataaaactatcacactaaactgaattgaagttagaagtcaaggagtagctgagatgtccataccagcagcaacaagagttgacatagtaacatggttcagaccattacattttttaacgaatataaccattacattttgcaactataaatatatattgatcacttcatcaatgcatccatgattgaatttgtgacgtgtgtgctgttcagaacgtgtagggatagcaattattataccagatgggtgtcacaatttgtaaagttgcctcttggtttatgaattcaagaatcaagaatccttgatcagaagtcagaactcttcactgaacactcaagcatgcagcatgcttacaggggatgtgtttctggacaagtgtctgttggattaccataacaaaagagagagaaaataaaaccaacagcctaatttcattttttgaaaaaaaagatgtgagatgttatggaggaactttgcatctgttattgatagagggtaaaaatggtgagaaaaccaatgcacgccctggtagcgctcctacgggttatggcaccgttcttaatagcctaacttgttaacaagctgccaacagctcttatgtcaaagttcaataccttgagatatatcaagacaaaagagcttccatcttctcgcccaatcgtcctgcttctaataagatgcatcaagactgagaaaaaaaaaagataaacttgtaaagaacatcagagaaatgcttcgtatgaacatgtaaggttggatatgtaaaaaaatagtgaaatatatcataaacttacaccatagtattacttaggtccacgatcatgttgtttacacccaaatttgacacctatggacaaaataggggaaaattgccaaagtttgagaagtgtcgggtttccttcacagcgccggtcagaccacaagtatgtgggtggtctgaccggctggaagggccggtctgaccgcaggtatgtggccggtcagactgtcagggtccgagtccgagtctgtcagggtccgagtccgagtccgagtctgttttcgtcgggtctcgggtttccttgctcgggaaggcatgtttcgggtttcctttggtttctatcccgagttgggcatggagaagggcctgtagagggcaagaccaacccctgtttaagggacaaggccggttcatagtaaacccccgaatataatctacttgaatcgttcttttaccatgttttctattttaccctagttttagtccatttttgtcgatttacgctgtaaattgtctggcgttgctgcgagagtacgacacctctttgtaggtttatcctgaaaaccttctgttttgcccacgagacgggtagttatcctcatatcgatctaaatatgcctagaggctgattttgatctctaaatcggctccgctagccggtttagttgtttttctacaaaacccatcttgatttggccgtttggctagatcgagatggttggcgactccatgtcaccgca

SEQ ID NO: 8382 - DNA, 1078 bp, Oryza sativa
attcatctcagatccaactagagtccaaccaaacagtccagctccacaaaaaaaatggagcggagtaggcggatcgctctgaaaaaatgtactagcggcgcggagcggcattccccccgctccctaactctaactccaaccaaattttagaagtaccactgaagtttaagaaaaattacccgcaaatgccatcgaactactccctccacccctccccctccccttgcctgtatcgcatcccctcagtccgccgcaccagcgagtctcgcttgcgaaaaaaaaggaggcggcggcgcagcgcatctgcctgaggcacaccagcgacggcgacgaaccggtggcagcggtgagcaggtgcgctctcaaatcccctctcctttcccctcttttctttcctcccccattgtctcttccccctctcttgacctccggcggaccttgttgcagacgagggcgacaacgcacggtggcggcgcacgacggcggaggctcacagcggcagcgcacggcggcggaagctcgaggaagccggtccctatcccccagcaccacaaggtatcaaatctgtaaaaccctagaaatccccccaaatctttccttcggatgacagcatgatttttgtggagtggatttaattttttgggtggatgattgcttgatatttgctcaatcttgtgtcacatggagttgtagatctaacgggtagtggtccatgaggaggccctgagttttcttgctatggtctgtaaaaatctgcaaagatgcgtgctgtaaaaatatgcagagtactatgtgtaacttgatttcagattgatgttatgttctctatttctcttgcagtgtgagaggataacgtataacttgattttagattgatgtatatgcttgagaggataatgtataacttgatttcagattgatacataggtgtataaatgtattataaccctgcatgaacacacaatgtgaaattatagtagtgcattctgaacctttatctaaactttgaaactatggtgtgagtggatggcaggcatggctgaaaatgtgccatcgaagagtgttaaaatgccaattg

SEQ ID NO: 8383 - DNA, 1501 bp, Oryza sativa
atgaatcaaaccgactgcgccaaaatcgttgctagatatagaatctaaacaaaaggaagaacagtttataaacgtgcactttggacttacttttaggaaacaaaaaataaacgtgcagtaactacactcgtgaagcagatgccttttgtgtgttagctttaaatttaattttgacgtgctatgtctcctccaaaattgccgctaatattatgcatacgactctcgatcacctttccctttccccacaaaggacaaccaaaagcgacggaattaatatacaaatcatttctggcgatcgcgattatctggccgaatcctaccaaaatgatactcgtaacccactgtcagattatcatatgcaaagatatccacatctcatgatgcaactagtagctagccaatctattaattgttgattaatcgcgtgctaacctaacgtgtgcatatatacaacgctctaaggaagtattaattattttcaatacggggtcctgaagaaattgctcagctttcagtaacttcaattttttttttatttcaaaccaactagagcgaatgtttattttttaaaagtaaattattaatgtgagaaaccaagttagctcgccgccaccaatatccaagctagctagagtcatctcatgctcgaattttaggtgcattactggataatggaaatctattcagactctacaactataggatagttcttttaattaaattgtatatatcaggattgattgaagctactattacatgagtcctttgaacggcacaagtttagttatcatctatagctatatgttcgattgtggcggttgggaatctttccgcacggtacacaaaatggaataacatattagcgtatcattaattaagtatttactaaaaaataaaaaatggattattaatatatcttttaaaagcaacttttctatagaaaatttttgtaaaaataaaaaacatcgtttaacagtttgagaaacatacgcgtgaaaaatgagtgagtagaagttgggaaagtgtacaggaagaacacagcctatatatgtcccaagatataattcatttcattattaaagaaatatcatagctctctctatatatatagctttgtgaattttgtttacacgtacggattttacaaaatatcttagctatactgatcaaagaagacccgaatttttacccaagtggccggagtttaattaaaagaatactattgagaatagccatgtacctgatcctgtgataccgtgtacgttggaccaaactactgtagtctgtacgtacagtacgttactaaatttagttggcggcatctttcctggaagaacaccaagacaagactattttggtacaaccagcttgtgacggcacagtgccggtgatagtctttcatgtgctggcgtacgtgcaaaaatagtgcacaagtcatgtcaatgcaggtgataaaactttcgatttcttgtcaggccatgtacaaagcgtggctctggct

SEQ ID NO: 8384 - DNA, 1501 bp, Oryza sativa
cctaataggtgccggtttttaaatagaatcggcacctattatccctgttagagaaatatgtcggttttttctctaaaatccggcaccttttatttcccatcacatcggattagttggcgcagggcccaccctagaaccgacacctttatggtgaaagagataagtgctggattttagttaagagccaacacctttctacctccacccctgtactaactgttggtacctctcagacatagatgctagttttagatgtagaaccccggcacctatgagccaactacatatatatcatcccactcgagctgattgagtaagaacagagcagcgcctcttgttcttgcccgattagctggaagcggggggagggggtggttgctcgattttttttggggtttggttgaaggttgaagcctacaaggtgaaattcattatttctcactccgtttcacttttgcttgttgatttacaataccgtgtgctacgtatgcatgtaaaatacatgatcgaaacaattatgtgtcgtttttagggataactctttttcttttttgtgtccattaatctcattagatctattcttggatgatatgctaaatttgagttgatgttttctaccatctatgccatcgatgttagtcaaatgttagtgaaacaccgttaaggacaagaaaatatccattttaccgctatggaaaaatgtgtacccatggcatgatccgatatttttcctcattgatggaaaatataaattatttttctttttttaaccatgaataattaatgtgacatggcattttcaaaaaaaatatcaattttatcttagggataaaatgatcatttctcattgtattttattccaatgttcttgtaaattacaaaaccctcattgtattttttttctgcacgatttttaataaacgataaattattattccctctattccatattataagtcattcggctttttctaagtcaaactttttaaagtttgaccaaggttataagaaaatataataacattttcaatacaaagacatgttatcaaaatatattcaatgttagatttaacaaaactaatttggtgttatagatgttgcttatcttttcttgttcatttataagatctatcggttttgttattgggtaaattgaatttgtatgattcagagtaatctacattaagtaatatttgtatgtacccgcctgttgtaatggatctacgatgggtgtatgaagcggatcgtgactctatggagtatatcaggggagtaacggctttcgttgccatggtgacgagcacaaactcagtggatacgccggattatctgtggtgtccatgctttgattgaatgattgcaagaaagacaggcaatttctggcgcatcgagtccatgcacatcttcttataaggcggctcatggacaagttctatggagaagaggagcaatgcgagggaagtgcaggcaactgtgacatgccaaatgaggatgtcggctg

SEQ ID NO: 8385 - DNA, 1501 bp, Oryza sativa
ccgtacgtgtaaacaaaattcacaaagctatatatatagagagagctatgatatttctttaataatgaaatgaattatatcttgggacatatataggctgtgttcttcctgtacactttcccaacttctactcactcatttttcacgcgtatgtttctcaaactgttaaacgatgttttttatttttacaaaaattttctatagaaaagttgcttttaaaagatatattaataatccattttttattttttagtaaatacttaattaatgatacgctaatatgttattccattttgtgtaccgtgcggaaagattcccaaccgccacaatcgaacatatagctatagatgataactaaacttgtgccgttcaaaggactcatgtaatagtagcttcaatcaatcctgatatatacaatttaattaaaagaactatcctatagttgtagagtctgaatagatttccattatccagtaatgcacctaaaattcgagcatgagatgactctagctagcttggatattggtggcggcgagctaacttggtttctcacattaataatttacttttaaaaaataaacattcgctctagttggtttgaaataaaaaaaaaattgaagttactgaaagctgagcaatttcttcaggaccccgtattgaaaataattaatacttccttagagcgttgtatatatgcacacgttaggttagcacgcgattaatcaacaattaatagattggctagctactagttgcatcatgagatgtggatatctttgcatatgataatctgacagtgggttacgagtatcattttggtaggattcggccagataatcgcgatcgccagaaatgatttgtatattaattccgtcgcttttggttgtcctttgtggggaaagggaaaggtgatcgagagtcgtatgcataatattagcggcaattttggaggagacatagcacgtcaaaattaaatttaaagctaacacacaaaaggcatctgcttcacgagtgtagttactgcacgtttattttttgtttcctaaaagtaagtccaaagtgcacgtttataaactgttcttccttttgtttagattctatatctagcaacgattttggcgcagtcggtttgattcatgacaaaggcgagccgatatgtataagacgaggtgattcagccaagagtacaaaacaaaatggctcattttcaaatgagaaaattatttacagaaactttggagctatatagccatccaaagttcctttctaaatactacaaacacatgcatactttttttgaatctctttcaaaatgtaaggtacatatgcgtgtaggatcaatatgactttctgccttttactatcatttaactatagtctgttgtgttaggtttttatattttgggatggatgaagtattaagtccaccgccccccctcccccccccccaaaaaaaaaaccgcgctcacacacatttcgtatcctcttttggttcaaatca

SEQ ID NO: 8386 - DNA, 1501 bp, Oryza sativa
gtttgggggggaggggtaattcaatcgaccgcgatagttcagaaggctaattcatacttttttcctttttttaataaagacagtttaaatcttgcgccatacctattcgatacaataaatattagtgtaagaaaaaaaagacatatctacagtggtaggacaaacccccgaactcactcgaaaagatgaccaatcaatttagcatttccatatattttttttagataatgaattttcattaatccgatctttatatctatgaaggatatacacagctaaaaatatacaagagcacttagactcacacctcaacaaagaggagaacacacaacaaaaaaaaaagaaaagaaaaacctacgacctcagcacaaccctgcttctcgacatcctctcctgaaatgcccagattcggcgagtggaagttgtctagtcatcgctgcccctagtgtgccgtcattgcgaatctccgctagtgccatgttcatctacttcaagtgagctgacgccacgcgttgccggttagcccaccttcattcgtcatcatccaatcagaactagccgaccagacgcaagctgacaggatctgcttccgcttcgtcggattcctaggcctctgccacccataggccatagggctgccaccttcgactatatccttctccgtctcccagatttctagcccgccgctacccctagggccgccgctgccactgaggaaatcctcttccacccggactccgaggccttccacacctgatgggatccgcctcctcatcgttgagaaccttgcaccggtgcccaggctaccgccgcccctagggttgtagccgccgccgtcgaggaggtcttctgccttgatgcccaggccgccgccgccgcctacaggaccacctccaccggatccgccttctccctgtcgaggactagccatcgacgcttaggtcgccgccgtcctccgccacgttaagtacatgaagataagccctagtataatcttaacacttagtattgttaaaaagtattatcgttacaacaacgatgaattcaagatctttctattgcgtaccaatgagttcatcattgggtgcactcagacatacaacattgtcatctctacaaggttgaggataccgataggactttctcttgctactatgtcacctatggtgttattttgcagatgcttggtcgaaatattgcatcaagtcaaattgttgtagtggtttgttttcatcatgttgtgatatttcattgcaattgttctttcgatttgttgaagcaagatattgcccattttgcatcaagtttttatcgtcaccatttgtgttgcaggcttattgtggacatttacaaacatagtacttgctagattgtaatattaattgttgcggcaggatttgagatattgtatctactatggggagagatagagttcttgtgatatttgattctttttttcgattacacggcacatactactacacaacacacaccatactta

SEQ ID NO: 8387 - DNA, 1214 bp, Oryza sativa
cccttgcgcagatgcagcctccttttgcagttttgttttgctgcgggaaattcggatttgttttgttttgccttttgcagttttgttttgctacgggaaattcggatttgttttattttggaaacattccgaaaaatccggtgcgtgaaaacgtccttttgcagttttgttttgctgcgggaaattcggatttgttttgttttgccttttgcagttttgttttgctacgggaaattcggatttgttttattttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacacgcgaaatcaatctagggtttacctcctactctgtactgcgccgtcgctcgtagactactctatcccgctcgccgacgtgcaccggtgatcgggatagcaggtctccggaacctctgccttcgacgtcctgcaccgggagaagacggcaataaggtttttggaagcgcttcgcgcgactgctccctgttcgtccgcgacggctcgccttcctctccgctcgcgtgcttcgcgccttcgtcgacgctcgcaaccgcgagtagttcctgccgagcaaccggtctttccaccacctcggtacgtgttcgacatgttgcgcatatttgatatgttcatgttttactgcttagtttacatgtgtagatctaatgatgcgttcaatctagtttacatggcttctgcatgagtgagagagtttatcggtgtgctgcagcccatgtgttcatggttgttgatgtggtaaaaaaaaagtagtttggggtggttcaaattgcaatgcaaacaaaattaactaaagatgaggtaaactaatgatggtcaaagtgaaacttaagcaataaaagtagcccaagtagcagtacattctttatttttatcaaaataacagcacaaatagtttgaataaagtcctagataaccaaggaattgaatccaataacatttatagtcatggtgcgtttttataccatagaaacactccattccatcatcgtcactaatctttaaaaacacatccctctcaataaatgtgaatggacaatgattcaagaatcaaattcctgattccttgctaaaatgaaataaaggattaccatgttg

SEQ ID NO: 8388 - DNA, 1501 bp, Oryza sativa
aatcgttgtacattcttagaattgcacttaacatgtcacgtgttacgtcttaaataaaaataaaaccttataagttggaagaaaaaaacatttgacaatcagtttccacttgaataggtggatccattattttttagccaatatgtatacttttaaaaaaagcttaagccaacatgtattacatcttaaatattagattagaagacatattagaaaatatgagaaaaaaatcaaatcatcagatttcacttaaatcatctctactattataaaaattgaagatgtttttgttggtattttagtacttcattcgtatttgagttggtttataagtctgttcgcttttagaaatacatatatgtatttgagtcaaattttaagttcgtttgcttttggaaatacgaaaggagtcgcataagaaatctctttaaaaaaacatgcattctaacttgagataaaagtcaggcacctaactgcatctcatgattttctaaactaaaatatccaagcgaatttccacgatgaatttcaccatagctaaaccgtataacaattacatgattaaaatatcttcacccgttacaacgcacgggcattttttctagtttagaaaggtagaaaaaaaatgcccctccacttcgtcctcccccacacatgcgcacaacacagtactacccaccccctcccctctcggctttagctatccactctacccctccctattttttatagcgagaaataattaaaattattaaaacaatgcataacttttaagctacacatgtaacctctaatcgaactattgttgtattcataattaaaccaataatttaaagatccataacgctaatatttgaacttgtataaaataaaacaagaaatagaaaatgtcaatagggaataaattcaactatttggagaaaatgtaataagttcataaaaaaattggctcttccattaaaattgaaccaaccattgcatgttccatttttataacaattttcaaataccttacatctatataacctataccataggattatgagtttctctgcatattattgcatataagtcacactaatgttcgaaagttatatttgttattattaaagttaattttttggattcatcataactaggtattttctttttaaaaagatagtataaatcacatatattacaagggaaggagtaattgctaaacccgatacggtgataggccgcccctcttgtggtctctgagtcacttgcaatatctacatgtttcatgtggagtaagtcaaatcacctcgctcgctttgcttcgacgaaacttcgacgacgcgttctcaccttcttccacgatgaaacggcgggaaccatttaaagccacaccacgccaattatataagccgagccacaccgccacagacgaagcaacggtaaacaagcacacatccacacaacggcaattaatcattgcagagagctagctagcagtgggcagtggctgctagttagg

SEQ ID NO: 8389 - DNA, 1501 bp, Oryza sativa
tacagccgtacttctcgaatgggtatagacctagcggagtagatagccgagcggaggcagtatccctgcatagtggtttcacttaggtgtgtggacgaacaagcagtctactggcggatacccgatacggatggccaaatggcggatacccgatacggatggctagagactgacttggcaagactacaagactacaaggagatacccaaaaggggacagcatggattgggttcaactacagaatgcgatgttaggcgtgcgtgagttttccccctcgggagcgccagaactcctctcactgctaaaaaccgtgtacgcctagagtgcatgagggcttaagttcatggagcggatactgccaaagtgaggttattgaaaggctttgccgtggcaagtctcattcgttgggacgtaggctcatgtgttgggcaagttgcggagtacgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgatttttttttatgctgatggagccacttcctgagaagcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggctcgtaaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtatcagacactcgtgtatgtgcacttgatatttcagctatgaattcgtgtgtaccaaactacttgatccagggaaatggtactgtttacacgattgattcctgttataaaaacgggggtccacagagctggtatcagagccatacgactgtaggaaaagaccaaaaggcgccccaccccttttctaagttggccaagggagaaattcccatttagtaatactttcaaaaataaaaacgctatgtttacaaaactcggcacaatttttatcttactcttaactattttctttacaaaacaagttttactctcaactgactttgggttttccttaaaattagatggcagattcggattcacccgctacctgggagt

SEQ ID NO: 8390 - DNA, 1501 bp, Oryza sativa
gaaaaatgaaagccccgaattgtgggcgcagggtagcgatctcgccggagtggcatgtcgcgggagtcccgttccggaatgtggtgaacagtgacaacggccatccctctactggttgagctcctcgatctccatctctacagtgacagtctagtactagtagtatacaactacatgcgacttgcacatctctgatctctcttgctgccttgtgtctttttttttcttctcccggatgacttgtgtgtatgtgcatgctgagactaggccagtacaccccaaaattttacactccatcacatcgaacgtttgaacatatgtatgcatgaagtattaaatataggctaaagaaataactaattgcacagattacgactactttgcgatacaaatctttgacaatgtggtgctacagtaaacatatactaataacggattaattaggcttaataaatttatctcgttgtttaatgaataggtttttttgttagtgctgaatacaccataaggtactctatataatatccgatgcggtaaggctgtgtttagttcacgccaaaattggaagtttggttgaaattgaaacgatgtgacggaaaagttaaaagtttactactatatgtgtagaaaagttttgatgtgatggaaaagttggaaatttgaagaaaaactttaaaactaaacacggcataagctaaactcggaaaagttgaaagtttactactatgtaggaaagttttgatacgatgaaaaagttaaaagtttgaagaaaaactttaaaactaaacacggcctaatgtaaactttacccgaggatctttaaacacaccactactagggctgtgtttagttcacgcaaagtttggattttggttgaaattagagatgatgtgactgaaaatttgtgtgtgtatgacaggttgatgtgatgaaaaactacagaagtttggatccaaactggatctaaacacagcctagaggaggaggatccggtgcgtaacaggggcagcagggctagatgtacaacctacgggtaggctgtgctgctgcagcacacggaccgaaacggaaggagtacgctgggcgcaaggcagcagcaggggcggggttgacactacacttggggggctggacggagatcgatgcgcggcaggagctggaatggacggccgcggctgagtacgtgcgtgacgccttgacctcggggaacgaggccgagtttaattcctccgtgtagctagcacgggccactaccgatggctttcatcgaggagaaaattgctagtttgccatcattcaacaggggttttctgacttctgacttgtgagaatactatcttgtagtatgccaaatagtactccctccattccaaattaatctacatatagtttttttaaggttatttctaaatgatctacatatttatattcatttattaggtctattcgttatttgtgtattggagtaagagcagggacaatagcaggctataagccaaat

SEQ ID NO: 8391 - DNA, 1501 bp, Oryza sativa
tgttgaagttgctaagtgcagcgggacggttggtcaccatgacagggggcttccatccggacggagtggctcccttaagtcgctgaggcattgtctgaggtgggcgactcatagcaagcctcctcttgcggttgtgttccaccgtcctttgatcgttctctagcctgacgaccttgttgatcaggctctggaaactctcgtgatcctgcccgatcataggtccacgcaattcatcattcagcccttctatgaacttgtcgatcttttcttcttcatccgccaggtctccaattgcgtagcgagccaactgagtgaacttgtttagatactcctgcaccgttgtattcccttgccgcagtcttctaaactcgttcttcttcatgcgcatcactgcagtaggtacgaaattctcgcgaaacgctgcagtgaactcctcccaggtgggttctccagcaccgtcttctcgggcctccttgtaggtatcccaccaatcaccagcgggtccttccagctggttcactgcgaagatcaccttgtcggcttcgcgtaccctgactagagtcagtttcttttctatgatgcgtagccagtcttctgcttccatgggctcatcggccgtagcgaacgtgggcggcttggtcctcataaactctccaaagcttgaccctccgcggttgccttggttgctcgcgatagcttgcagaagttgagtttgggtggccataattccggccagagtgtttaagtcgggtgtctgagtttcgtcattgctggttgttgcccgacgtcggcttgccatctgtgtaggttgatggagtaagcatcctaattttctaactagctcctatggctttatcccattaagggagttgtgtcgatatgactttgtttcgcaagcatggtggaataaactcatttacaacacaacaacaatagatatcatagataacatcacagagtttcacaaatggtacataaatcatgatgcaattgactgcatacatacgcagtccaaataaggttcatccaaacgatacatcaaaccaatcatcaaactactcgtcaatctaggtaagggaagggggtgtctcgcatactatccaaaaaccatctgatacgagatcgaagctgcaaggagtccgtcagtctaatcctccagccatccgcaggatcccggggcaggtagagggtagtcgctggctcgcgcaaaccggagtccccacggctcagaggtagtggcctctggatctggcttaggcctcttgcctgtcacgtcctgataaattcatcccaaaattaaaaattcattcgctaaaaggaataatagaattaattaaaattcgaaaagaaatcggcaaacactaaaatacgtgcaagaaaaattcgaatgtggcccggagaatttttgttaaattctccttggtctaaaatgagccctcaaattttacttgaattttcagagcaccggaaatatttattaaacaacaacaacaattgtcaa

SEQ ID NO: 8392 - DNA, 260 bp, Oryza sativa
gccacaacagcagccggcgccgccgccttctcctcctccctggtcctcctccgccaccgggcgcttggccgccgcgctcctcctcgtatccaccatctccgcccccctcgctcgctcgcatcgacgcgctgtcctcgtcgccgtcgcggtccgagaggggaggggagagacctcaagctcgccgatggagggggggggagagagctcaagctcgccctgccgccccgctgtcgccgttgagctcgcgccttgctcgccga

SEQ ID NO: 8393 - DNA, 1501 bp, Oryza sativa
gatgagtatagtagtggtgggggcctgttgagaagataaaacgacttatatatatataagtgtcggtgttgatttttgttttaggtgtaaaggaatctttattgaacattttgttcagtacaaaaaagaggcatcattaaaatgatatttagaactaaataaagttgttcgatcagggtttatatggctttatatgtttttcctactatgtatgcaattcatatagtaagtgcaaattaaagccgctgaggtttaaggtgcagtgacatgattcatatcctttcctacaaatacgtgtggttcaaataaacacggaaacatggccagctttgagttacgaccttatcctagttttcaaggggaagttgttagacaaactacacagcttattcgaacctttttattttttttcatcataattagaacctctttaagtaatgcaagaaaaatcaaacactttaaggtactacaatatttttttaggtactaaaaaggaattcgttttttttatagaaaaggtataaataaggcaggagctactactacaagctagtagcgcttaaaccttgcctgtgataatagttcaattttacttatagtgctatagttgcaattgatatgtaccggagacgttcatatgttacggtaagtcactagtatataaactagacccatcaaaatttaaaatctggtggctaccaatgctaaacatatgcgtgagcttttaataagattttattaaggctaagttgccgctgttaattcgttattttgagtatgtgtttagaggtattttatgtacggtgatatgtgtacgtttgcttctttcctgtaataaaaaaaccaattgtatgtgatatttgggataattgtatcctcattttcaatcctttgcaaggaaaataatatagagtttgcagcgggagaatatatggtggtgtttgaatcttctaaagatgaagataaaataaagattaagtgtttcaaaaaaacgaggtggtaataacgtatgattaattgagttttaattattacaaacttagaaaatagattaatatgatattttagagcaactttcatatagaaaattttcacacaaaacacaccgtttagcagtttgaaaagcgtatcatgagtatccaaaattatatcctctgctgatagaagaaacaaacggggatctatttataggttttggagtacgtatatataatgttttgtttctagaaggctaaggttgtcgtcgctgcagaggtttatctccaaaaaccggaaatcaaatcaaaatttgtcctgaaaaactatgaacacgctgtgtcgtacgtcacggcccacgtcatcatcataccgttttaaccttttaactctctctctccctctcatcaccatcatcaccatcatcagtataaatccgccatctcctttctcgcgccgtctcatctcatcttcttcgacgcgtcgcgccggtgagcactcacactctcaccggcggcgggcggcg

SEQ ID NO: 8394 - DNA, 1473 bp, Oryza sativa
acagcaaccgtgtgtcgcagtactcctgcggcacgggcttttctagctgaacttccttgttagccgagtcattagatggcgcttcttttgatatcccattagttcctacagggttaggatatggcggatcacgagtggacttacctccccttgtcgtgatcgccttaacattttcaacggaggagttaggttgccccggaatcctcccagtatcatttgcagggactaaggatgccaactgagctaactgggtctctatcatttgattgaagctcagctggttttgaaaagcagaagtgaagccatctaacttgacattaatgttttctaggatcttatcattggcagcaagctttttgcttagcgcatattggagtcgttcctcgctccaacccatattggagactatcttctctattagttcaatggctccttgaaccgttttagacaagaaggctcttctagctaccgtgtccaagtgatcgtgggacaccggggtgagtccattgtaaaaattctgcaggattagccagtcgtccatcccatgatgaggacaggcggccacgtactcctgcagttgttcccatgctttcggaatagactcatcccttatctgctagaaacttgaaatccttccataaagggcattggttttgcccatcgggaagaattttgagaggaatgccatcaagcatttgtcccaggtattgacagcagcacggttggcataaaaccactactttgctttcccgagaagggagaacagaaacagtcgtggcctgatagcgtcgggactgacgcccttgatggtgtacgtgctacagatctccaggaactgttgcagatgagcattggcatcctcattaggcttgccacagaacgggctagccggcgtcatcgtaatgaggctggacttcaagttgaaatccatacccccaatgttgacctgcggcccaatggccacattgttagtagagggagcagcgaacttgcgaagagtcttgctcgccatagtcttgaaggtcggtggcgctggtatggctggtttctctgttggtagagttttctgcggagcaacgactcgtggtctgacgctccgaaagacagcttccggcaggttgaaaccagtcatgtactactctgttctcacaacaaaagtaaaaacaaccaaggttagcctgcaaaggaaaatgattacacagaggtaaatataaagttttagttcaagtaatctctattatgaatcttccccggcaacggcgccagaaatgcttgttggtatttcttaatgacattactagaaatataattcccagcaatggcacataaatacttctggtatattatggttacagagttcatccgcaagcgcacggatataccattatagcatttcacccaagagtattttaagggtatcgtatttattttatcccgtgggaagatcatgtagagaaaacttgactaataatt

SEQ ID NO: 8395 - DNA, 1501 bp, Oryza sativa
gaagaggaggaggtcgtgccccgccgccgtgaagaggagaagactgcgcgccgctcgccggccacccatcaccgcgccaaccccggagcgccgctgcttgccaaggaggaggagatggagaagggaggaggaggccggtgaggagaaggaggaggagttgccactgctcgccgaggaggagtaggaggaggagaggtagaagggaggaggaggagaggagttatcgctaaggcgttgagtctggggggaggaggagataaagatggattcgtcgcagttggtggttattttaatatagcaaaagtatttttgcagtcggtggtccttgacaaccgcagggaaaattgtattttcactagcggtcggtaaccggaatccctctcaattattttcacaagcgcttttttatcaaacccgccagtaaaaggaaaagggtaacactatgaaaaatgatttttctatagtagtgcgcggtctaaacacgtcaattatatatggcaaactgtttttaatccctcgaggggatgtcctctggtttatttttatttacatgtcatccaaatagttatgaaaaaaaatcacaatatagtttagtatgtaatatatcaattaataaacatgtaagcttaaatttaacttctacaagatgaaaaaagaggaaatatccatttccaatcccatcctaatatatccctaaattgtctgaatatagtatatatactgatctggtggtgtacacacatcaaattaaacaagggcatgtacaactgcattcaattaatgggataagcacaatcagaaatgagtggtgattaacataatcgacgcccatacgtttgtcataattaaaaaatacagctatactaacattttcaattaaaaaatatgttgattttctattacaacttcaaccggcggtattggtacttggctacttgctatctatttgcgatctattttgctatctagcctctttgatcgtcgtacccatgtgtttttagttaaaaaaaatcataaacaagttacaatattaaataaaagaattaatacttagtgatgatgatttatttatagtacagttgagggcggatagtcttttattatatacaggacaactccaacctgtcatatttgtcaaacggacgtgctctatatcctttaaaaagaaatactgtgctaattcgaacatatatatttttggctgtgtatagtacatccaatttaagaggtaagtagagtctgaattttaatccattttttattaaaaagccgaacaaatatatattttttcactacattagcttttgcttcgaagtgcgcgtgctatatatatatatatatatatatatatatatatatatatatatatatatatatatatatatatatatatatatatatatatatataattgcgcccatttctttcctccagcatctcctcagttcacgttggtctcgtggcacatcggatcactggccggaggcaacaacattgatcg

SEQ ID NO: 8396 - DNA, 1501 bp, Oryza sativa
gctggaggcgatggatccgaaactgacgaaggaggatctgccccgctagcagctagatcgggatggagcagcgccggccatgccgcgtcgaaggccggcaaaggaggttgagccgctggcagagaaggccgagacgtaggcgaagggcgtcatggtgccggcaaaggacgttgcagcgcaggcggaggagatcgcggcgccggtggacgaggtggtggcggggccaaggggtggtggcagccacgagtggtggtggaggtggcggcatcccgtctagatccatgccgttctgaccggatatgggaggtggccgctggcggtggggttgagtggtggcggcgtcagctggcgatggtagctgcagtggcggtgatgatcgacaccagtgatggcgactgctagcggcggtgtcacccaggccagcgtcatggcagaggcggcgggttggcgtgtcgtcgacggcgacagcacgaggtggaggcggggaaggaggagaccggtgaggtgtcgacagcgggatgcgggcgatggcaacttcggcaagaggtgcgggcggctgtggatgagatacaggcgactagccgggagggagggggaggcatgggcgacgacagcagctggccgacggaggagccgacgtgactggaggcgcggctagaggtccgcacgacgcgaggaggcgcaaccagcgggtggtagaggccggtgcgttgtggcggcatgcggaggctggtcgccagggggcgttagtgcagcggtgccacgtgccggcaaaggatttgatggcagaggagcatcaatatggcggatgtggatttgcaggcggtgggcggcaggtgaaaacctagcctagccttggctgggcctgcaacgacgacgttttcaagcgtcttcccctcttgagggcattgccatgccgtcccatctcctccagactccagtgggactgtcgggtgaaaacctagtctcggctatccttaagaccttgacggacgacaacggcgatgtctttgtcgttcctctctctagagatgtcatctaggtagcccttggccgaatccatccagacaacttgtgcaagctcgctctctagatgcatgtcctcttgtgtcggcgccctagcttatgtaagttggccccgtcgaaaagcctagagggagagtggttcaatccttctctttcaccctctctccctcaatcccatagaggtggctggagtggggtttagtgttggttgttagggatatgttttgggcaatctcggctatagtttctttgttgttatagcggcggccggttcgagtgccagccttttctaggatttgtgtttggtgctgtcggtacatgggtggtggttttttaaaaaaaaaaactggttaaaacctcccaagattgtatcaatatgaatttcacgctgtccgatgcgagttgcttaaaaaaaaagaaacttcaggctgtcaggagaagggacgggcagatacatgaaagaagcaattcattc

SEQ ID NO: 8397 - DNA, 313 bp, Oryza sativa
tgtctcttgacttaggaagccaagcgcacgtcgtcttgatgatggggctgtcagatcttcgcctgcgatcaagcgaagctgagcgtcgtaactagccgacggggccaaagccagccgttacggaagagctagcacagggggccccgggcgtcgacggtacccagagctcgacgcagggctaggatagagctaggaatcgtagcccccacacttatagcaaagaattgcttgtatgaatgaagcaaacacaaacattgcttgcatgtcgcgacctttcaaacctttagctcgaagagcccccccccccccacca

SEQ ID NO: 8398 - DNA, 1501 bp, Oryza sativa
ctcagaaagttgagctataagcctgagctttggtgaaagatgggagggtaaaatggaagtgaaggtagatagtatgggaactactactgtctactgttgtttgttagctgccatgcgatgatgttgtctgatgttttccatcaatcagataaaaaatgacaaaacagtgcacgggtagttttctctttccttcttttggggggtggggcgtgggtatcttcccgttttcccttcatccgtagaatctacaggtgaccaccacagattaggaatggcagtatggcgttgcttcgtcagttcagttcagcaaactgttggcatgtcgcagagctcagcctgacagcggaatgcttcaatccagcgatctattatattattaatacagctcgaaacaaaggcaccacgttcaccgtgggggctagaaattcccacattaatcggagaaaaagaaaagaagagtcaaagtagaaatacaattaaaaatagctgaaattcggaattaaaaatatgcaatatggaaagaggagtccatataggaacccaatacgtgattaatcaaaattcgaaataaaaataaaataaaatccaaaattagaaaaggaaaggagagtccaaatagaaatacaatttaaaatagctgaaattcggaattaaaaataaggaatattgaaagaagattccatataagaacccaatacgagattaatcaaaattcaaaataaaaataaaataaaatccaaaattaaaaaaagaaaataaggagttcaagtagaaatacaatttaaaaatagctgaaattccgaattaaaaataagcatactgaaaaaagaatccatataagaacccaatacgagattaattaaaatttagaataaaaaataaaataatatccaaagttagaaaacaataaaagagagttcaagtaggactaaaattttgaaacaactgaaattgaaaataaaaaataaaaacattaaaataacacaatacagtattaaataatttttttaaaaaaaattctaaaattagaaaaagaaaaataagatttcaattaggaatacaatttaaaaataactaaaatttttgataaaaataaagattattaaaataaaagaccatctaaaacacatgacgagatatattaagtaacatgcctataaaggggtagagtggtggcggttgatatgacatataaaaattgttaataaaacaccaaatagaatcctaatgacgattaaaaggagagacgttagggaggccgtgaagcaaacgagtaaggcggttgccgggatttctagaaagtaaaaaaaaacaatttttagaatcacaatgataataaagagtaggtggcggatgggctgtagatcagggacatagtgacatcgtttgatggcacttctaaaaattattaaaaataaaactacaagtccaatttttaaaggttcagaacttctgaaaagtaaaaaaatcaatgataatcatgttcgattttaaaatcaaa

SEQ ID NO: 8399 - DNA, 266 bp, Oryza sativa
acaaaacctcaactagtggacactctactcatggcaccactagtttaattttaggtagatgcttcgctatttaattagataacattaggcggttttacaactctagactttgggatattctcatcacctggacactctggaattgttggattattgtggaattggattcaccccgccccctctattcaaaatccccaaaaatggttttaggctgggctcggggtgcatggttttgatggtagcacctcggccatataaggaccggt

SEQ ID NO: 8400 - DNA, 1360 bp, Oryza sativa
aataaacagcagcggactagcgggcctacggctccatctgcacaggcgctcaactggggtataagccaggactccacctaagacttcttctccaaagcttctcttactgaagaggggaaggattgagcaagaatgagtacaaccacagtactcagcaagacacaccggagaatgcatgattaatgcaagggagtacaaggggataataataggggttaggttttgcagtaaacagcatttaaaagtcacttagttgcccaaagccattttgtaaagacgatcttagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggggtgaagccaattccacaatactccaacaattccatagtgtccaggtgatatgagaatttcccaagtctaaggttataaaaccacctaatgttacctgattaaattgcgaagcatctacctaaatttaaactagggataccacgagtagagtgtccactagttgaggttttgtttaatctagggtgaacaaggtaataatactaacaataacaataataatatggtcataacaaaggtaaataggcatggctaaataaaacagtgataacgcgggaatttaaataaagcgataatgcaataatttaaatcaacataattttacaaactgggattcaata

SEQ ID NO: 8401 - DNA, 922 bp, Oryza sativa
aagtgggcccggccgtcagccgcccgcgcccgcgggtgcggctgacgcgcgggacccacggcgtcgaccgccgccagccgcgtgcgcccggtccaccgtggaccgtggggctgacgcgtgggccccactccccgtggacccggtccgcgcgtcccctccctcggctgacgcaataatccgtttttttttaattaaaatttaaatgaagaaattcgcaaatattcatttaaagagcatataaacttcaaatggccatatcttggccatttgaactcggaattggaccgttcaagtccctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagttgaagccgtcgtttgggaaagcgagcaaggcaagacacatcatcttgatcatattgaatcccagtttgtaaaattatgttgatttaaattattgcattatcgctttatttaaattcccgcgttatcactgttttatttagccatgcctatttacctttgttatgaccatattattattgttattgttagtattattaccttgttcaccctagattaaacaaaacctcaactagtggacactctactcgtggtatccctagtttaaatttaggtagatgcttcgcaatttaatcaggtaacattaggtggttttataaccttagacttgggaaattctcatatcacctggacactatggaattgttggagtattgtggaattggcttcaccccgccccctctattcaaaatcccctaaaatggttttaggctgggctcggggtgcatggttttgatggtagcacctcggccatataaggaccggt

SEQ ID NO: 8402 - DNA, 1501 bp, Oryza sativa
atataaatataatataatatcacatgtccttaccatataaatactttaaaagttataaatatcgatttgccaaaaaaaataagggagtatctaaaatttatcaattttttgaattattaaaaacttccagttacatctataacataattaaagtgtaattatataactgcattataattatattgtatctacgatataatttatataaacttataaacttgtgttcaactataatttgattggttagcatcgagatcttacgcttgatatgtgtgaaaatttctttttagcaattccttttcctttatacacaaattataaagtgatctgatttcacaaatctaaaagttttggaggaaaaaacttacgaaagtttcgtagcaattatgaaaaataaaggcaccttgtatcgttagcacgaaaagctttttgttttgaacctgagtagtaccacctaggccgtgtttagttcacgtgccaaatttattttaagtatacgggcatatatttgaagtattaaacgtagaccaataacaaaacaaattacatatttcgcctgtaaattgtgaaacaaatctattaagcctaattaatccgtcattagcaaatgtttgctatagcaccatattatcaaatcatggcgtaattagactcaaaagattcgtctcgcgatttacatgcaaactgtgcaattagtttttttcgtctgcgtttaatgctcaatgcatgtgtttaaacatttggtgtgacggaaaagttggacgttcgaagaaaaaagttggaatccaaataaaaactaatacaattgttgaagtactgtttctcaaaaaaaaatgttgaagtactcaacttgttttaccgccaagtcaaaaccgcctcctttcttccatccacgcggcggctgtttaacccgtcggctcgccggcgctcccatccatccatccctgcctcccctttgactcccggcccgtctgaccagtcaacgtcactctacagagctaacgccgtcagcacatcccacccaatcgcggcgctccacgtgcggccgccgtcagacctcgacggcgccgcccccccgcgacgacgcgccgtcccaaataaaagcggcgcacccactcacccaccccgcaattcccctcctccgcctcccctagtttcctctcctccccgaaacccccaattcgaatccggcggcgaattcgattggggatttcggcgtcctcgcctccgtgggattcctcggatcccgcctcggcttcccgtctcgatctgcgtctggagttttggagcagacgatttgagtttctggttcgatttggtttggtttggtttgggggcgatttggttcaaggcgcggatggcgtcttctccggtgtcgtactggtgctaccactgcagccgcttcgtgagggtgtcgccgtccacggtcgtctgcccggagtgcgacggcggcttcctggagcagttcccgcagccgccgccgcgcggcggcggcgggagc

SEQ ID NO: 8403 - DNA, 1501 bp, Oryza sativa
caagctgtcaggacggcggtgaacgtcaggtggtcgggctttgcgccgtcgcgcagcatccggtcgaagaggccgacggcttcttggcagtggccggagttcgccagcccgaagatcatggagttccatgtcaccgtgctcctctgtggcatcttgtcgaatagccggcgcgcttcgagcacgagaccgcacttggcgtacatgtcgacgagggcgctgctgacggtgagctcttgctcgacgccggccacgacagagtagccgtggacttccttgccatgcttcacgtcagcgacattggcgaacgcgggcaggatggtactgatcgttgccgagcttggcaggacacggccgccggcaaccatcattgctcggaacagtgcgcgtgctctgccgtactgaaagttcagtacagagccggagacgcgcgatgtccatgtgaccacgtccggctggaacccgtcgtctttcatggcgccgactaaatcgccggccatcaggtcatcgcccgccagcgcgaagcctgagacgacgatgttccaggtgaccaggtcgggacacaggccgatgccccgcatcttgacggccagcgccagcgcgtgctccgggaggccgtggcgcgcgtagcacgcgagcagcgcgttccagacgaccgggtccccgcgcgacgccatttcgtcgaacaccttgcgggcgctggcgacgaggccgcacttggagtacatgtcaaggagcgcggtggcggcgacggcgtccgaggcgagggcggggcgggtgagcacgagcgcgtggatgaggcggccggaggcgacgtcggcgaggtgcgcgcaggcgcggagggccgtgggcacggcccccggccaggggtccaccgtgccacggctgccagcttggagtctgaccccggtgaagaagaggcggaggacgtcgccgtggtggccttgccgtgaagagcttgtgagctgcctcatccatgagctggttttcgccgggcacatttgccgctgatccgaaccggtgtaacgctgtggctgtgttgcatttcacttcaaatgaaggaaaacgcttcagtctgagctagaaccggacgggatgggagagtagaaccacaggggaatatctttccaaatttcagctaatcaatcaaaaatatacatgaactttgaaatctaaatttcactatagtagctggtcccgttcatttctacaacaagatttggatgaagatcaagatttttgtggcacgtttttttcaaactgctaaacagtgtgttttgtacgaaaactttctatacgaaagttactctaaaatatcatattaatctatttttcaagttcgtaataattaaaacttaatcaaccatatattaataccacatcgttttgcgtaaaacacttcatcttcatctacaggaaaaaagaacaccaagctgatgaggctttagcagctcgggaagggactgaaaacttggaacgacaagaagaaacgcttgacaccagt

SEQ ID NO: 8404 - DNA, 1501 bp, Oryza sativa
ttaggtttccaaagttcaccacctgggcgcagacgaacccctcattgtggtaccatttctggacatggtccctgatcctctgcaggagcctagcgctcaccttctcctgcttcttcatcattcctagcacctccccacgcacgttatctggcaatatgcacggcttggcaccacgaacacgctgctggtaatcacgctcctgcttccggaggtaatccatcttctccctctctgtcatgtcctggtcgaagtcaacctggcccgactgcgacattagccccacattgatgcacttgaactgcttagcagcgctccacacgctctcgacaaaagacacggtgaggccaagggtgccatcgggcttggccttcccctcgaggtcgaccctctcgaacatgccacaggacacgagcgtctcgagctccttcagaagctgcgacttggtgtacacgccgccgggctgcagcgtcaccatctcgaagaaggaatcctcgggccccgtgaacgcgcctccccctcccgcggcgcggtcgaagaacttgagctcggagatcttgtacctcttcagcccgctcagcttcgtcatcggcacgttgatgtttgccgggagcccgtgcgggtcccaatcccccgacgacttctcatccgcgtgcgccgcgccgccggagaagatccgcgaccagaacccgccgccgccgccaccaccaccaccacctcctcctcctccggcgccccatccaccgcctccaccgccgagaggacccccggcgccgcccccgaacccgccaccagatgacgcgagaaggaatgcaccagaggcggcggcagtgatggcggaggcgagggcgaaggttttcgagcccttagattcggatttggagctggacgacgcgacggcgaggggttgttgggggtggccgtggggctgcgagttgtgcgacgaggcggaggcggcggctgacacggaggtggagcggccccgcccccggactctccgggatgggccggcggccagcggggagaagaagaggctctgggaggtgagcgccattgcggccgccgcggatggtggcgaggcttcggtcttgccgccgggggaagcagaggaatttgggggaggaggaggaggcggatgggggggcttttctcgtctagccctgggtaagggttttcctcccaccccctatcttttccacgttccaccggcttcgcgtgttccggttcgagggtttagccgagtctttgcgtggcggctgaacgccttttttttctctttttttcacaacattttctgctttatattgccggacacaatctccaaatcaaacgtattttgtaagtttgtatggtcgccattacttgcaagaaatatatgcacgtctgtacgtgacaaaaagggagaactgcaactacatatcggtgggcgtttcagatgtgtatcctgccgccatcagaacatcagattcagatgtgagttaaatctgctggcttgatggccctc

SEQ ID NO: 8405 - DNA, 1501 bp, Oryza sativa
aaaaggtctgtgcccatctaaggtcgccaaggcctagcaattgcacgtactaatccacgtaccaaaaaagcaacacaaaagattgaagttaaagcataataagttattccatgagaaagaacacagagcatatagagccatataccctatcctgttgtggtggttgggagtggaatctggccacctccgccggcgccgagccaaccgccggcgcggcagcattgatggcaactgcgccattggccggcctggtgctgctgctgccgcgcgccaccaccgcccctgttgctcccctgctgtagccttttctgatttgaagccgcggttgctccggtcacattctccggaacccgagcaaggtttctcctacggatcccaggatccggcctaagctcctggacgagaaattacacgcagtaaggatctaatcatccaagcatagttaattgcagtacgggacggaggaggagatcaccaggaaaaatacagggtaatttttctttttttaaaaaaacataggagtgagctccaaaacttgcagaggaatatagctcaaaattactagattaaaatcatttatccacaaaagccttgcttaattacgccccaatttcccatggtgactccaaaaaccgcaacgattcggccaggggaagaaatgcctaagctcaaacgccatccaccccaagatccccttcccactccccgaatccagctccagccacgcagatcaagcacgagtaatgccggaaaccacaagataaacccaagagcagcgaggagccaccaccacccccagatcccttcatcagcccggcagctcgaaaaagggatggaaatcgtacgcgagaaccaaaatcgagcgacggcgaacgaaaccccgcggggggcgacgcgtgcagcacggcgcgtacctcgggtgcactggctggacgaagagctcgccgcaggctgaggcggccggcgagaagaggagcggcagcgagagagggaagatcagggaggaggagcaggagaatagtgggagtgtgcgagagagacgtaagcaagcaagcaagtgagcgagagatatgtaagcaagtgagcgactgagcgtgagatgtacgggggccttctcccctttcgcctttttctttttcctcgtttcctttctcttttcttttcttttttttcccttttccttccgtgggcgccacgatttgcccgtgacgggtggaaatgagcctgaacgtgtcatgtccgactcgtcgtctctgctgtgctgcctctgctccgcacgctcatcaggtgaggtcacggggaaaaagccctcgccgtcactcgcggtcggcggctgcgatcttgctgctccggtcacgactgcaggttactgctccttcacagaatcacggtgctgtaacttttattggttgagtcggtgaaaattaccaatggtttatctagcacaactctagctctagctgtatcactcttgtagtccaaccaaaccgtttcaccttca

SEQ ID NO: 8406 - DNA, 1501 bp, Oryza sativa
agccagctcatctattgttgccactaatgctttgcttaagaatcttaatcaagaatttgcactcaaggatctaggaagactgcattacttcctaggcattgaagtgaaagaagtaaatgatggcatagttttgacacaagagaaatatgctatggatgtgttaaagagagtgaatatgagtgactgtaaagcagtcaatactcctttgtctatttcagaaaaattaagtgctcatgaaggtaatcctcttggaccagaagacagtaccaggtacagaagtctggttggagcattgcagtatttgactctgactagaccagatttatcattttcagtaaataaggtgtgccagtatttgcatgcagcaaccactaagcattgggtggcggctaagaggattttgagatatttgaaacatacagttaagcttgggctaaaaattagcaagtctaattctcttcttgtaagtgctttctctgatgcagattgggcaggatgtttggatgatcggcgttctactgggggttttgctgtttttatagggcctaatcttgtgtcatggagtgcacgtaagcaggctactgtatccagatctagtacagaagcagaatataaggctttggctaatgctactgcagagattatgtggatacaaaccttacttcatgaactgggaattcaggtacccaaaattgctaaggtatggtgtgataatattggtgcaaagtatatgacagctaatcctgtttttcatgctcgcaccaagcatatcgaggtagattatcactttgttcgtgagcgggttgcaagaaaacttttacaagtggaatatatatctaccaaagatcaagttgctgatggcttcaccaagacactgtcagtcagacagttagagatgtttagaaacaatctaaaccttacaggttcagattgagggggagtgttagatatttctcacatatgataatgtaacaaatagcgaaggataagagttgttgggatgtttagatagataagataagtttcctatgttttagtagatgcacaacaactctatccgagctatatatacctgtattctgttaagcccggttttgtggcaagtaattaacacgtaaactcctcgctgaaggagttctctccacagtccctcctggggctctcgtcaaatatgacatcgatcgcgagcgagatgcgcatgtacacgctgtatccttgcatgaaggacacgatacccccatctcatctttgtggccgatgaagacgtcggctgttctgcggtcgtcaagctcacgcacatagtagtttagatccttcacgaacgctaggcctctactagaaaaagcattttccccaacattagagtcttatttttacagtcggacatgacttttggagccaaatgaccgcctacaaaaatataaattggggtgatgtacgctgtccgcctgcgaaaatcattttaggcgcaccttatatggtctgcctgcgaaaatgagga

SEQ ID NO: 8407 - DNA, 1501 bp, Oryza sativa
tggggttgggggagagatatatgcatattctactagttgaactggtgaattttatttgctgtatggtctgcatatatatgagcacatttgtcttcagtgtcaagttggtattaattaattagcagtatatacaaaatgtatataaatgatactactaatactaatttggtggaaatggtcaccgttgggtaggttgacctacatgctcccatcacactctttctcctgtgctccatttttcgcggactgtgccgctacatgtcgagacgtcaatgcatagatggatgcatgaacacattgatacatatgcgtgctcgtcgacgccaaaccgagcatgccgtctgtctcgttgacaggaaattaaagcagttagggatgattggaaagcaagccaaactctatttatatttattgcccatgtctcctgcacggttgtattatgcgatcgatagattgcacggctcgatcgtacgtccaacccatcccaaccgtacatacacatgagtaggcttgccagcttattgtcgattctgctcggacgatcgattccagtgcatggcctcccatccacatctgaagctgaatttcaactctaacagcaagcttaataattaaaggaacgtaaaagttgctgtttacacacaagctggttaagctaggtgagcttaattgcaataaggtagtgtactagtagcagcaaaagggaaaggttatgacagtggattaagggtgaagaaacagctaaccagagagagagagagagagagagagagagagagagagagagactctgcttggggttgcaagctgttcattacctgtgagaattgcaccgtccttttgcatcatctgtgcacggtcgcgaggcgttgacgcgagaaaagatagatatagccccctgtgctgcaacaccgaggagaggccagatatatatggttgaagtgcaggctacgtcagttcaatagctagctgcgtgaattcccatgcaaatatgtggggaggtatttgtatatatatcaagttattatcaactcgccgttggttaattagccagaaatggttaattggtctggggtatgtgtttgtactaatctgctacagtaatcaatcgtgctgtttactatatcctgtttggttaattacggtgatccaagcatgcttaacataggatatatgcctagtggttttctcaacatggtacactcgatgacggaattgctgctcggtggcacatccgcatcgcttgttgccgtcaagtccctgttagatgacggaatagcgaaggataagagttgttgggatgtttagatagataagataagtttcctatgttttagtagatgcacaacaactctatccgagctatatatacctgtattctgttaagcccggttttgtggcaagtaattaacacgtaaactcctcgcgaaggagttctctccacatggtatcagagcctcccgctagattagattagttctgtcgtgcaaactttctccca

SEQ ID NO: 8408 - DNA, 506 bp, Oryza sativa
aagttgtattgattgatagttatgtaagaatttataaggagtattgaaaaataaaactcattgatttactgaacaacggtaaataagaagataaaagtaaacttatttcaagacaaatggcataggctagagataaacttatttgggaatagggaagtatacattgctagatggatatgtgtcataacttaaccaagggcggaggtaaagtataggagggggaggggggtgctgaggaacccagttaagaaatttttttagctatatatcacctatttttcactatgtgttcaccccccctcagtacaaaagacttaggaacccacatcaacttaaatttgatctaaagtagagtaaattaagcaagtggtatccttctcaatttcattctacccctgcccctgaacttaacgagagtgacatctttatcgaaaccctcggtgatctattggcacttataaataaaaaccatatatagaattaaaggtgaattaagggttcgacca

SEQ ID NO: 8409 - DNA, 632 bp, Oryza sativa
tctcttatttattagagcgacacgtgacatcgctaatctagctagaagcgtttatagaagtgtcatatgatggtttaagaagcgttcataggagtgtcatatgatggtttaagagcttttgtacgtggtttaatggatttttagtatataatagttgatagatagttggagaaaaagaaaaagaaaaagattaaaggcaatcttatagtctatctattataggcatgttagctttaatataggcttatagatagtagctctactaagtattaaacttgctctaagagcaaggtcaatagtttagtaggctactggcttcaatatttatccaggtcatttatatatagctattaagagagagagcttgtataaaagcaaggttaataagagagcctgttgttggcgcttcaattgatagccatgttatctatagttaaccctatagtcaatgtgttcaatagatgtattgtataacacgaatatttggatggtgtttgaataaactgatgggacgtacgttgcccgccggattgaaatagttttcctataaatacgtatacgcgcatgtccagtagaacataagtgcaactgtctgagcaggagctcgagagccttcagcaccccacgcacta

SEQ ID NO: 8410 - DNA, 1501 bp, Oryza sativa
tattaattttcttttttttttctaatatcacaatttttttttattttgaatattagttaatgtcgtatagacagtacagtaagttgcaaagctccaaatttgatttcttttttcagtccaaatccatgttagtatcatagtatggaagcctatgtccgattggttttttttaaatctagaatccttatcgtattcaactggagttctattgatttatcaaccatactatcaatacatattaactcgatcgttacagtttagatctagtatgatctaatggttaatattttttcttcattaacatggtaatttttaaccttcggagcaaatgtgttggattttttttaagatgccttaatgatataacagatactctctccgaaaaaaaactaatcctggttttaaacctggacatatgggtttttgctggacgaagggagtagatagagagatttttagtggatggattttgatctagttacgcagcttaggacagtcagattgagcgtcaacgacttatgcttggccgataggcacaatgagcacacttatatctggtaaactgagatccaattttttatggtggtacactgtattgaggacaggctacttggatccagctcattcacgtcttgtatttctcatcttttagtaaaggacgcatactgtatccggtgaattgatctctaattttttaagttccttcagcattgcagagcatctagatgtaacctttttcaagaatgcatgttcttttgctggagattctgtacttatgtgattgcttttgttattggttggtatttattgggacttgattgaaagccatagttggaatcggacaccaatttatacctggacatatttattttgcttagaaggtgacatgacatactttacctcaggtacacgtatttgttccaattctaaataaagaacgcaaaatcaaaacttatatgcatattccctataagtctacatatcccgttagatttaatatacaactctaaaattttatttctataagaaccattaagtatattttgatttatatacaattcttagtttctatttttataagatccagattttatatacaactcccaacttctatttttatagatataattgtatttcatatacaactgtataaatcaatatataccgttataatccggacccaccatgatcaaacggttaagattttttttctttttctctttttttctccgattaatgtgggaatttctagcctccacaacgaacgttgtgccttcttttaaggctgttttaataatataatagatagattggcggctcgtcgattcgttttttttttataaaaaattttcctctaccacagcaactgctaagtcggcagaggtaaacagcgacgggttacattgaattgctacaatgagacgccatgcaatttccttgccacagtaatgcctctacaatgagctatagactatacagtgcctgcgtgtaatgctgcaga

SEQ ID NO: 8411 - DNA, 1501 bp, Oryza sativa
aaggccggagagctcgccccgcgccgtcgactgcccatcactgcccgcccggctcggtagtgcctcctcccgttccccttcctcgctctccctcgtccccgctagcttgcgtggtagctcggtagccctgccgaacgcgcgtagacgccgccccaaggaccgccgccacccggcgtggccccaccgccattgccgcccacccccggaggccgcctctcgtcgccggacctccacggcgccgctcagacccatccgaccccggaaatgagttccttgaacaccggagatgcttccgccgcctttaattgagtcctcgtcgcccctcagtgatttcccctttctctcgccgccggccgccactgtcgaattccaccgccgtcgaactccctccggcgaatccgagccgttggctcgctccttctcgacgccctcgtcactccggtgtgctccccgaagaccaaatccgtcgcgcttgctccggtgaacacggccgccgtccgccgtccatctcggcctccccttcttcctcctcccgccggcccgcgtggctgccacgtaggcgccacgtcggcgccacctcggctttgaccgggccaagccggtcagccgtcccctccctccgtcttccctcccgtgcgcgcagtccacggaaagccgtgcggctgcatgtgggcccgccgccatccgtccaaccggtgcaccgctcctaagccatgcgcacccgaaacccgtgcgccgcacctcgcgtgcgcccatcccaccgtgggccgtgccaccgacaagcgggccccacccgggaccccgcgcggtggaatcggtccaccgggccgtctctctctcccccgcgccccctctgttgggccgcctcctcgcgcccgcgcccggcccaatggctcggccgcgccgtgcttatcccttgggccatacccgagcctcccaaagaagtctaaattacatccctccacccttttctttttcagggatttaataaatccttttttttttccttcctttgtcccataaatcaattccttattcccaaaattccacaaaccatttcctttggtcccgcgtgacagtgactatcaataatatttttgagaatattatttctataaattccataaaccatttctcctattccagaaactccaattaaacttccaaaattcatatcacccaattcgcaactccgattgactccgttcaacttccaatattcccataaaattgagatctatttaatggcactactaattagtctaaataggatctttcttttggtcttttgtttaggttttcagttgtttgcgtatagttgcggttatcggattttcgtcgatcgcgtgttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 8412 - DNA, 1501 bp, Oryza sativa
tagtatagtgccaagtcaaccatttttaactttgtaaattaatagaaataaaatcaaacatgtaaaattgatattattagatttatcattaatcaaaatattataatatgcaactctttttatttaaaatattttatttttatagatattgttggtcaaaataacatctcaaagactgtgtcgaagtccaaaaatgcttatattttgggacggagggagtatttattttatactagatttttaggaatatgcaaaactttcaggttttttatgaaatcactgcaatttgagaaatattactcccccctcccctctaaaagcatcggtaatcatttgtcaaagttaaacagcatagaaccaacagaactgatggtaagcccttaatcggaaatgctaaaattatgttgacagaaaatacaacctcaaatcttgcaaattttagatcactggatatgctggatgtgcttcatgattcgtgctcttcttctcaaactccggcgatcacctcttcttctccggcgttggtgaacccaaactccgacagagggccgacgaattagggtcccggggtgaggtgggggtgggagggggggagggaggggaggggaaggaggggagttcaccggctttagagggatggccatgggaggtggcagcccggcggtgggcggctgatcgggcgggcggcgaggcggcggcaccgccgccaaagccgtggggtcgggagcaagcggcgggccggtgtaggaggcgggggcaaagcggaaaaagtgataggaggaggcgaccggtggtggcttcccgccgccggcgacggggtagatgacggacagctcgccgccgtcggcttgaggcaaaggagaggagagggagggggagggggagggggctagcctggggggcctcgccggcactgttgacacctttcggccagccggcgaggccgggcggcgcccggggggggggaagcactgaggagcggcggcgtgaggaatcgggagaggagagaggatttttagggtttggttgtctgcacgaatcttaaagcaatcgggtggtctaaaatttgcaagatttgtaagggggttttttgtcaaatgatctttagacagtccctaaattaatatcctactttgattcggtcgtctttagtacgtttctccataggaattaataatctaactcatgtagtcagaaaataactaactcacgcaagaattatataaaaaaatctttgtactaaatgaactctaaataatatgcatatgtactattaaactaactggcacgcaaagtggcgtcccgattttctatttgcttccaacgctgaatgtacgtatctgtcagatcttccaatagcaatggatgttgagagaccagaaacacatgtaaataggccctttgggagtttaggttgagagacgagaaaaatactagggcaatccatttgagagagagctttgagccaaaagcaccccacgcactagccggaccggcgaaa

SEQ ID NO: 8413 - DNA, 1501 bp, Oryza sativa
aactatcaacgcattttatatgaaagaaatattagaatgctacctagcgataggggcgatcagattctgattccctccctccacctggtttccttttttggcaccgtattactttcctattttagtaaatttatacacctaaagtttgtacacctcaagtttacacatctccacaattttttttttaaaaataaaaagttagaaaaatttaggtatataaatactatatataaaaaaaattgaattcaaattcaaatttgaattgggtatgtaaactcttaacttataaactttggatcattaaacttttggtgtataaactttagatgtatagaaatactatatatataaaatatttgaattcaaattcaaatttgaaacgggtatataaacttttgacttataaactttaggtctataaactttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaataggaaagtaatacggtgccaaaaaaggaaaccaggtggaggaagggagggaggagggggtcgctacccccatcgccaggcgatcgatcgcccattaggcgtaccccatgcgagtttctaattatgtatgcttcatccattacgggattgttaaaattatggcgtcacacttttcactgagtcacttttttttcctgtacgattttctctctcctatatatataaaagtatatttctatatctcatagctagtcttttaagtaaacaataaattacttttgatcctaattttcttatacattatatatttgaaaaattaaaataaaatattgaaacttatacggtgtaattacgtaagtgtaaataatttacagtataaaaatgatttaactatttttttctgaaaaatatggcgacataaatatagctattccaatctattattcaccactagaaatctccatgttccatgttgtttagttgtttcctgttagtgtatacaaagtccatgcaaaaaatattgttccctatagtttttatatatgtagggaacaaagggtggaagggcctaccatgctcctagtggcttgaagagttctggatttcctttttttcaatcaaagttggttagctggtttgtgatgcagaataatatgtacaaacatgcaagtttaaatttaatatgcacttgaaaaaacaaaaataacaaaataggtattggagaatagaaacataaatgtttatatctctttaagtgtacattaaatttgtagttgtatgtttcttgaaaaaaatatagttgtatgtaatgcgtatgtaactatggtggaaattatgacatgccataggacaactgaattggcagttgagctaggagcgataaaagtaataattgaaactgatactatgaagtggtgagga

SEQ ID NO: 8414 - DNA, 1501 bp, Oryza sativa
tcaatagattcgtctcgcgaattagtccagagttataaaataggttttatcagtagtctatgtttaatacttctaattagtgtccaaccattcaatgatgtgacaaggactaaaaatttttagtcccatccaaaaacaaccccatattacacctttcgtctcaaaatatagtaatgatgggatgagacctatcttagaactacgaatctggacatgaggcatgtccagattcatagtgttaggatgagttaggttgctacattttgggacggaggtagtatttgagacttgctctggtcaaataaaaagtacctcaagataccagtacttcacgctaccaaattgtttccgatagttatgtttagctagacaggatggacattgttagatccaaccatccgaaacaatacggtaccggtacctcgaggtactttctgttggacaggagcaaatttcatattatttgggtttgctcaattcctaaaaacagttcaagtcgaacgactagcatgaggtcgatctagtatagtgggccactgtatcggtttaaaacctggatgagatggtttgcggctagctagttatggtcggcttacttaggtgttggctcgataagattgaaggtggcttgaattgtgttgtctcgggttgaaatccctcactcacatcccctcccggtgaagctttatatttataccctcatatacccttatttaagtaaaagtaaagagacaaatgtagattttgaatcgttttaatcagtgacagatttatgtgtaggttgtggggtcagcccagcgttttcactatcatccagtgagtcttaaattttctatataaatctattcaaatctgcataaatgacctcaccaaaatatgaagtaataataattaaccccaccgagtaaatttcctagcttcgccactggttttagtaggaaccaaatagaactatgtctttctttcatcatctcctcccggctttacatatgtttgggtttgttttcatataggagtcagtgatatatggtattccgtcgaggtaagtatacgtctaactacatattaagttcaaactcaatctacaccagggtttgaaatttcggttcgaaatttcgccccccaccgaaatgctcacatctcacccgaaaattttgttttttgcaatattttgtgaatttggtcaaatttattcaaaatcagtcaaattttcaaaaaaaaaatcgtacaaaaaaaattcggaaaattcggttctttcgcccacctgtggtagaaatcttagtttcgaaattttaaaccctgaactacacattaaggggggaaatctaagaatagactcaagattttatggaacaagtcaagtaattgaaacgatttccccccctataaatacgctctttgttgagagtccagaagagcataagtgagacagtctgagcaagagctcgagccttcagtatcccacgcactatgggaaccagaactaacccgcccggctcaa

SEQ ID NO: 8415 - DNA, 245 bp, Oryza sativa
ggcggcggcgatccatcgatcccctcctcgctcccgcgcgcgggcgcgttgacgtaaccacctcgtcctcatcatcatcctctcccgcctcgccggctctcccatctcctataaattccgatgataataccatctcctgatcagttcaattttgtcataatcggctgcttcttcgcttcaattctgtgttggtagcaggcgacgctcggtgtcttagttcatggctcggagggatcagctggtct

SEQ ID NO: 8416 - DNA, 1493 bp, Oryza sativa
cacaccctacccctacgagcacctctggaagactgagctggcatatctttagattgacgaagttaccacatgtgtctcgctgttgaaaggtacgtcgcctgctactaaaaaaataattaatcgtaaatatgatcactcttgtcaaatcttgaatttgaacctgggtgggctggttccaccacaaggaacttaagtagctgagctacgctcatttcacattaatttttttgttcgatggtaataagcgttgttaactcattaattgtacggcatttgcaggctatattaaatcgcccgattgaaatggtgcaactttgaagatgcatgtatggctattacaatagtgcttgattttgatgcaaaatactactagcatgagtagggtgttcgtgagaaagaaaatagatgaaaaaaatggcaaataataatgatagattaggttggtatcttgaccatgttttttcggagcatatggatagttggtgtcagggtatacgtgagattgaggtaaaagaaagacatgaatttttatacaggttcgtcctcccgcttactgataggtaataaccctattgttattggctgaagtctgtattgcctttatagatcaatatcacacgagtacaatatatgagatgacctagtttgtcgctgtcgacctagcatcatcgctgtcgacagtgtagtgatctttttccttgaatatgaactcaacgagattggagatgtttctagatctctcatgtcagcctctctggctcatacattgggtttgtctatatttgtattggcttgtcttttgacttggcatgtcccctgatttcctcctagggggtcttgtattcatactctgggtgtcccattatacaagtagaactagggaaacaagtatggatacgatccgagtagttcctgtagtgtccgaatagaactttgtttgtccttccttatctagaacatcttccgtatatgaggcatgatttcgtatacgacttggtacatgatgggtcccaccgagtcttaatacaagagtattgggtatgttttatctataacaccgatagtcggctccaagcatccattgcacactaatgccagagataattaaggaattgatagactagctagctaggggatgtctggatacgtttttgttgcacacagcgatgtatgaaccgttctagaacgctttaatttattaagaaatcatgcaaaaactaataaatatttgtattagttggaaattcgccttatagcttcactactacagaaaaagggatcggtgctagttaaaaacttgtcataggtgccagattttctaactgtcatctagtaggcaatacctttgaggaagactcaaaggtgtaggttctaagaatgaaaaaaagaaaagcaaaaatcccggcttggtgcatcgcttcgaatcgagccaatacatcaaacagctctccatcatcactgagatcaacatcatctccatcaaccaaacacaa

SEQ ID NO: 8417 - DNA, 236 bp, Oryza sativa
agataaggcgtgcgccggcagtggctggcccgtcaagctcatcagcagggccttgtcctcctgtgattgggggagcgatagccgacgccagacttgcacgaaaagatggcgagcggcggtatacacaatagcggcgacaccaaaatctcttgttcctccatgcaatttgatccaatcccgctctgaccccccctctcgtcggccggacgaggatatgctgggtcatggctccggca

SEQ ID NO: 8418 - DNA, 1501 bp, Oryza sativa
aacattccatgtacacctctacagtacatatatatcctacttatataaacacttctaaaaactagacaacagattaatcttagtattgacgaaattatgaccagtgacgattttatatcgacgagcgtatcgtctactattaaaaaatagttagctataaatacgagtatccatgtaaaattttaaaaaaactcgaatgaataagttctactatcagtagcctaattagttcagctacgttcaggtaactttttttccctgtgatttggacttgactgcacgcttgcttgcatgcacacggagggaccaaacggtgaggcatgggagatgcgtagatgcgttccatggatctcgcgacagtgatgaccatcctggattgtccccggccatgcatggacactatatatgtctctctgttttttttgaaaaaataatttcgagggagaatactttgtctctttttcgtttgcttaattaattttctagctactagatatatagctagagtattaaactacatgcatctagctagcatattagagggagaggccttaaattggcctattgttgtagaagaagctagtagatgaatccgtactatgatcatgtatatataggtagattggttggtacaacagtggaatgaatgtgtagggatgtttcatacgtggactggttgacgtcctatatttgttcacatgtcaattaatgtgcatatgtcatactatgccttgttttttgtggagagattttgtactcccaaccctctttgaggaaacttggctcttcatagaatgctaaaacttttgcagaatcagctggctgaaggtaaaatgtcatatcatgatatcaatatataatagaaaaaaaagggaactatttgcacatatttatatctacacggttttgaaatgtatctgtgcattaggatgtgaaaggttggttgatgagtccttagcttgtttttggggctgtctagttttcactcccctaaaaaaaccaataaattctattcacttttgaatgccccaacatgggcgtatctacaagccggacaacccaaaaatttcctagcctaagacccttgtagaaaaatatagtaaaaactaataaaaaactcctgccatgtgaagagtgaagtcgatgcgtggttgtcttggtcccatatcgtgtttttttagttttctcgccacattggcagcaatcatcatgccagacggcaactacgagtctgaggcagagacaacaaactggtatggcaaggatgcaacgcactgtcatagcagcagttaccacgccaaacaaaaattaggaatccgagacagagacagtaaaatagcacggcaagggtgtatcttgctgtcatagcagcagtcatcataccagacgacaactaggagtccaagatggaggcagcaaactaacacggcaaggatgaaaggtcatcaagtagtcaagccgacatgttagcaagcaggaaagggcaaacgtcgtgtcacga

SEQ ID NO: 8419 - DNA, 1218 bp, Oryza sativa
aatcacaaataaaataaataataattctaattttttttaaataaaatgaatggctaaacagaacaagcaaaaagtcaaaataacttatatattatgggacggatggagtataacgacaaaggagacacactttgccgcagctaccagttggctggctgatgagaagaggtcggtttggctttggtaaagtaaacaatcgcagtagattagacactcctgcctgaccaatcgtcgtgtgacagagcaccataccgtactccttactactgatgccggtcgaaagaatagcttttcactggcccagctggtcgatacatcgatcagaggccacatgttctcgtcgattggtgattaaaaaggtgataaatgtgcagcaattagcgatgacgacgagaagatgaagtgatcatccaactaaactcgatcctttcgttctcccgtgtgcagtgcatatgcacgcacgcttgcgcgggggtggccggcgcacggcaaaagctggtcagatcactgtcgccgcgccggccagcagcgtgtgtacagcgttaggagaggacgatggcgacggaacagcgtgtcacacggcgcggtgtctctttggcccagccgctgtgtaagttaaatttgttagaacataagtataaagaatgtgtgtttagattaggggggtaaagttttggtatgtcacatcagatattatatagggtgttgcatgaggtgttcgggcaataataaaaaaaactaattacagaatccgtcagtaaaccgcgagacaaatttattatgtctaattaatccgttattagtacattgtcaaatcatgaagcaattatactaaaagatttgtctcgcaaattagtcgtaatatgtgcaattgattattttttttagcctatatttaacactttatataggtgttcaaacatttaatgtgacagagtgtaaaattctgagatgcgatctaaacacccccccccccccctcttaagctggtatgtcacgtaaattgttaagggagtagctatatttatagtgccatatttttgatcaaaaatagtcgccatgtatttacattgtaagtccctaaattacatatgtaattttagtgtatttatcatgtaagtttcaaaattacatatgtaagttcaatgtaattataatgtaagtacaatgtaattatgcaacgtctatattttgcattgtagattacatatatttata

SEQ ID NO: 8420 - DNA, 342 bp, Oryza sativa
ccgccgtcccgctcagctgccggccaccgctctccccctctatcgcctcgcctgctcgagagaacccgaagagagaagataaaagaaaataaacagagagaaatgtgggacccacaccattttctcacttacacgtggacctcacataataattttaattacttttgccaactaggatgctacgtcagcgaaacccggcctatatactgtcttgggaccttttatgcacggttttacatagttcagaaatacacatttctgattttgtggttaacggaccttaaaaaaatctcggtgtaaagttgagggacagccgctgaacttattcctcctatttatagc

SEQ ID NO: 8421 - DNA, 892 bp, Oryza sativa
aattcctgcagcccaatgagtaacaatcgaaattttatcttgtaccgaatgtgcaacatcagcaacagagacacaaataggagatggaagcaaagcaattgactctacaaccactcaaagcagaagagtcgatcggtatatgaaacactaacaaatgattggtggatacaagtggcacaggctcaccatcgatctagctattgaaggaattctttgacatgctactttagatatggagtaacaacacagatgtttaggaactaaggtcttagatctttcgatatgctgataactctagatttggtggaaacttgacacacatgatccggcttccgatcaataggatccaagtctcctttggttatcaatcgtgtgctatccagttgacctcactaagaaggttaatccctgcatgcgaatcgaaaaacacaagcaagaacaatgtagattgcaactcaatttgcagatgaatgattaaagactcgaagttggggttccacaaaccgaaccatcggcaaaaatgtaacgacagaattaatctaagtgaaacccgactcgaaactatgacggctactgaataaatatgattagggatgtcctagggttagccctaggatgcatactgtcacgcccagaaattttgcccaaatttctagactattttgtgtattaaatccctgtccaggaatcagccagggtacacaaaacgacaaataatatacacatccaaacgtaaataaagcgtaaatacttacagaagagacacttagtcctcacacagaaaagaaagcagtagcaacggaaaaaggcgatcctagcggggctacatcttcactccacaggcaaaactcaactgggctctaagcccttgtcgtctaacttcatcttcagc

SEQ ID NO: 8422 - DNA, 1185 bp, Oryza sativa
atatagtcacaatttgagattgttctagatggatgaatagatagtagatttttttattatgtgatgataatcgaggtacaagcagaagagttaactactactcgtataagtcatattggggttatcccatcttcaagttgactttatagaaaaacataacaacagtttcaacaaaaatatgtcatacactagttatggcattttagtctctttactgtggaacactctttttttcggttcacaccatatctccgatgccacaacttttttttatgatcaatttcattgtatttgtcttgtgtttttttaccttgggatgtcctttgatccactagttcaacaaggtttcgtcgccattgtgtgcgcttagaacatcacttctcaatttttgcataattttctcctatatttggcgtacaaatgtgcatgctgcatagtttcgaggttttttgtcatagagctggcagaattaattgttcagccactgacggatttgcagctggtttaccatctttatcttattttatagtaggagccatatattttttttagcattttcaaagtgctcatgccttccatatcagctttgcagctactgaatctaatctcccattgaattgtgttgtatgccgactttgcactggtattccattgttcgtccatcgccatctaatgatgtcatcaacccttctgattggattatgttgttgcttcgtatctgaagaaacatgtcgaagaattccttcatcaggtcgacagtgaggttgtacgtgatatcctgtatccgctgatcgtttgttactgcttcatatatcgatcgactctttcgctttgatcggttgttaaggccaggtgctatagctctttgagtggttgatgactgaccaagttcgatacccagaaaattgctttgcttccctcaccttttccatctcagtttgctggtattacgcattctatactagataaaatttcgttggacattctgtactacataaaattttaattttgatcgttacccattcagtacctgacagaaaaaattcttttaccaaacatatattttctaaatcatacatatataacgtgcaaaattattgttcgcacggggtaacaacttatacttccagatcaacttctaatcatgtcattccatttccaaatgacatttccaaattcttgaca

SEQ ID NO: 8423 - DNA, 1501 bp, Oryza sativa
gtcggacgccagggcggcgcgtgcaaggggaggagaaggccaactaaaccacggtttttgagtgggatgtggtccccaaggatccagcatagactttgcaaaggattggatagggattgggctgagttagtcgagctaggcattctgccgaataccttgagggcaatgaacagtgttttcaggaatttttgaatatgtccctaggaaagaatgaatttaatatatgaatttggaagggttttactagggtttggagtgtagcaaatactcactaatattaaggtaaactaaggaaataatctaaagtttaaaatttgagagaatttgctgaaattcactaaggtttggaataaaaggaataattacggtaaattagtagggttctaaggaagtaatacttgaaccaattaagaatcaaatagatttttaaagcacactaatttaatcaaaagccagcatgatgcagtcaaattttagtttaaaatttgaggatgttacactcccctaaggccctaacacgttcctcttcccttcttctcttcctactacaccataaattaaaaaaaagtaaaaaaaacacaagttagaaaaaaaataaaaatagaaaaaaaaaatctaatactcttatttatgtgcatagactctatacttatgtatagactttgttgtcgagtgacaaccacgtcacgtcgaagaacgtgggattgggtctggtgttttgaacagtaaatggtattgacttaataaaatgtttgggatccccctatcacatggcactaggggctatttatagccctagtacaagctgttactctctagggtttattgtttacaggagattttacatgaataccctcatgacggtgacatctacaggggtaaccaatgtctattgagttatgggcctgctaacagcttcctcggcctgccccaagcaagtggcgaacaaccttctcggaccgatcccgagcgaagctgcatcccgctctaccgaaaggggatgccttcatacttcgccatgagcttcgccatgtactttgtcttcatgcatcgccatgggcttcgccttcatccagacttggcttccggtcattttatagatccctgatggtttcggcgggttcgggcgaaggccctcatgacatgcctccaacaaactttatatcgtaaactttgcacgtataaactttatgtgtgtgtgtgtgtgtgtatatatatatatatatatatatatatatatatatatattatttgaatcgggtatataaacttttgacttataaactttagctgtataaatttactaaaataggaaagtaatgcggtgccaaaaaagtaaaccacgtgaagaggggcctgatcgcgtggggcgaacaatcgcccattaggattttcgcctgatatagggataggcaaaccacaaatttcgaaccttgcactgcacccgaatgctggctgaaaaaggaaagaagatggagaagaaagggaggccgtgtgggcc

SEQ ID NO: 8424 - DNA, 545 bp, Oryza sativa
gctgccggattagacgcccccgagctcaccggtaggggtggggatgaggcagcggcgaacggcgtggtggtagatagaggggagcagcgacgcgagcgatacgaatagcgtggtgtagatgacgagatctacgggattttttttccccatttcctgtttcctctttttttttcctctaagagtaaagcgtacgagcggtctctaaatttgggtggacgtgtcaattagattctaaactctcaaaataatttttggatccctcaacttgtctcgggtatcataaaggtccaaacgggttccaacccactctgtgtgttgacgtggcatgccatggtggcgtgtacatgtcaatagaacccatatgttagccacatatagaaaaaattaggcaaattttgctacaggacacttcgacttcgtggttttagtcgtgggacaccgctcgaactcacttttgggggaaaacactccataaacgtggtaatttgcccatggacaccgtgccgattaaaataataatttccggttgaagagaagagaaaaat

SEQ ID NO: 8425 - DNA, 1501 bp, Oryza sativa
actaaatatgtagttttgtgacacttcatcttaaatgtgcagttttgtgataaatctattatattattaaaacagctttgaaaggagacaccatgttcgctgtggggggttagaaattcccacattaatcggagaaaaagaaaagaaaaagaaaaagaagaccaagtagaagtactatttaaaaatagctgaaattcggaattaaaaataagcaatattgaaagaagtttccatataagaacccaatacgagattaatcaaaattcgaaataacaataaaataaaaatccaaaattagaaaaggaaaggagagtccaagtagaaatataatttaaaaatagctgaaattcggaattaaaaataaggaatattgaaataaatttccatataagaacccaatacaagattaatcaaaaaatgaaataaaaataaattaaaatccaaaattagaaaagaaaatgagagtccaagtaggaatacaatttaaaaatagctgaaattcgaaattaaaaataaggaatattaaaagaagagtccatataagaacccaatacgagattaattaaaattcggaataaaaataaataaatccaaaattggcaaaagaaaataaaaaataagagttcaagtaggaatacaatttaaaattagctgaaattcggaagtaaaaataagcaatattgaaagaagaatccatataagaacccaatacgagattaattaaaatttataataaaaataaaataatatctaaaactagaaaaattaaaagagagttcaaacagaaatacaattttgaaacaactgaaattgaaaataaaaaataaaaacattataataacacaatacgatattaactattttttttaaaaaaatctgaaattagaaaaagaaaattaagatttcaattaggaatacaatttataaataactaaaatttgtgataaaaataaagattattgaaagaaaagaccatctaaaacacatgacgagataaattaagtaacatgcctatagaggagtagagtggtagtggttgatacgagatataaaaattgttaataaatcaccaaaatagaatcctaatgacgattataaggagggacgtcaggcaggccgtgaagcaaacgtggaaagcggttgccgggacttctagaaagtaaaaaaaaccccattgataatcatattcaatttttaaaatctcaatgacaataaaaagtagaagcagcgggcggggtgtataagagtataattgcagagccgccgacggttgacgggacttctagaaaataagaaatgaattccaactatagttatgttcgatttttagaatcacaatgacaataaagatttggcggcagacgggctgtagaggggcatagtggcatcgtttgatgggacttctaaaaattataaaaaattaaactgcaagtccaatttttaaagatttgaaacttctaaaaagtaaaaaaaaaagcaaatgataatcatgttcgatttt

SEQ ID NO: 8426 - DNA, 911 bp, Oryza sativa
gtccacggtggaccggcgcccttgtgccgctgaccggtggggcccgcttgccggccccgcccctcccctttgatgacgtcagcgaggtccatttcctttgtaaaataaataataattgcgcaataattcgtgaataattatagaaattcatttaaatggctcaaaacttctaaaattcatatctaattcattcgaactccgaattgagccattcaacttgcaaaattcatctaaaattgatctctacatgtttgtttagtttttatgtactattttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcattttgatcctaatttacaaatgttttactgtttacaaataaacatgcatgttttgctaattacacgggatcagggtttacctatctgctcgcttgtgccacgtttacttgatatctatcctttgtcaaccttgggtaataaatcgactagctcatgttacttatgtgattagctagaactatatgcttagccatgcttaattaccactagctcagttgatgggataattacaatattagacctttttggtatcagagtgagctgcgtgctcgagacatctggccatgcttcatggtcgtaattatccgattaaaatacgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtga

SEQ ID NO: 8427 - DNA, 994 bp, Oryza sativa
catataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaacaaaccttatcatcctcgtgtttctaattatatagttttcaaaagtcacaccagttgctaccccttatgttatctccttctttatttgcttgctcaatctatcaatatttctattcattcttcttggaacctttaaatttggattttatagtttttagagtttattgtcatgttgggtttcatttttataatttctagatgtcccgtcaaacgttgccattatactcctctacggcctgtccactgtctcttctctttgttgtcattgagattttaaaaatcgaacataattatcgtttgggttcatttttttactttctagaagtcccgccaaaccatcagcggctttgccatagtactcctctacagctcgcccgctgcctctgttattgaaattttaaaatcgaacatgattatcatttgcttttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatagttggaattcatttcttattttctagaagtcccgtcaaccgtcggcggctctgcaattatactcttatacaccccgcccgctgcttctactttttattgtcattgagattttaaaaattgaatatgattatcaatggggttttttttactttctaga

SEQ ID NO: 8428 - DNA, 1501 bp, Oryza sativa
ctcttcgacgtgatctgtggctgcggcaaggatacaatgattgagaggtaacacagtgcagttcatatcggtgctgttttatcttgaaacctgcagctccattgataattgctgtgaacaagcagccatttgggccaatctcgcacagaagtgtactggttaacttgacatgaacgccagagtacaagttgaggaggttgccatatgctttgggatggtcaagtttgttgcaaggtttcagtgcgccacgtcacagaaagcaaggatatgcttgcgcatacattaggccgttttgatcgcctatcttctcaataatatgagaaatgaataatgaattgcttagccttgacgcataaggaacgaaacggcatcaggaatagctttattttgcattttgcgtcatgctgtataagttacagactttgatgtgcataccattttaacagtctttggcttcatttaacatacggagcatgttcaaggtttatcgggtagaagtactacttcactgttggctgtcaaggatatcctgacgagacagaactggtaccggagtaatcagcgtcccaccagcaggtactgatcgctgaatccactgttcattgatatgatcaagatgtacagccgcaagatcgctatcgatcagaaatgtggcagctcacgttattggctgatagaatttgcaagattgtgttacaatcgcggcaccgacagtggtcttgcaaagttgcacaccttcccaccacccacgcaaaagattttaacaaccgtagagaatgttaaagatcagattgaaaatccttgacaatgcttgtggttacagcgatacaggcatcggccggctcacgcaagtcaaggatagtacacgtagtaacagcaaatctgcagagtacttactacatgttagccagtgtaagcaaacagacctgaacattgaggggcggcaagcaagaaaaaaaaagaagtcaaatcatcgttcttccaccattatgcttgggagcaggaaacaacatacagataccacatggcgcaagctaactgccagttacaactgaggagaatcatgtcgctaacttggagttccgaccttcccacacgatttttacaaacaaagatgctgaacactgcatataggtagtaccatcactataaccaaacttcctgactggcaataaccactaatcttcctagcaatcaaccaatctcaatgcacaacttgactcaaactggcccagctgatctgaagaatcccaggcaaaagcagtttaacagcacaaccatgaaagattcattttcccaacaacgaactgctagccgtctcgagatctgtcttgcagttctctctgaattcctttaacttcacaagagatgaatgctgaatgtaagaaattttttgaggttagcacataatcaaatattggcaatacagttcatcagtcaagtaagggaagttacattgacgtcaaacttagaaaaggtgtagaaaacatagtacatgatt

SEQ ID NO: 8429 - DNA, 1501 bp, Oryza sativa
aaatgcattattgaggggctccctactatacgatcacgtggctgtgttgaccgatggaaaacaatttgccaataataaaatcacggctgtacagcgcttgtaattagacctgcaaataatggcgatataattgaggaggcactagaaatcaataatgtcctttttcatgtctaaatcaatggtgcccgcttctccaataccaagaacagttcaagctcaaattgtttctaccaattcacaccactgtttttcttgtaacgcaacaatagcagttctggatttttttcccccaacccagcgaaagaaacaaggtgattttaaaataagaagaatatattcaagatatggtagtagaggcaaaccatcaaactacgcaaagtaaagctgaaagagaatgaatgaaagaataagaatccaacatatcttaatttacagagtaaatgccagtcattgaatacttttcaaaactgtaatggcctcagatggagaaggcttttagcccttggcgcaatccaaaaggcgaattcccctggacaaagggcagcaaaatttgaagtcaatccagcccaccatcagtccatcaaccaactacaggacgccacgtaagcaaaacacagtgtggcgacgtgcacacccctgtcctgagcacacgtggggcatcctcactggctgcaacttgttacccccgcgtgctacctgccgtggcctgacggcatgggcgaaagctacagcttatttgtactagtaattcacatttcaaaaaaaaaacccttttattttctttttgtatattttgtagagaaagattggcaatgaacagagaggaagagagatgcttgccttcggttgcgttgcgttgcttgcacggccaaagtggcgctatataaaggccatggtgtgaggcctcttcttcctcagagagacgcctcaaccccaccccaagaacaccaaagccacatcccatcccatcccagtccacggtgaggttgagcgatctgaaaaaaatcatcagcgacgagcagcaacaggtttgttctctgaacttctctgatctttttagaagcaggtaacacacaagaaaggtcctgtcccaagaaggtacttctttcgggtttattagatcgaaagaggagttcttgtgcgtacaggttctttctcatcccatcaacttctcctaggaggaacagagatccagagaaccttttttctcttctggattcttgccgatttttaggcttcctttgcttttctaaggccagaaagggttgttttgcaatacccttctagttcatcctctcaaatttttcttctttctattcaaaagctctttctttctttgcaccctttgtttctctacttttattgaggaacagggctgatttttcacttcttgcatccaaaaagcaccccttttttctttcctgtttttaagatttccatacccttgccatcttcatcttctacctccatccagtcctcatggccgcagcaatagacatgt

SEQ ID NO: 8430 - DNA, 1306 bp, Oryza sativa
ttacttatttgaatatatgatattcactcgattaaaaaatagactattgtataatatcagaaaatataatcatcaccaccactggtgtcttttataatagtatagataccaactaatcatgcatcaattctcatcataattttaattgtctaagtataattgaaatagcattgcaacaaatccgtgcatgtcctaaaacttacttgaccatctagatttcaggtgattaaaagtttaagaaattttagtcgcttttgattgtttctttttccttatatataacaagttgaacaacatatttaaacatataaaaggtacaaaattatatgaaataaatttacaattaaaaaactcatacctgaataaaaataaagtaaagcaatgctactatatataacaacaaaattacaattaaagagaaataaaactacacatggcatactactgcaattttgtacaatctagtttttgtctattttttataattaaatatacatattaaggtttaaccttgtttttttttaaaaaaaatgagacgcctttctttatgtaaagtacgttggcaacaaaccaacttggttaaaaaaaactttgcttcacatcctcatttgcggtttgctttgtaatcataattttgtcagtccttttacataccgaccttgacaaatgtgtaggtatttgaacacacatcttgggaaaaaggattgcaattgtaggatagaagcacgggcaaaccattacgcaactgaatgcccgatgaaaattatgaatgtgctagaagccacttaaattttactcagttagcgcttttaggcttggatttcccgtttaaattttacacctcttggttagttggcttcaccactcatgcgtgcgtacttcttcacaaatggggctacagtcggtgccaatgatacaacatgctcacagatccttcagtttgtgtaggcgtacacttcacagatttggcaccggggctccacattgcctcttttggcccaacgacaaggcctcccccctctcccccacctccatcttcgccattggctagcgaatagcagtgcaaccctagctcgcgcctcgcggctcgcgcgggtggactcatgaactcggcctacgctttacactgggctagaaaacaaacgatacggcaggggatgcccccgccgcggcctaccagctaagcaggcgagccccctcacacacgtagaatccacatatggtgacatgggatccacgtggcggccccccacgtgccctatcgctgggcccactcctcgcagctataagtaccccgtcctctccc

SEQ ID NO: 8431 - DNA, 1501 bp, Oryza sativa
gtaaaataccgcctccaaaattgtaccagcaggtagtagctttttaaggcctgttcattttgatgtcattttcaaccttaccaaattttggtaaagttattaaaaaaagtggctacatttagtttgctgtcaaattttgataactatataagaaattctgtaaaaaattttggtaagtatgctaatttttggtaaggttttttttgacattaaagtgaacatgtcctaagtgtgtgcaggtatgcggtaattgattaattatccccatgcttaatcaacaggccgagagttcaactacgttgacgccacgatagcaagtcacgaacgcactgaatgacgcgtgtcgtactagttagcacatatattcctggtctatctcactgtatgacatcgtatacatggttacgttacacattgacggtatgtacacaccatctcccttggcagctaattagaagtcgtcagtcaagctagctaagctaagctagcgcgtgcgtctggatgataatattgcccacacgattcttccatgcgtcgacgttatgggaactgtatgcttgctagatcgatactgctgtactctcgtctgaactgagtttcagctacgtgatacatcgaccatcgtgaccgagaaattattggcgtacgtgagcttgaccacgggatttcagttgggaatccactagcagcgtggtcacacgagagggcagcatccgcaaaccgcaaatcatatgaactacctgtcatcgagttcatatctagaaagaaatggccaatggaactatatcaagtgcaacaaaaaggtttgctttactcgtgaacagaagttaatctaccgcgaaaagcaagatgtgttgcatgcagaggcagagcagagaagagagagtccgtcctacttgacctgccggaaaaagcttagcgatcgcaatgccatttcacaacgctcctcaactgtttgatctgccccccactggcttgtagaacaccctccttgttttaactgacgatcacttcacgagcacgagcacaggaagaactaagataaggatcaactcgccatgtactaatgtacagattaattactaatcgaagtcaaaacaacccaactcgattgttcgatacactaccgtctgattaaacatttaggttccgttctattctacaacgatagttggatgaaaataaaaattttcgtgacatgcttttcaaactgctaaacggtgtgtttcgtgggaaaactttctatatgaaagttgctctaaaatatcatattaatctattttttaagtttataataattaaaactcaattaattatacgttaataccatcttattttgcgtaaaaaattaatctttatctttatctttatatttatctttaggagaaaaaacatcactttatgtgtctgcttggcccaaaagatcgtctgcctggagaatatactaccgggataatcaccgaagaggtaaaagaatttagacccaggcggtaaattccag

SEQ ID NO: 8432 - DNA, 1501 bp, Oryza sativa
acccttgctcaccactgattctagaagctgtgccagttaaggatcttggcttccataagcttcaggaaggcatgaatcaggtatactaatagtatcagtaacttagaacaccctcttgcaacccttctagctatgttgcattcttcaggaatttgtgaatgcaattagctattattcaggttgataatatttcagattgtccatgataagtattcagctcttgtatccttccaatgtactttgcagttggacgtggcatccaaagctcgcataagagatgccttgtatcgattggccaattgtgttgagcataggcatcgcattgctagtacaacagagaccgttaaccaacttggagttatggaatcatcagcttcaaagaggtacaacggtttaatgtgatcttcaattatgtttaggacacttgaagtgatcgacagctgagtttttgtgaagtgtaattttctgacatgttcaaatcaaacaggtggagagaaattcagatgatgaaccctatggatcgctcagtggcacagctgcttctccagaaaccgctccaccataaatctccacctgattcggcgctcggcattggtccctgaattgtactgcaccgtgaaaaacacgtaggagtggctgctgatgcgatgtggttttttttactgcacatgtctgatcgattgagcattctaggtccggcaattttttttccctctcggttccggtacgcatgtatatacagtaatcactaaagagtacagacttactagatgaaatgtaatgtgatagcaacgctttgctgttcagagatgtgattctaaatagaaactacagtgttttttttttgttgtcttcagcatttacctgtgacttgtcagatgccccattgtaccgtccaaaaatttcctctattgacggttaccccttggtcgcagatttacacggtttctcttattgacggttaccatggtaattaggcttatcacgtgtgcggaaacgataagtgccggataattctaccaagttcaaagaaacttaaatgtaaactctctccagttttttcacggttcatcacgataaccgcaatggttaccgcggtcgttggagataaaccctgtcgccgaaccgaggccgcctgtgcactaaccgccaattagaggaaaggaaacaaatcttgcaagtgtgcaagtgaccgggctagataatccaatcttgacttggcagttgtgttcgccaccgaacggcaggagaagcgaagcgtggggaggaaaaggcccaaatcctcgcctcctcctgcctgcaaccaccgcctccgtcgtctcgtctcccccggcagaggaatccccaacccggaagctttcgggagtcggacgagctcgccttgactcgcgtccccctccctcgcgcgcgcgcgcgctcgtcgcctcctaaacttagcggccgcgcgggacgcggaggggcgctcccctccagaaataggcggggtgggtggcgaggagga

SEQ ID NO: 8433 - DNA, 1501 bp, Oryza sativa
agggtcggtcctgagaagtgatatccatataaaaaaaatcaaacatattggccatttgtaggtgtgaaatcattgatgataagtatcactatcatctgtatttcttgaagtatctattttactccttaaattttaatttatccattgctcaattagcccaattactcgttctttttttaatgtatactttctcgaccacattatatccatacgggcaaattagtgaaagggaacattttaaagttgaactcatagcttaaggctatagaagtactgtattaattcagaaaaatataaccaacaattatattaaactcacaaatcgacatagtctgtactatttaattaatttgtatccctaatttatcaattgaccccttgtaattatgtaaaaaaaagataatctcgagctagatgacagattgagattgacagaaagctttgcgtacttaccaccgccaccgtcgaccttgtccctgccgccggctgttccctcggtcgcaagggatggggttctaattaatcgacgttccgatggtcaccctcgatcttgatggccagccaatggcgcagcttccgctttaggtcgccgagaacaccgcgctacgtatatacacgccttcctcgccagctactccaggactctgcctccagtactgctcctgctaccctcgcctcctacgcctgccgttgccaccatagactagcgtcgaagcgtagcaagaggattgcggccaagcttgcgctcgccggcccgagtgacatgaccttatgtgcgcagcacaatttgatgcgcaagcttgggttggtgcctgagaagggtcatgtgttggccgaggctgttacggcttacaacgccctcttctcccagcccctccctctggatcacgccatagccctatcttcactcttccccagctccctgcctccgacgcaggctggagtgtagtgggatccccaaccccaccatgcattgggataggagatttttcttttttagtagcttatcttctttgtatttgttttttttttcttttttcactactagaggacccctcttctatcccagttcgcaacctcctttacttccgggtaacgaaccaggagaaagaatccaggactaaagaagccagtctttagtccttgttcaaatacctgggagtaaagattcatctttagtcccggttggtgtggcaaagccacatcctggttggtcccttttttccattgtttctttactatttgctagggttaatccctgtatttcctccaaaatcaagtgggttgcatatcccaaatcaaaccctaaatccccaaatcaaattaacatcccaaatcattcacatcacaaatcccaaatcccaaatccaaattattcacaccacaaagcctaagttacttatacaaacaaattaaatacatcataaatccttaaaaaaattacacacaaatcaaatacaccacagattatacatctcagatccatgcaattaatcacaaa

SEQ ID NO: 8434 - DNA, 850 bp, Oryza sativa
tcaagggcagttctcgcaaagtatccaaacattcatagaagataaacgacatgtcacttctcagaaggttgatcaacggtaaggcgccatcgtcatcacatcaatagctttgtttgcagcaccccagctcctcaagttgcatcagttccaatgcaaagttggtcagttcagtcttgtgaaattaactatgcaacaggataccgaagtcagagctctccgtactagtgtatggttcttaattcttcatatacttcttttactggtatttgttttggttacgtgtattctagttatgtagaagtcggaagccttctcagtgcgcagttatattatattatcttgatgtaatagaccgattttaataaaagcttgcatcatcaaaaaaatagtattacctgtgctgtttggaagagggaagatcaaaattgagctcgattgagagaccacaaacaacacttcgaccagtcgatcgatcgggtgtagttgaccgcacgggtctcctaggcagctagtcgatctcccttgtttttttccattttatttaacttagggtgtatttagttcaagttaaaattggaagtttggttgaaattgaaacgatgtgacggaaaaattgaaagtttatatgtgtatgaaagttttgatgtattggaaaagttaaaagtttaaagaaaaagtttggaactaaactcggccttgatcacgcaacagttccaggataaacggctatatatacagtactaccattcgacataaccaaaggtatagtaactacaagtcgtgaggcttcaggctgtgacgaaagaaaataaaaagagtggctagttagttccaggccgtcccctagcta

SEQ ID NO: 8435 - DNA, 728 bp, Oryza sativa
actcttttcccgcctatcctaagaaataaacccgaacatcaaaatgcacgccctttgatcaataggattttttatattccaatatgtcctgtctcgctacaggttttgatgctttatatagtttgtaacttgtacatatgagattacacttatgccctcattgggcctatgtaaagttacaattgtgcccttaacatgttagcaattccaagggcaatttagtacatctcgaaggtttttatagtcttttggtgccagctggatggagtggttgagtggtccccggaaatcttctcgtggcatctttattgctcgaactgtcttctccatgagaacgagcctttttcatggtagagagtcttctccttggcaagtagtcttttccatctcgaccattcgaccaccttttcctgttcacctagtgactgatagtttacctgtcattggcttagacaatactcaaaacagatctggcttagtaataagaaattgcttgaatagtgtttccaactcgcatagcattttaccatttttctgttctaatggcacttttccacccgtacacttacaatagaaactcactcttccttctaaatgtttctggcggataaggagggatggtggtgacccccaactactgcaatatatgcgtgcataaagccattaaaccatcgtccactacaaaactaagggggagagatggagcgaggaggaaaaatggagggagg

SEQ ID NO: 8436 - DNA, 1501 bp, Oryza sativa
aacccaacgtgggagggtgattgtatttatatatccaatacaatagagattacaacaaactcttaaataaaagttatatacggatacaatctatacaaatctaatctaactctaatactaaacgcatacactgataatcagggcttctttttttttcgatttgaacctcaaaaaaaaaggaatatatgtttcatattcatcatgtctctagtgtttctgtaaagtgccatatttgtcatcatatttgttttctgtaaagtgccatatttgtcatctcttgaaaattcaaccctaacaggtggaccagaccacaccaaaggacaaatatatacatacatgcttttctaaaatacaattgtggattaaccgctacacagcaccactcacaccgtatatgcaggtaaaggaatgcaccttccgttaaccacgctagagaaaaattatcagaactacaagatacttctctattgaaaggacacaggtatgaaaatgcgagaaaatataaatgacgcatataagttttgtttaattttaaatcacacatataataaatgacgaaccaaataatgtgtattaaaacaatattgcattattacaatttccttaagaatatatattaatgaatgttaatttgttgtttgccacaagtgactggctgtttatgatttcccatgaatttacaggaacaattaataaccaccttaatttttgacagaagttaataatatgtcaggcatgtaccatgtaagaatcaaatcacgcaaaaaaacaccttcaaaccaaaaatttgagatgtcttttgaagttattctgatgttcatgttgctaatgtataattttggaccaagagttgaggaaccgcaaaatcagattttcccagggtatcttacttgaatgatgaactgcttcttcttttcactgataataacttcgtaaaacttagagaaaaaaaaacactgatagaattagctctatgcataatgcatggctgtctctagatgcattatcaatccttttaaataagcacctcaaaagaaatgatggataattagctccaaaaaaacaaaaatgtttacttcccatatacaaaccgtcatcttcgtgcacatttggactggactatttttttttcgcggcaaatccatatcactgccggttggtggactaaacctggaatgacaaacctccagggatatttttgtgtcaactccaactccatcactgcgccacatgcagcctgccgtttcgaaaactggcagggatctcttgttgtgtaccagtgaaaataaaggggaaaaaaatgttggatggctaatgcaagtgggggcaaaagaattagacatctgaccttgtttggttgtgacattattccatacttcttctaaatgctatagccagggaatgcaaacgagaaaatcgatgaagctctgagttggcctcatgaactagagtgctaccactacgctataaatacagctagccatacaccatctctgatcat

SEQ ID NO: 8437 - DNA, 1501 bp, Oryza sativa
agccatgcattatgcatagagctaattctatcagtgtttttttttctctaagttttacgaagttattatcagtgaaaagaagaagcagttcatcattcaagtaagataccctgggaaaatctgattttgcggttcctcaactcttggtccaaaattatacattagcaacatgaacatcagaataacttcaaaagacatctcaaatttttggtttgaaggtgtttttttgcgtgatttgattcttacatggtacatgcctgacatattattaacttctgtcaaaaattaaggtggttattaattgttcctgtaaattcatgggaaatcataaacagccagtcacttgtggcaaacaacaaattaacattcattaatatatattcttaaggaaattgtaataatgcaatattgttttaatacacattatttggttcgtcatttattatatgtgtgatttaaaattaaacaaaacttatatgcgtcatttatattttctcgcattttcatacctgtgtcctttcaatagagaagtatcttgtagttctgataatttttctctagcgtggttaacggaaggtgcattcctttacctgcatatacggtgtgagtggtgctgtgtagcggttaatccacaattgtattttagaaaagcatgtatgtatatatttgtcctttggtgtggtctggtccacctgttagggttgaattttcaagagatgacaaatatggcactttacagaaaacaaatatgatgacaaatatggcactttacagaaacactagagacatgatgaatatgaaacatatattcctttttttttgaggttcaaatcgaaaaaaaaagaagccctgattatcagtgtatgcgtttagtattagagttagattagatttgtatagattgtatccgtatataacttttatttaagagtttgttgtaatctctattgtattggatatataaatacaatcaccctcccacgttgggttgtgaggcgttgtgaggcgtctcataattctctacatggtatcagataccagtttccttctaccctaattcaccgcttcctctggccttcgctttttccgcgttcgcttctcttccgctgcccacgcgacttccacgtccccaccaccgcgccgcgccccagcgatttcccctcacgatctcgccacgccccagccccactgcgccttccatgtccccaccgcgccacgacgcaccgcgccgcatcctcgctcgttccgtgccgcgccctgcctacatcgcgccgcgccgcgctctgcccccatcgcgccacgccgtgccctgcccgcgccgcgccctgccctgctctgctcacgctgcgccgctttctgtcttcgccacgtcgtgattattctgcctctctgccatgtctaccgagtccacctcctcttccacaacctcgggaacaatggcatctacatcatccggctctactccatcttctgctgccagcaccggggattctaccggctc

SEQ ID NO: 8438 - DNA, 1501 bp, Oryza sativa
tttcatctttcatttcattctgggaataggctggtaagtagcttcacaaagttcaattaaccatttagatttagcaacacagaattcaaatcaaattactcatttctgtaatcttttgtctgatttctctctaagattttcttttttgttgttctgtttccttctatccttcagtgtgtttctttgggaatcactgtaataggcgggacttgttctattcaagtctttaatgcattcattttctttgtttctgtttgagcagtggtttaattctgcaaaattatgttccattcatgcctcaatcgtgcccctccccgcccctctttttttttgcttcttcaaatatacttctctttaccctctattcactcttcacatcagtatattttggtccaattacaattttctttgctaagatgtatagcagcatacttgatgttcacccttctaagtgctcaccaaatcactatttgggagtcatagaaatatatctagctgttgggttacgaattgttgtaagacaaatctttgctctatgtggaaaaaaaacacttttaatatctgaacaagaccagggaaaacttatttcgttttcaagtttgatgtaatagacttctgcatttggctgatgatatgaccagagctccactttaacagattgaagtgaatcatcttaggggtacatgaaacaggcctacatcaactatgaatcagcttcgcaatggaaaagttccccaatatctttcgccagctataactgtagtaccagaactctctgaagttacatttcctagtttttcagagcatagaccatcctatatcgaaagggagcagtgtggtagttctatcaactcatttgatgcttctactccaatgtgtatgttagcttccaactttacatcagatctttatatcaacaaaagtgaatcacctaacggcaagctttcttctgaatcatatgctattgatacctctggatgtgattcttccttgccgccaacacagtcattatacaagggtaatccaagttctttaaggatggtttatcctaaagtatctgaacagaatagttggagtcaagaaccactgcctggaccatttgtttgtccaactagtgttgatttcttcgatcaacaagatatgactatttttgaccaacaaatacaagataacattgcagcaagtcctagcaccaaccttgcaaagcaaaatgagtggttctcatctggcacttccttgcagtatttggaaagttcggtgtctgctggttctgtgctgaaggtatctgatttgacccttttggatggtgcactaactatttcatgatttcttatcctctctcacagcctgtacggcaatttagaccagctcttcattggtctacttaaaattttagataacatttcccctcatttccaggctgttgatgcgacaagtacaacaccttcaaattatttgcattgtcatgcacagagaaatacatcaaatcctcccaacttca

SEQ ID NO: 8439 - DNA, 1501 bp, Oryza sativa
cagtacggaacgaggggtggttctgaccttggcggtgtcgagccagacggagtcgagggggttgaagtcgaagggcgagtaggggcaatccagcacagaccacgcgcgcagctgcgtcgacgcgaacccggggattattatccccgagagcttccggtagtcgaaatccgcgccgccatcgcctccgcccaccgcccccacggccgccaccgccaccgccgccaccgccaccgccaccgccaccgaacaggcgaggtccccgcgccggagccgccgccgaggcatcgcgaagaactgacgcgatctgacgagcgattcaggagaggtaggagctggatgtgtccagcgcgtgcttccaagggggaggtcgtggatcgatctggaccgtccgtgtcgcacgggacaggtcagatctcttgcaaacggacggtcggaaatcggccgcgtgtgctcccctccctaaggtggaggtcgtgtcgttcaactccgaccgaagggaggaacgggaggaacgggagtcgaggccgagacgctgtctgtctatcggttccatttttttttcttaaaaaaaagattcattttactcctttaaaatattttattggttcattttacacattaactattgaaaacggatcaccatacttcctaacgatatttctttttctctctctatataagtcatattatacaatgaaattgataggattgagcactgagcatgatttaaacattaaggttttagattttaaacaaatagcgtatgttcagattcaaattcagaacagaattcattttacaacagagggagaagaacaagatacatgagttgcagtagtgcgtcgagcataattcagtagggtatatccagttttgcacagaagcccatctagaataggcaagttatactttagatcaacattctgcagaaaaaatctacaaagagaataaaaaggtaatcgggtcattctcctttgtttgcctacgacgctgataataaatgctttgatcttgattttggcggggcttaaaacaaggcgagctgcaacaggtagagcctattcatgaaccctgaagggacctctcgtatacgaaggttgaggcactagcaaacaatttgatcctcggccacaccaccgaagattttcgccaaatttctttcgcaagatcaacccaacaacaaccattgcaagaaaaacggttagatccaaaccactaatgaaagagagaataaacattgtgaactgcaaagaaaaccagcgaccatacccaaaaggggcctccttgcaagagaggttgagatcatctcgactagattcaaccacatcagccacatcttaaggaagcttcgccggatattaggaaaaggaccgcttctcttgaatggagctagaagctctataatcaaccgtgcttgtgacgatgaatggtggatatatacatcgataatcagccgctaccccgctacaagtacaatcgtagcgataaaactgtaggaaag

SEQ ID NO: 8440 - DNA, 1501 bp, Oryza sativa
tacaaactcaaagtttcctagttttaaatagttcttttaaagccataaagccaatctaacactaataactaatagctaaagctagattaaaaaactttttttgcgacgaaggtacttttgaagtgtttgtatcttaaaggcatgactctatcctttaacatatgtgactaaaaaaccatatgttcatagactaccaaagtttaaaaactaatttaaaaggtataaccaataagtataacctagaataagcatcgccgtatactagatcattctaatgtgggattctccgtgctatcggctactactctcaaatactagcattcaaacaatccatgactttcactctaattcgtgatatcatactataatatggatttctgtatctctatctctatctctatctcttctctatctctattattataaaaattgaatatatttttgtcagcactttggtacgtcatttgtgtatgagttgatttgtaagtttgatcgcttttggaaatacaaaaagagctgtataagaaatctctttaaaaaaaactcatatactaacttaatagtctatttaatagccaatttataaaatagttactccatccgcctcaaaatagttgtcgctttggagttcaaattttgtcccacaatacttgtcacttgttagtattacttgtcacatcaatcacctccaattcaattttttacccattctatcctcaccactctcgtgcttctattcaaataaggggcaatatagtctttacttctcaaaccttaatttgtgttaaacaacctagaaagataagtattgtgggacagagaaaatacttataacatatagtacacagttaatacttggtctcacttatcatacacacatgtatcttagagcccgtgatgtatatagctggctacggatctgtagcccgctgctattctctctcctttttatcttcttgaaatgtatttatagctggcttatagcttgctattatagctgctctgagagcaagtataatagaaggctgtaagtcagctaaatgctgaggtggaggagagaagagaggagagagagaggagaagtgggctgtaaacttacagccggtttggacacaaaaaccaagaaattatgtgagagagacaagtgggccctatgggctggtttagtttgaggcctaaattaggcttaccaatatttggcaatttcaatagtgtttagtgtctatttggtttgaagccaaattttggcatgtctaagaaaataagccatttcaatagtgaacttaggctgttttggcttcaatccaaatacaactttgccttaccaaaattagtcatgccaaaatttgccaaattttggcattgacaaaatttggtaaggcttatttaggccacaaaccaaaccaaccatatattaattgtaaatagctaattattatatgtgtgggctaagagcagactaaaaaaaaccttatagccaataagtcggctatattattag

SEQ ID NO: 8441 - DNA, 1501 bp, Oryza sativa
tggcgggctgtgaccggccggtggccggatcgaagcaacctggcctgattgtgtgatcttgtgtgtgcttcttcgctcggttgatatataggagtatctccgtgtgtgttatgatggggccagattaatatccagctataaaatcccaagctgtattgttaattctctgccggtgtcataatctattgtttgagcataacttaaatttgagcatgattaatttggagatactctctgtttcccacttgctactgtaatgagtactttcctacagttttatcgctacgattgtacttgtagcggggtagcggctgattatcgatgtatatatccaccattcatcgtcacaagcacggttgattatagagcttctagctccattcaagagaagcggtccttttcctaatatccggcgaagcttccttaagatgtggctgatgtggttgaatctagtcgagatgatctcaacctctcttgcaaggaggccccttttgggtatggtcgctggttttctttgcagttcacaatgtttattctctctttcattagtggtttggatctaaccgtttttcttgcaatggttgttgttgggttgatcttgcgaaagaaatttggcgaaaatcttcggtggtgtggccgaggatcaaattgtttgctagtgcctcaaccttcgtatacgagaggtcccttcagggttcatgaataggctctacctgttgcagctcgccttgttttaagccccgccaaaatcaagatcaaagcatttattatcagcgtcgtaggcaaacaaaggagaatgacccgattacctttttattctctttgtagattttttctgcagaatgttgatctaaagtataacttgcctattctagatgggcttctgtgcaaaactggatataccctactgaattatgctcgacgcactactgcaactcatgtatcttgttcttctccctctgttgtaaaatgaattctgttctgaatttgaatctgaacatacgctatttgtttaaaatctaaaaccttaatgtttaaatcatgctcagtgctcaatcctatcaatttcattgtataatatgacttatatagagagagaaaaagaaatatcgttaggaagtatggtgatccgttttcaatagttaatgtgtaaaatgaaccaataaaatattttaaaggagtaaaatgaatcttttttttaagaaaaaaaaatggaaccgatagacagacagcgtctcggcctcgactcccgttcctcccgttcctcccttcggtcggagttgaacgacacgacctccaccttagggaggggagcacacgcggccgatttccgaccgtccgtttgcaagagatctgacctgtcccgtgcgacacggacggtccagatcgatccacgacctcccccttggaagcacgcgctggacacatccagctcctacctctcctgaatcgctcgtcagatcgcgtcagttcttcgcgatgcctcggcggcggctccggc

SEQ ID NO: 8442 - DNA, 1501 bp, Oryza sativa
taacttctttatgaatgagaaggtgatttctgtagcgtattgattgtttgttactgtgtgtgaacctggactgttctgcttaaattcgataatctttctcttgtctactatccgatggatggataacgataacccattctccattattgaatagacaaagcatgtttgtggtgtctggtgatcagactgttaactgtgatactactattgtcgatttcattcatcgagtcttttgtttgtcgatgtttagggccttgtagccaacataatcaatttttgcgatgtcaaatttttgataatctgataatattgctaagttttgatatgatttcttatgtatttatagtgtgtttgggaccttttttagcatcggctgcggctgaagcagctcaaagtggctgcaatttgcacaatttgcagcaattttgctcattttggtcacaatttgcagcaattttgctcattttggtcagaagtgtaaaaagaaatcatattcttacgatccatcatcctacaatccaagaaaataagtggttaacacatacaacgaaggacatagctatttatttgaattatttaaaaggacgcgactacaccgagagtgctagctagatagtgctaaaaagagacaccattctttccaaaaaaaaaaagctactacactcaatatctatatattttttccttcttagagaagtttctcttaaattacttatccgatttataatccgattacgccgttgtgttcattgcaattaaatctttacaacaagatctcacatgattatattttgatgaaaaatcacaaattacttttatgatatatgtataaattacttttagatttcactaagttacttcttaaactataaaagtaagttcagtaagtctaaaagtaatttatatatactgtagaagtaacttacaacaaaacgaaggtaactttggcatgtcatttgaagtaaatccgttgtagagataaaaacatgactctatctagaaattaaattaatcagcacaaattatggaattaactaaaaagtcatatttttatccctacaacgaatttacttctaatgtcgtgacaaagttacttccgttttgttttaagttacttttaaaatatatgtaaattacttttggacttttattgaatttacttttatatgtctaagaagtaatttagtcaaatctaaaagtaacttatgtatataataaaagtaatttacaaatataaatattttttcatcgtaacataatcatgtaagatcttgttgtgaagatttaattgtaacgaacacaatgttgtaatcggattatagatcgaataagtaatttgagaggaaactttatttgaataggaaaaagatacccacgtgaactttatttgaaaggaaaaagacacctatgtggatggatatcatgacgacgtgcacagttagatggctctgagatgcgtcgcgctatagagctaaaccgagagcgctctcgaaatagattt

SEQ ID NO: 8443 - DNA, 1501 bp, Oryza sativa
caccgttccatagagtcgttttgaatttttttttcttagtcaatcttttatcaaatttataaaatataataataatagtttcaatataaaacaaatgaattatcaaaatatatttaatgttagatacaataaaactaatttagtgtttaattttctaaaatttaactttggaaaaaatttaaatatgagtgaacgtagagttagcgggaaagtcgtctctctaatctcgtgtgagctgtgtgcatcagtcagcaggtgagtgcacggtgaaaagcagaaaaattaagcacaagtacatcgatcaggtacgtcaggtacgtcacgtgtgtgtccggtaaaagttgaaggtgaaaactgggaatatagaaatcattagcgtcgtatcaatcatcaaggtgtagaaatctgcggccggattggtgccgtttggattacggacggacggagatggagcagaggtgtgtacttcggttcatttcgatctgtgcacggctcgcacggggcatgcagcttaactacgacaaaaaggcaaaaaacttaaataattaggctgtgatgggcagaagtagattgagtgaaaaaaaaataaatttacagtgtaattataatataattatattatatttatatttgataaagttttaagagaaaatttgtcgacaaatgtatagtcagtccctttcgtttttaacgtgaaagtttctcgaacagttaaatagtggagtatgattttattttaaaaaaatatgttttaaaaaatatattaatttattttccaagtttaaaataactaatactagattaatcctaagttaatggttcagctagttttgcatctttatcaattttctccaataatgtcctctcgattctcgaacaatggctaatactccgtgagagcaagtttaatactctagtatagctaactattagctctaattcatctatagtcaatctaatagctcattcatacaatagttatatactacactattaatacctggtcccacctgtcatacacacattgtgtctggtaatccgtgctacagctggctataaatctatagctcgctctcttctctctctttatttatatttttaaaatatgtttgcagttcgtcttatagccttctatcgtaactattggctgcctgcgcctgcctgcaggctgcagcgagcgaccaatctggttgggcgttggccgccatacgaccagatcgaccagagagcaaaacacatgagaaatccaggggtcaccgcccgtacagatccgcgcccatccatccatgcatcgtcacgcgcttttttctccaaaactccccgtccgccccccagaagaatacgtagccgttgtgtcgcgcctctcgcgtgccaaccccaaccccaccactgaccactctatatatacctcctccaccccccgccacacaccaccacgatccaacgcattttcttccacaattgcacgtacgtggagtatcacggtatcagtagtacgtaa

SEQ ID NO: 8444 - DNA, 513 bp, Oryza sativa
ctaagtaactagtcggttcagggaaacctcgcatgccaatagttggggaacgccggggcggggtcggttggagccaacccgggttcctggtaaggcaagaacacgaagcttgccagattaccgatcgaggtggttggagtttgatttgtgaaaactaaaatggcctatatttatgtgaggaattgatccttctatgtggcatgaggtaaccctgggtcggcttgggaaaggctttgttgcgaacctctgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctacgtggcagatggatgacctgagtagtcagaaacgaatctgtgtgattcgggatgtctgtgggcatcataga

SEQ ID NO: 8445 - DNA, 1501 bp, Oryza sativa
ccactaacataacaaggatttccttgttgatttaaaatgattgacaaaacatatagatatgccggtaatattgaaaaattcagaatgtaagagttacacaagcatttcgccccagtatacaggggaaaaaggacagacaaaaaggccacatgtaaactactatgaatttgagtaattaccaatccgaactcgcagctttctctctccagtagagggcttcttcttcatgtagcagctgttccaatcacctccatcctgagagtagtaatccattgggtactcccccccaaagtccttgtcagcacaaccaccattgctgcaaccacaatctgtggaagttcctgatcctgaacaacaaccggtggcatctccactgccacattccctactccccttctcccaccatccaggaacatagcccagtgcaacatcaaactcgaatgtcgtcagcattggcttcttgaatccttcaccccagtcaatcgacaaacgtgggcatgcaatctgcacccacgcatccaccgaatccccaaacagctccatccttgccggggacagctccgacatgagcactactgtgtgttccagccctttctcctccaaatgctccaccaccctgtcgagaacttttacgcttccctgccgcccaagggtgcctagtataactccccaactcttggccttccttgctgccagcaccgcctccttcctcgcttgcttcatcccgacatggtcatactcctccagcacaagcacacccaggaatggatcaaagcggtaggccttgaccccgggattggcaatcatgaatgcctcgaggtggaatctcccgtctgcgacgaacaccaccgctccgaccccctcggaccttttcagggcaggtgctgtgcacccaagaacctcgccggcggacagcggctttgcctgtggcacgacgatgccctggtaaccatcgtgactgaggatctcacgcgctgcgtgaactgccgaaatgaactgcacggtgccggcgatggcgaggcggggcgcatcggcggggtccgggaaggcggcgcggacagcgtcggcgaggcgttgggcgtcgacacggatctcgacgaagacgtagagcacggggaggagggaggaggtgacggggacgaggcaggaatggccgtagtggacgagcacgtcggcggcgagcgccttggcggggcggtcggcgaggcagcacgcgccgtaggtgggatcggcgaggatgaggacgtcgttggaggggtccggctcgaggaagggcgcgaggaggtgggaaagcgggagggagaagaggagcaaaccctccggaagctgcagcgcggtgcggcgggcgccggaggagcggatgcggtgcgccgtcttggggagctcgaagttgtacgccgccgggaggaggccggtggcggcagcggcgagggttgggtcggagaggatggagggcgggatgggcgtgtggacgaagcgcttcggggcggcttcctctttg

SEQ ID NO: 8446 - DNA, 1501 bp, Oryza sativa
ctccaatggcgatgaagcaaactggaggcctccgtttttctcccggctcacaagtcgactagaaattgtaaaatcaaattaaaattcttttttggaaaattttgagaaattttggggctgagagatgaatggataatggccgcggagttggcctcccttccacgtggcctgcacttttttcggctgagtggatgtgtggttagccacgcaactttccctggatcgaaagcgatgggccgttggattgggccccagcgcgaagcggacggcgatcgcggaccgcgtgggctttttgccttcctgggctttctgcccacgtgtccggcccaattaatttcgtgaacctttgataccctctcttctctccttctggagaagcaaaccctcgcgccgccgccgctctctcccacccgccgccgccgccgccatggacgccggcgagacctccacctcggactcgctggtacttgccacgggcgccgcgcagggaccaaagaggaagccgccccgaagcgcttcgtccacacgcccatcccgccctccatcctctccgacccaaccctcgccgctgccgccaccggcctcctcccggcggcgtacaacttcgagctccccaagacggcgcaccgcatccgctcctccggcgcccgccgcaccgcgctgcagcttccggagggtttgctcctcttctccctcccgctttcccacctcctcgcgcccttcctcgagccggacccctccaacgacgtcctcatcctcgccgatcccacctacggcgcgtgctgcctcgccgaccgccccgccaaggcgctcgccgccgacgtgctcgtccactacggccattcctgcctcgtccccgtcacctcctccctcctccccgtgctctacgtcttcgtcgagatccgtgtcgacgcccaacgcctcgccgacgctgtccgcgccgccttcccggaccccgccgatgcgccccgcctcgccatcgccggcaccgtgcagttcatttcggcagttcacgcagcgcgtgagatcctcagtcacgatggttaccagggcatcgtcgtgccacaggcaaagccgctgtccgccggcgaggttcttgggtgcacagcacctgccctgaaaaggtccgagggggtcggagcggtggtgttcgtcgcagacgggagattccacctcgaggcattcatgattgccaatcccggggtcaaggcctaccgctttgatccattcctgggtgtgcttgtgctggaggagtatgaccatgtcgggatgaagcaagcgaggaaggaggcggtgctggcagcaaggaaggccaagagttggggagttatactaggcacccttgggcggcagggaagcgtaaaagttctcgacagggtggtggagcatttggaggagaaagggctggaacacacagtagtgctcatgtcggagctgtccccggcaaggatggagctgtttggggattcggtggatgcgtgggtgcagattgcatgcccac

SEQ ID NO: 8447 - DNA, 804 bp, Oryza sativa
ctgaattgttatgttgtatgctgttttcatctgatcatgcatgtgctgctctgaagattgatcttgaagttagcatttggtacagcaaactgaatttgaatatgcatgcaactgttaaacacagcctaaaacgtgtttacatggatctctactgcattcccataatcaatcactacggttttggttatcattggtactggaactgccagtcaatttcttctatgtaacagtcgtcttagacgaagaatgtgcacagcaataataatatgtttgtgtctatgatgtcctttctattggacttgttcatccatatggattgttagttttgaactgcattcacgacttagcttgcatgccaacttcaggtaacactatgcaacaaatatacgaagtttaaattggaggtttcgtgctttcaaattcaacttatagtttatataattcatttgtatttttccattaaaagtgccaaatcttgaagctctttgtatttatacatccctttaggtatgtagtatatagcagtttgccattttatgcacacattagaacattgcacaggataatgaccttgaaattttttttgtcacttctatatgattttagtgtatgtcaggtagaaacaccttttttgtattatagaccctgtgtatttttgtttatatgctgctaaagcatccccttaacaagtgaaatatcctttcaagtatttttgttcttattgctgatgcatgacttcgcaatgtgtaagctttgtatacaaacacaaccagattgtcagtgtgcattttgttaatttccagc

SEQ ID NO: 8448 - DNA, 1274 bp, Oryza sativa
tcatgaaatatttggttgttaacactagtctttcgacagatatttaggaattgattgtagctgcatgatatatcatatcgatatatccatgcattgtcaatatgatgtaatgatttgcatggaggattttttttctctttaaagaaacatatcgtgcaaataattacactatatatgttttctgtacacatatatatggccccttaattaagcagagaatacctcaaaaattgtttctcaatagtaccagaacgagatataccttgatatgtatatatagctagtactctgtacgtttttttttcttgagatagaggtggtgtatatactacgtttcagaaaccaactaagatcgatgagctgatcactagcagactaattatgcataagtgcatgccatgatcgtaattaagtgtcctaattgacacaaatatgtatataagttaagtatattcgatgataattaaggaatgcaaatataatacacgctttgcatgcatgattaattacacacaaccaaaccttgagtaagtgggagcaatttacttaaagtcggtgtgtacgtgcctaccatgattagctacgttaagacaaaatttttaaaactatatattaaagaagtatatacatagatacttctctaactggtgggcaagccatatattcaagtcaaaatgcaacaaccggatcaaactgtatgaaatgaattaattttcatgatttgcctgaaaatttgaaggcgacatgcatgtacacgttttcagaattaaatcgcggttgatcacagcatatctgggatcagattccaaacaaacaatctaaatgtatgaatgatattgatgaacacacatactccacctgtctcaaaataaaccaacatcgtacaggatgtgacatatctatgtatgtccagatttatcatactcgaagatttattttggtacggagggagtaattaatataaccatgcgtatgcgcgcatatatgcatggtcctcttctctatcaatatatacgaggcaaagttttgccctcttttttttaaaaaaaatatatgcatggtccctagctagttacaagaaaataattagctgcagaagactgaatgtggtcttctgcaggcatcacggcttttgggagtctagtaggactaagcccccccccctcccctcctttgtaggagcagttttttcaagtttagcttcctgtagcaatataatggccacctggccggttgtgtcatataactaaaactctgttttcttgtcctgtagc

SEQ ID NO: 8449 - DNA, 1501 bp, Oryza sativa
actcactctataaataaattaaatcctatggatgaatttgatccaggttcatctttaatattataatttctttaagaaataggtaaggacatatattcatccatctcaaaatattacaatttaaaaaaggatgtgtaatcagttattcagttgtaacgtcttgggacgaaggtagtaatacgaagattctaaaaaaaaatagctacagccaatgggaaacacagagcctaaaagctcaaatgatctgatcagcagtcaacccccggcgagaccactacagtactacacattctccagacgccagctagcgcttgacattgtgtgtgtttagttcacgctaaaattgaaagtttgattgaaattgaaacgatatggtagaaaagttagaagtttatgtgtgtagagaagttttgatgtgatgaaaaagtttaaagtttaaagaaaaactttggaactaaactttggccattaccagtttaccatgacaagttcaactctaggacgaattggctattgccacccccttctgatcttctagtagcaatctgggctcaaaatgagaaagaagagatacgcgtgtgcctggactttgtttgaccaagcgacccacatggagttttcaactttcctcgagatatctgcatgcatcggcgctgtttgacccggtatatatatctattcaattctagcagcatgggttagggagaaatgaaatggatgattcactcgattaattaacacggtaaattaatattttgaaaacaaactttaaaaatataaacagtaggagtagcaactaggaacagagtggtctaaatgcggcagaataatgttcgaagaaacttttttttacaagagtggagtaaacaatctggaccaataatctgccaacaagcaattatgaacaaggctgacctatgacaattgacaaacaaatccgatgttgggctgacctatgagcacgttaaggggaaaaaaatcatatgttacatgttataagacgttttgacgttgatcaaagtcaaactactctaagtttaactaactctatagaaaaaagtagtaatatagtagtttgattttgactaaatttaaaacgtcttataacgtaaaacggagagagtacattctatgccctataaagattataatccgttcttttctttaaaaaaaatacaatcctaaaacaatcaccttaccaatcaatcatcttacccttttatataaactttttcacaccttagggtgtgtttacgccccatttagttccccagaaatttttcccaaaaacatcacatcgaatctttggatatatgcatgaagcattagatgtagataaatgaaaaaactaattacacagttagggagaaaatcgcgagagtaaagttgggaaagtgtggatgcacagcctaaatgtccacagctagcctgagataccagattttgaaagaagttagtattttttcaactctaaaatcatgtttcagctgaaattgttacg

SEQ ID NO: 8450 - DNA, 1501 bp, Oryza sativa
gcgacgtgacgttcgtcggcggcggccgtcgcatggcggccgcggccgccgcggcgcttgggctcgtcgagctggacctcatcggcacggtgggcgccgccgtgccggggcaggcgacggcgcctcgtctgctcgtcgtgtcgccggcgccggcgaaggaggaggaacgcgacggcgacgacgacggcgagccgcggcagctgttcgcgtgccactactgccggcgcgagttctacagctcgcaggcgctgggcggccaccagaacgcgcacaagcgggagcgcacgctcgccaggcgcggcgccggcgcgggcgccggcggcgagcaagcgtcgtcgtcgtctttcgccatccaccacggcgcgttcgtgtcggcgtcgccggggtggatggcgcgcgtgcttcacggcgaggcgccgccggcgatctcggtggccggcgacggcggcggcggcgagcggtggtggtggggcggtggaaacgtcggctactactggccgcgcgacggagacgatcaaacgcgtcaactcgacctgacgctaaagctgtgaaattgctggtgtaaaaaaacacacatatggacacatatttttgctgctggaaatgaccctagctttttcttctcctgcatttttttttcttgcttctacatttctggtgtcccggttgatcgggacacggatcctctgcagtactgcacttgcagtagcagtagttgacgggtggtcccaatcccatatttcaatggcagctactgtaggtgcagtaatgtaaataatccccactgtgttgatcgatgtatataaatactagtaattttacaaccttaattccaagaattacttggcatctctttccatcattccatgcacgtatgctctactatgtaaactgaccctgaccgtaataaacatcatataattttccgaatctttcgagttgatctaaaaaagaattgatccaatgatctttttcgatccggttattgggccactaagcatgactatgagttagaagtgaacagctcacaaaaatgaaacacaaaaggaaaactataaaggagatgatccatcgaactgactgcatgagatatcatatcattttctgaatatttcgagttcatctgaaactaatcctccggtgatcttttggaaacttaaatgataaatcgatcttctagtcgaataagatcaatctacacacactctacacaatgtggaactaattaagctcttacttataagttacaatgtaattaattgctagccgcagaaaaaaaactaaactaagctgatgatgatccatgtcaaaattatatagcttatcgttatcgaaggagcactcgtgcgcatgcttggttacgtgcgtgcagagaaagagactgacgctgtttaatttctcttatcatttttaatttcttgcagttgaacttgatgcatgtatacatacaaaaatgactatgtgcataattggtgtgtttaccagaagttatactgccatt

SEQ ID NO: 8451 - DNA, 1501 bp, Oryza sativa
tatcttgagattgacaaagtcaccacggactaacccgatatattttgattttgacgaaatcaccacgggtgtctcgctgtcaataggtatgccgcatatcattgaaggaataattaatcgcaaatgcgagtacctatgtcaaatatagaatttgaacctggataggttggttccaacacaaggaacctaaccaattaagctttatatgcttgcaaagacacctacagatagacatgctaacatacaaatttgaattaaattggttcatgtatttagtagagatatctaagataatctcttatatatttttataggatttctatatggctgttgacagaaaattaaggctaatcttagctaggttcgtgctctaaccacctagatctttctcctctagctccaacgactggtgacgtcctaacgagttagagtttagggtctcagattttggggtgggggaagggagaagaggaaggagatcgcggggtttagagagatggctgtgggagacgacggcccaacggtccgcggtggacacaggcggacggcgaggtagcaatggctccaaagctgccaagatggaggaggggcagagggccgatgttggcgatgagggaaaatagagcttgtagttaggagatgacggttggtggtggcgtttctagcaacggggagctgtcgaagataggaaagaaggcgccgcaggggcactcgttgccgccaacttagagatgagaggggggggggaacgctgcgatgataatgacgaaaagagagaggagggttagtggtaaatggcacaaatcttaaaacaatccaatggtttagattttgcaagatttgtaatggcattttttcagtcaaacgccatacagacagtccctatcgtttagtagtttgtaagagagcaccggaggtgcagtgtgcatgatttcgaaccattacgattcaagccctacaacaacgaatatgcatgtgtgcttctaaggcctttcacagtgggcggaacttaccgtggcttcgtctcacgtggcaagaaaagtgggtggggcccatagctatactcggttctccggttcctagcaaagcaacgaggaacttcgctcgggcgcggggcccactcggggcgcgggcccacttggtgagcacgcgggcgacgacgactccgcgcccctatgggaggtcctcggccgctgcccatggcgagtcgccggcgcggctctctacttcaatcgccggccgcgtcggccacgccgcccccgatctggtcgaccggagctcgccggccaggagcggcccgcttggggtggagagggagatgcgggcggccccccaagctcagctcagcgcgacgacgacgacaccactgccgtcctcctctctccgccttctcgtcgtcgtcggttggagctgcttcgcgtcgacgtcggtggtggccgagccgccgccgccgccgccggagaggcgagctccggaagaagaggaagaggagagagcaaaa

SEQ ID NO: 8452 - DNA, 1501 bp, Oryza sativa
atgtagctagtttgttcggtgaattctggttttactgccattggccacctaaggtgtgtttagtgcacactaaaattaaaaatttagttaaaattggaatgatgtgacggaaaagttaaaagtttatgtgtgtagaaaaattttgatgtgatgaaaaagttgaaagtttaaaaataaagtttggaactaaacattctttaattacataagtagaatggaatgccgcaccacattctttaattgctatcgtgctaaacatttcattccgagttttacgataggccattatttaattctacgttctaatatgcttgtcaggttgatatacaacttttagttttggtctgagataatttcttttccatttccccattccttttgcagccgttccttgatcagtaaatatacctattctgctcattttgcccttgttggagttgagctcacgtatcttcacgtcccggctcagcggattgcctcctggcccaacacctgctccatccgccgctcctactctgggcccatgcttctggcctgacccatcgtgcaaagtgcgaacgggctatctcaggcttgccgatatacagcatcaattcagcccaaccataacacaactcccggactgcaaaatttgatgggccatactaccactacttccaattacaaatgtaggcccattcgcagattcgctattgatgcagatcgatcacattacgggcactagagagatccagttttgttatccgaatttcgtatcttgagctttgattccggaagataacaacaaaatcttctagattcacacggcgattagcgaagagattgggccttctagctttgacatcgcaacgtatggctacgagtcgacccaaaaaaatcttccatcatttattttcttagaggaaaaggccaaacaaaataaaaaggaaaaaaaatctccaagcattaatgacgctttaaattactaccccttccgtgcctatccatccaaaatttcccgtttcgtttaaacttcgttgcgagctcgagcccgaacccgagctcaccgcacccgtcgcaccgcaccgcaccgcaccgaaccgcgcgcggcaggaggagaccaccgtcctttcctctccgcctcggcctcgctccctccggccccgaccgacggcgacccccgcgaccgccgcttcctccccgcccccgccgccgatctccgctccggctgctccaggcggcgaccttctccccctcgcgccactggggggatccaccccggagtactgagcatctgttccaggtaatccctaacccccactggcggcgggtttcagcgatcgaatcatcagtatgaccgcgagattccgcgtagttcctgcatgtttcggagtatcggagtaggtgttggatttggttccctgcgcgctgatgtgctaatgctgtagcctccgcttgtttccatctacagggaaggggagcggcggcggcggttttggtttggcgttggtgagttgatttt

SEQ ID NO: 8453 - DNA, 1501 bp, Oryza sativa
agcattaaatgtagagaaaaaacaattacatgaattgcgtgtaaattgcgagataaatcttttaagtctaattgcgtcatgatttgacaatgtggtgctacagtaaacatttactaatgacggattaattaggtttaataaattcgtatcgcaatttcctggcggaatctgtaatttattttgttattagattgtggttaatacttcaaatgtgtatccgtatatccgatgtgacaaccaaacccaaaattattctccaactaaacaaggcctagaggtctcttccaaaatagaattgaaggctagactaggaattaatctcttacttatatatcgtaatccatttatcgtttcaatttccgttaccattatccaaaatatacatatttatttgtctagctatcgctattacatattaaaagaatcatagttatttccattaccattatcggaaaaaacattcatatttatctatttaattagttgttgctcctatatgtattaaaaaaaccattaattatttatatagtaatccctctacaatttttcgtggtgatggaaacatgatcaccctgtttgtatttttatcagcagtgatttatcatcagactctctttcacccttaggtttgctgaatttcagtggaaaatttgaactccaaacctctcctgtttaagctcccattggttgcccatttggccaaaatagcttatttggcttattagaaaattaaaattaatttgtaagtaaaacttttatagaactattcgtagcgacttaaaagccaacattaacaaaaaaaaattacgttaaaaatatttcaaaatcaaatttaaaaattcaaattttgacttattctttggctgtttaggccaaacaatatagctataacattgcgacgcacgggacgtatcagtactggtatcaaacaagcttttctaattttgtaactgatcttttactatagtagtttccagcgatcaaatgcaaatagccctcgaaaagaaagcagagacaaaacataataatcactcagaaaacccatccggagaggacgaacttgcaaacacagaactgtatgcctacccacgtactcctacggtcctacctactaccgtcaacttgagattttctccctgagaaaaactgattttaccgattccccccacgcacaacgcacgaaccttctcagctctcaccggtggatagatagatgatactcctcgcctcgccgcttgcctcccccattgcgctcccaccggcggccggagtcgtctcccaatccgacccaaggtggggaccaccctcctgctcggtgggcccgagcagcccggccaagtggccgccgaaacccgctataaatcccccacgctccaccagcctccgattccacagcctacctagcttctccttctcgctcgcttcgcccgcataagtctagccacaaacccgccgccgccgccgccgccgccgccgctagcttccgcggagcggggcgaga

SEQ ID NO: 8454 - DNA, 1501 bp, Oryza sativa
agtagccaaagttggtcacctgttcttgggctaaaaagcgcacagacgcagctgagaagaggagagagagagagagtgggaaaagcagcataagcaaaagcacagctgcccgacgccgtcgccgctcgggccacggcgcagaggttgaaggagaaagggagaggcgccgagatccgagcgttggcgcgccggcttggggaggatggccgcctctccgcccggccgccccgcgccgccgccacctcctcctagggaggagaccggacggggagaggaaggggccgcgtcgccgccttcggccccaacgaggagaggtggaggcgtggagctcggtgtcggcttggggaggagcttcgtctgcccgggagagagtggtgggaaagtgtgagaggagagagagggagagataaaagtgagcggagagagataggtgagacccactccaagcaacatgtattatggagtatgtagctaatatggttctttagcctagttagaagcccatgcgctgtattttgtacgatacactgtgagtgctctaacaccacacaattgggaggggggatgggggacaaactaggtcgactcaactcattaacaagctagcaaaaggttagcttggcttaacttatgagctgctcattaacaatctcatttatatcatactaaactattttatcatatattaacataataacacttaatggtaattaataatcactaagtatataaagatatggtgatatcttatactaacgagctagctcgttaagcttatggacgcaatagggatcctggatattctatggaataccaaaaaaatctgcaaaatttaatatatgtcgatcaattatatgtctatgtacttaattggacataatacttcattatcgacttctattttcacaacaaattcactccttctatggtcttagctcatgccacttctatcttgatagccaattgtctcaaatctccaaactttagctcactaaacatcaatgatatgacatttgtaattgttgattaaatactcacactttggtggcgaaaaaaaaacctcaccttctatcactagggcgttgtttggtttcatgggctaattattagcctccatcttttagcctgaatatgaaaggtgagggtttttttcgccaccaaagtgtgcccccaaaaatccaaaaaggtgggctaatttgtggctaaagtgaattagccaccatcaaaacattagcccctccaaggggtgctaatgagactaattttgtgtggggaccattaaaaagcagctctctctctcttactctttctccaccttttggtcttgaattagtcaatggatccaaacatgccaacttagactaatatttagcctactaattaatgactaaacattaactctcaaaattagctctgggctaatcttccaaacatagcctagctcagcttgaccaagttctagcttagagctttttatccatccctccacacctccgcaccg

SEQ ID NO: 8455 - DNA, 1501 bp, Oryza sativa
gtatagaaatactatatataaaaaatattttaattcgaattcaaatttgaatcgggtatataaacttttgacttgtaaactttgggtctctaaactttaggtgtataaactttagatgtgtaaattcgaggtgtacaaactttaggtgcataaatttactaaaataagaaagtaatgtggtgttaaaaaaaacccacgtggaggggggatcggccctgatcatcccggacgatcgctcgcccattagcaaaaccgtctccaacccgtctatcctggccgaccaaccgggcgggtgggtttggatcctaaaccacgtcaaaagtcaaaacacacaaggtggagtatacatggacaactaggcctgcaatgcacatgcacggcacgggtccaatgatcgcccatgtccagagacggccgtcaaatactactagcagaacagcaaaaaggctgctgtacgtgcccgtcggtgtctcgcactctcgcggtctcgcgccgctgcagcgcgccgcaacttccaatcccattggctttagagcaaggataataagagcaagtataatagtgggctataagaaaactaaatggtgagtggataggagaagagatgagagagatgaaaagcgggctgtaagtttacagcctgcttaggcacaggaaccaagaaaattgtgagacagacatgtggaccatatatttatagtgaagagttaaccactatataagtgagctgatagataggctataagtaagcagctggctgtattattatccttgctctaatatagctcacttcctactactcccttcatctatttttgatagtcatatttccaaatctgaaaattttatttttgataggcatatttcaatccaacaacctatcatcttaatgattttctcgaatttaatgcatggctctctattcttccacacatgattggctatatgggctttgagaaatgtaaatattaatgaatcgtttgtttacgaggaatgaccagtagcatgcttaaatgaatgataagtagaactacttatccttggtctgtgtgtcaagatgaaatatgactatcaaaagtagatggagggagtattagcctatactaaagtcaacacatgtaatagattagctataaagttagctatgattttcttcttctatctctatctctcacttatatatttaatgtatttgtctttaagcttgtgttaagctagctcttgcatgagagccaacatccttctttttcttttttgtttacccctctcctccacgtaagattatagtaagcttatagctcactattatacttgctcttatacttcagctcgcagtcgccggctgtattaatattgtgcctgattttgcgagagttatgagagcgtacaaaccgcgcgcgctgcgccctataaacatccttccacttcttcacgtacgtacgaatcatttttcgtttcgtcagcaatggcacgcttgccttctcatcgtctcgcggctctc

SEQ ID NO: 8456 - DNA, 356 bp, Oryza sativa
tgagttcttgggagcaatggcgccgccgggggtgggggtgggtgtggcgtacctgtgggggaaggggaggggtgggcggaaggggacgccggtggtggtgaccatggagagtcccaactactcggtggtggaggtcgacgggcccgacgcggaggcggagctgcgcaccgccgcggtggccatggacaagggcggcgggcgtggcaggagcaggagcaggaccgccaggcagctcacctgggtgctgctcctccgcgcgcgccgcgccgccggccgcctcgcctccttcgccgccgccgcggcgaggcgcttccggcgctcccccgctgacgccgccgacgagctcggccgcggcc

SEQ ID NO: 8457 - DNA, 253 bp, Oryza sativa
aaaacttttctatgcataatgtctgcaattaaggattcttgcccccgtgtcgctgctagggcaggggcgacacgggtggcgaccgccaccaccgcagcactaccaccccgcctccttcccttcttcgcctcgccgccacccgagcgggccgctggaaactgcgtggccgcaaggacggcggcggcggggcctcctttcttcccccgaggacgcggtttggagcccacgaccccacctggatctggggtgccaa

SEQ ID NO: 8458 - DNA, 1501 bp, Oryza sativa
cgaagaacgaaaaaaaactatagattagagttacgacttacgacttatgagtagaggcctcgtagtaatcctatgttacaaaaggatgaaaagctacgaacataatgtgcacaaatgatggcaagttcgcagccccaaaccccaaacggacaaaccaaggaaaccaaaggattcaggattcaggaaaccccaaccccgctgcagattcagtttccacgcgagagagagaggccccagctaaccacacgcaactgcttggcgggagagcgagaggggagggggtccgaaccggaggggagcgccgcggctgcagggaagcgtcggggaggcggagcccagccggggcccggggccaccgccatctcgtcggcgcggtggccgcggtggttgagcggtggcggcggggcgtcgacgagcggagaactcggcgtcggaggtggggagttgcaaatgggccgggccttcgcgtgcacatccgagacttgaaaatctctcggccttaaaagacagcccatgtgagccaaatgctaattggtacggcgcgtacgctgccaaaagcccaaagcccatacggagtacgtgtgtttctttcttttcttttctttttttcttttttagcgcagccacgtttcctttttatttttttccttttttcatctcaacttttgaaaactttcaactgaaatttgaaactttcaattcagttttgaaaactttcaacttaaaatttgaaaactttcagctcgaaatttgaaatttttgaagtcaaattttgaaaactttcaactttccatctcaacttttaaaaacttttaactaaaatttaaaactttcaactcagatttgaaaactttcaacttctcatctcaacttttaaacactttcaactcaaatttgaaaactttcaactcaaaatacaaaaacttctaactcggatttgaaaattttcaaatcgatatttttggaaaactttcaaatcgtattttgaaaatttacaaaatcaattgtttttatttttaattgggaaattactgtagcattctcactaatctaccctataattcaccaactacactcttacaaacctcattcatcaaatccgatggtcaagaatgatcgaatccaatggttcgagatcgtcgtggaccctctcccttccgcacgcgcttggcacccacacctgctgcattcctcctctccccttccctcacgtgtgtcccctaatcacgccgagaaccccgtctctgccctcctctctctcgcactcacccagctccgccgatgctgcaccctcacgccgccgacgctccgccatcgcgacgccgcctcgccacccgcgacgccgcctcgcccctcatgccaaccgccgccgaccggcgccgccaccagcatcgccgattctccatcgcgccctatcgtggcctgcatcgccgatctaccccgaccggtgccgccgcccgcatcacccatctactccgtgcctccacgtcaacctccatcg

SEQ ID NO: 8459 - DNA, 1501 bp, Oryza sativa
ttctagttaaactttgttaagtttgaccaagtatatagaaaaatttaggaacatttaaaatccaaattagtttcactaaatataacatagcaaaaattttaataatatgattgttttgtgttgaaaatactaatatagttttatataaatttagtcaaactagtttgattaggaaaaaagtcaaatgacttatataatataaaatggaagaagtattttaataccttttatccatccattaatattattttcctataaataagggacactttgtttattttatccctacaactaaagttgtcttgggatgggatgctaagagtggatttgttttaggagagaggaagtagctacgagctttcgtagttttaccgaaatatcagtaatatattttttttcattaaaccaaatgaaactattcatccattgacattgccaacatttctatagggtcagtttggacaatgaaacaaaccaaaacatgccttcttactcatgtgccctccaaatagacgcgattggactttaattgccgtcagggattttaattccgaaaaaaacaaaacaaaataaaaagagtttatcacttttccaaaaaaaccaaaaaaaggcaagaactgaaatgaccaaaatgcccccttacctcaacatacttaacattctcaaatatgctccacctatctgtggacacaaatatatcttgtgtgacaccagagggattataaatctcaactaagcaattttttttaaaaaaagtttctttttcttataataaaaaagggtgacaactgaaatgaccagaatgcccctccgtcctaccccacaatctgttctgtttcttctctccttccctcacctctactctcctcctcttcctcccccatctctctccaaatctctctccgatctgtagccgaccaccgccgccgcggccgccggccttctccccgccgccgccgccgccacctcgccctcatcgctgcgcgctcccatccccaccgccccagcgagcagctccggaggggcgcggcgcagacgcccctcccctctcccccgagcatcccatcccatcccctcccgaccgtgccctagccttctccccccatcgcgcttgcccgcacgggcggcgagcacggctaggttttggagtgggggcgacgccgacgccgacgccgacgcggcccgcggtctagttcttccttccatcggcgtccatccatctcgtctcgcatcgaattgaaggtattcatctttttcacctctcgtattggggattcatccgggcttgggaattgggttgtatacttctacccttccgtttgattcatccgggcttgggaattgggttttgcccggattactttgatttggtagtactgacataatttttttttaattttcaagagggatttgggggttcagctgaaccccctccatgccgcgcgacgctaggtcagtcactggttgccaggagatactcggagcagccgtgaattgctga

SEQ ID NO: 8460 - DNA, 1501 bp, Oryza sativa
gggatagcttggtcctcttcatgctgatgccccacatttccatcatttatgttcacctgatcttcattgtatgggatccctgattcttcatagcttgagtctttggtttcttcgtcatatgtattttctggatcttccttgtactgctcaggcacatcactgagaggaatcgcctgctcctcattatcaagattactggcaatcccactcatgtcctccgcaggattctcgatgttcccatccatattttctggaaacacacaacatagaccatgtcaagtaacacaaaactgaaggtgagatgcttctcgggcagaagtgcagcataaattgtagcaacaggtggctcgcgtaatgctttgcgaggggcacagctcgcacggaacaataccagatgggggcaacccgcttcctgcaccaatctaactgtggactacacgaaaacccccaagttatttctactccggatccacctagataaagctcagcgcaacgcacaaacccctaacaccacagcaaactcgtcataagcgagtgaaaagaaaaaatcagccacgagccccataaaccctaaatcgagagcagagccgcgcccccaccacgacgcgagcgggcgcatccaagctacacctcccgcggctacagcgcgagtaccacacggcacaggagaacgaggcctacagcgcaagcaaccaatctccgggcgggtcggcggcgagctctccgccgcagctacgctagacccgcccgcaccaccaaagctacggattcaccgggaagtagatgccgagcgaaagcgcgctcacctcacggaggaagaggacgaggcctcgccagagagggagtcccgccgccgccgccgtggagggttttgagaggagaggagaggagagcacgggagccgtgcggatttgggaggaaagagagagagagagtgtgtggcttggttgcctcctcggtttgatttaacctggctactcccaccagcccatgggcctcacgttcgcccactcctgggcccagcccatccatataccggcccaccgctgccaggtgggcctcactccccaccgtgcgcggccgcgggccccaccgaagaaacaccacactcccgtgactcgtgtcgtcgtcttcctcgtcagccgccactgccgtcgcgtcgtctccaacctcctcgccttcgcctccacccagccatggcgacgagcgccgccgcgcgcttcctcgctgccctcgcgggcgccgccgtcctcctcgtcctgctcggcggagctgctggcgcggtggtggggcacgacgacgacgcggcggcggcgcggcggacgatggaggagttcgccggattccccgcgtccgactaccgcggcgatggcggtggcggcagcggcggctcctccccgttctacgtcgactccgatgggctccagcgccaggtacgtacgtacgcacgcgattccaccgcctgcggcaggcaaaacccgtggcgcgattccgagtgacg

SEQ ID NO: 8461 - DNA, 1305 bp, Oryza sativa
acactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcagggagctcgcgcgaggggaggggcgctcggcgcgggcgactcccgcgcacgcgcgcgcggcgcgcgggcggggcggaggggggagcggggagagaggcgctcggggcgactctcgcacgcgcgagcagcgtgcgggcggggaagagagagagagagagagagcgggagagcgcccggggggagagggagagatgggccggggaagaggggaagatgggccgagcgagattcggcccatcgacctcgggggaggcaaaatagacttttgaggaggaatttgattgaaaggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacacccacatatgctaatggcggattaattaggctcaaaagattcgtctcgcgatttccagacgagttatgaaattagttttttttatttgtgtccgaaaactcctttcgacatacggtcaaacatccgatgtgacaccaaaaaattttcaattcgcaacctaaacaagcactaactgatctctctctagtgaggggtgcgacgtcggtgaggaagaggacaaagtgcgaagagggttaatcttagttgttcggcaacgggacattgtgtgaaagtttgttttgttttccgtgtgcacgcttcccgaactataaaatgtattttttgaaaacaaattatgtgaaagttactttaaaaaatcatattaatttatttttaaagtttaaaataatttatactcaattaatcatgcgctaatagctactgtgtatcttttcttctcttttcctctcctctcgagctcacctattattggtccattctagaagcaggagcctatctgctccggagttggatccgagccgcccgatcagtaacgtgcgcagcagattgaccagaaaactagaagaaaaactctataaatatccaaggcccggtactttcctagccagctggcagcctccaacccgaaagcgatatcaaaatttgaaaccgcgcagaggcggcagcttgctccacacgcctccgccgtgtcgagatttccgactcgccggagaggaacaa

SEQ ID NO: 8462 - DNA, 1501 bp, Oryza sativa
atctataaaagtaagatatttaaaataaaaaagagttgcatattatgatagtttgtttaataataaatctagtaacatcaattttacacgattgatctttttttttatttttttctattaatagttaaaaagttaaaaatatttaacttgtcagttgtcactatgctaaaaatgattatatttcgagatggatggagtacgagttaaggtgttcgctacttctatttatcatggttgtttgccaaataacaacccccacaataaggacttggcaaggtgcttccctaattatcatgtgtatatatatcaagagattttgcaatcatgtgtatattatggtgggcacgagtagccgagtatgttttatattgagcacatgtccattatgctctcatattatattggttgtcaaaggttgccacgttaaaacttagacattcaacaatttgttacctcaaacatgtttggttggtaaccacaatggtgacataccgcacttggcttctagccaaatgctgtcacatttatggccaataatttgttggccacattttatacggcatatgccacacttatagcaaagtgaagcgtgacaaacatagttatcaaccaaagatcagacgtctggtattatccatcacatttctttcgattaaacaatatgtgcatagtaaataggactaaaatttacttcatttgttccaaaaatattcaaatcctagggacatgtgtctagattcatccctaaaatttaagtttttttttacagagacattacaccatttcattggggcagagaaacatgtcattatcatatactcctttcatcctataaaaacagatataatacggaatgtgatatatttagtaatacgaatttagacactactaaaatattacattgtattctacgtttgttttttaattagacgggtggagtatactttattgttaggcttagcgcctatttaattggcaaaaaaaaaagtttgcccgtgcatataacatcggatatacggacacacattaaacgtagtctaataacaaaacaaattacaaattctgacaggaagctgcgagacaaatttattaagcctaattaatctatcattagcaaaatatttactgtagcaccatattgtcgaatcataacgcaattaggattaaaagattcgtctcgtaattttctgttgaactatgtaattgatttcttttttatttctatatttaatactctatatacatgtgtcaaacattcgatgtgataattttgtttcggaactaaacaacccctagttgctgcatgatctgcgtatcttgtttgaatggggaatcgtgccaccaatttcctacctgtcatttgaatatcgaatttataatccagcacgcgtcctataaataccggacatggcagccaccgtctccactgagctcgagctcgaccaaagccgctctcccatcgtaaccaccggatagaacagtgcccccgccatgaggacga

SEQ ID NO: 8463 - DNA, 1501 bp, Oryza sativa
ggaaatcgaatatcagctgcggccaaaaggcaaaacgaaacatcatatcagacgacggcagctgcgtgcacaggaccaacaaaaccatactttcgcgcgtgtgcgtgtgtgtgtacgtacatatgtaccttctcaacggtggactcgaccgcggggccaatgcctccgccgccaccgccgtcccctccggcgaacgcgcgctccagcgacatggcggcggctgccgagccatcggagcccagcggcgattcgcccgtagtagtggccgtattaaccgacgaggcagcgcacgcgactgccacgagccggggcctacgacacggaagcgcggcgcggccaccgcccgtctccgcgcgccgggacaacgctggagcgagccaaccgtgcaccaccgcgagagcagccatcagctcgaatgctgctggtttgcctgccacgagtggagtacggaaacggacgtggtggtgtgacgcgtcggtgtctcccccacccggtgcttttcatcgccctctcgatcatccggccatgcgtgcgggtgcggatggttggtttctcgcgtgcgatcgaaagggagtgcaggaaagacctggaacgggtcggcaaatccccaatacggcatgcaggcccgcgggcctgcgcacgcgaggacgcgcgagtcacgatcccgctgacatggacgtatacagtgagtattgtagggggcaaccggtctctggctcgtatcagatggcctaatcagtaaaagaaaaaaatcaaattttaaattttcaagcttaatgttgaccttgattttgagatattttaacgcaatttcttttttaacattggcttttaagtcaaaaaaaaacatatttataaaagtttcacctacaaattcatttatatttcctaataagtcgttttggcttattaggaaataagccaaacgattgggacctcggtgtctcggaccctcggtgacggtgaggggccgtttgggcccttttcaccggtggtgaactggcgatgatcatcagaaacgggcagtaggtcgttcagtatccagcacacacggtggcatcaggcatgagttgaagtggtagaacaagtaaacatctgggctctggccatctggggagctatcaacagcagctccagcacgtgatggaatgcatacgggtaactggctgtaagcctgtaacggcgacacggcatgcatggctttggggcggtgctgattgctgtcgctgaaggaagaaatggggtgactcgattactcgagggatcttgaggtgcagtttcgtgctgaaaactggtattgcacatgcgccattcatcccatgaagagagctcttgtacatttgatgccgcaatcctgatatgaaaaatccagtaatgcataccatcatatatatgatatgaagttcaatgaaaagccacgtgttatgcaatcattagctgtcaactgaaagttatctttcaaatgaaacaacacatcatgtgagaacaaaaagctcaatac

SEQ ID NO: 8464 - DNA, 1501 bp, Oryza sativa
acagctgcaagtacacctaccactgcggcggctactagctaattaagctagcgaatgtaccatgcattactgagcttaagctgcgtgttttcttcaggattagcactggtaagtgtgattaagaagagcagtattatggtattttgctgtgtgttaattaattaccaccagtcgcttaacacttcgtttttatagtatatatagagagatatatacatattgtaatactggtgtgtatgttcttgtgtttgctggtctgatcttgggctagctatggaagtttgtgtactagttccttgtaatgtttaatttctaagaacactgtgtactcaagcgtacgtgtgcatgcattggggttggagaactaaccattgcattgcaaactggagcttctgtaccacgtgccatatataaataagaaaaatgtgtgtatttattatcttgtagtttagtcattctcaaaatgttctacgaattccggaatgattttgctatatatttattgataatttttctttctaggacctgtcaaacctaaacacaatatataattatagcataattactttttttactttgtatataactgcaatataacttatatgtaactatcataaaattttaatccgttagatttacttcaagatccgtgtaagtcaggaagaaaaaaaaatcataccgcgtgcacgtgtgagaagattcagtctcgtcctcttgcgacctacgtttctcgaaaatagcgtgttagtgtgagatttttaaaagttacatacaatacagttttatagttatatgcaatttacgatatataactacactatggtcacactgtatttacatccgataaattttcaagagaaattttgttaataaatgtatagctcagttatgtacgtggcctgcacttcaggcccatttagaaaggcccaatattctcggcccacacaaatcaccgtcctcgcgcgatcagtttgctcgctcgcctcgcctcccccgggtcgcatcgtcgcggcacacgcgtcgcatcttgtcggtggccggcacgcggcgacgtcggagcggtaggtgcaaacgcacgcaagccgaggcgtacgcgcgagccaagccaagccagcgagcgcgccgcgagaagcctctcctcctctccccgatccctctctcccttcctcctctccaccgagaaaaatcgaggccaacacgccacgcaacgcgcgggacgcgtgctccagatccagcgcctcgccgcgcgcgccaggtgttcgatgattttccggtgcgggagggtgtaggaggctcggaggaggaggaggtgacgcgggggtggggggcggaggggaggaggaggagggggcagatctgggggcaaatctggcaggcggagcggtggggctgcgggcgagggggagggcggggggctgggcggacggcgcggagggaggggaggagggggaggactgcagggggctcaggccctggcggcggaggctgctcgcgtccatgg

SEQ ID NO: 8465 - DNA, 1501 bp, Oryza sativa
ctaaaatattaaataaatccaaatttcaagttattacttctattgtaaaatatactagcaatataatacttattagataccaactagcataggactcaaatctagacatagatttctccatattcatactttgtagtactaggtggtgctaatcacgtactagattgttattttttaggtggtgctaatctggtactatattgctatattttgacatggaactagggaatatttggcaactcccaatggtacaagatagtgagagctttgggcaaatatatagaggcgttacaatttatcctaccaaaaattaattatactaaagcaagtccaaaaataggcaccacaaaaatttggcatagctttaaatcaaaatggccctttaagttgttggcaacgcaatttcaacctaagaataagatgggaaatatgggtggtgggtgtctgtttggctcacttgtctatttgtgttgtcaattgtggttgttcatttatatataccgttgacggactatactcatctacggtatttgtgaagtatggagatccttaattcgcaaatatacgtgagattgcagtaaagaagatgaagacaggggatttttatattggtttaggccctgagatcggtaatagtcctaatctagttaatatgtataactatgggatgtctctcacgggttacaatggtggagcaagctagctaatctagcttaccatctagtactcactgagaactatccgattacttatagtcagtgactaacaatggactttctttagatgaatctacgatacggcttgtggctatggcttgatttgatgtactcacctcccatggagcattatatttacacgggtaagcaacttccttttcaagtagaactcggagagtctttgtagggcacgggcaaataagactatgcctttcatgggtcggactccgacaacctctatccccgtgcaaggagtttctgttcgtatgttcttatgtaccatatttgggtataccttccatccaaactgaatctgggcatgcctcttatctagatttgtagtatcacgatatgtcccattcagttctaggtttacgtagtatattttaagacagggtagtaatttctatttcaataccgtataattgtagacttcagcatatattatgaaaatagtcttatctacaagtgataagaaaaggtgctaatattctatttcaatacggtgtactgtttgtggtattttctaaattatctctatgtataagtggtaacaatagcgaaaatttagtagggttttaaatcaatatagctaaactaaccatattatcctcccctggtttaatgccaatatatgcagccagttgaacacctaccaaatctgtcactctgtaaaacgccaccctgcagatgccagcacaggcaagtgtaaacgcgctttggcctaatcaccggataaattctgcacccatgtaccaatcgtctcaatgcgagagagattcttc

SEQ ID NO: 8466 - DNA, 400 bp, Oryza sativa
aggattaaacaatttgacatgctaatgtgatctctggtgtgatagacatgcccctgagctttttatccgatactactctcctattcgaaaatatgtgtaatctatgatccatcacactcagcttgcacgatcagaatatagccagccaggacaggacaagaacagataggctcttctcgcctcttggcatctataaatatcgcccctgcgccttgctctcttcaccatcctgaactgaattgcctgcacctagccacatcatatattcagagagagagctgagagagcagtacaagagtgtatactacacttagcagctcatcagttattagttcactagttcagccactgaccatcgaatcaattcaggtgagataatcttgagatagatatacggcca

SEQ ID NO: 8467 - DNA, 1501 bp, Oryza sativa
aaatcgcaggctcccagcatgaggaagaaaaatcgcatgctttaagtacattgcctccacacgcatgagcgaatgatgttgggtcttccttggcagctgggctacaccttgcctgggccagcgggttgagaagatgagttacccaacatcaaatatacttaaagcattacttatgatttatatttttttatatttgtataatgcttttaataagaggaatggtaaatatatgtatatgtgcgtcaaatattaagaatcggagtgagtattttgcaaatattgcactactccaaatgtggtggtgcaagtgtaacgactttacgtgcatatgttccttgcaatattcaaacactgcttgcaacaaaattaatcagccgaaacaagattatcatgttttcaagcccattttaattatcacctccgtagggactagagataaactagctcattacttcaaatcataatagtattgtcaagacaattatcacatacttggggatgggcgtgttggtcttgtggcaaatggacatagtactggccacttggaaacgataagaaaactgtcacatcaacgtgatttttgttgcaatgtcgttgtgaacatatacttgtctgtattttgaggtaatgccaagttatatatagttgttcatcgaataatagaagagggatgtatttgatttatatagttgtatgcatttaaatctccaaagaatggcatattaatgttataaaatatgtacgtatatttgcaaacgttaaaatttccacatatttttgattaatcatctgtattatggttaatcgttggacaatgccttttccgtcccatgattgtattctgctattctgtcttccagaacgcacccacgtccaactgagtatatcaaagcagtgtgaagtgtgaactgctcctaattcttacaatagtttataactgcatgacttttcaacacatcttagtgtcatgttgtaatgaattgaccattgataaggatatatttatataaatgccgacatgcgacacttgaacctcgcaaagtcaacgtagtatcttatatgacacctttaggattataattacatcatactccgtgctactccctccgtttaatattataaatagtttgactaaatttatagtagaatttagtaatatctaaaatatcaattagtttcattagatctaaccgtggatatatttattttgtgttgaaaataatataatattttcctataaatttagtcaaacttaaacaagtttgactataaaaaaaatcaaacgacttataatatgaaacgaatggagtagataatagtagtatatcagtacgtagcaaggtttatagtagaaccggtggtaaccggccaattaacgactggtctgccagaataaatcggccaaataaccaaattggaataatttaaatccaaatgattttaatttttttataataataaatttgatagattcatcaatattttcaacataccgatgtgc

SEQ ID NO: 8468 - DNA, 708 bp, Oryza sativa
gtccaatatttgaccgtccatcttatttaaaaaattattaatattttccttattattagatgataaaaatgaatagtatttcatatgtgattttttaatttttatacggagttgctagaaatatggcgcaatatgctatagtcgattttttttccgccacttacacagtagttacacctcatttacaccccacttacatatgtaattagtatgtaattttcaaatttacatatgtaattttagtacttacatatgtaattttgagatttacattgtaaatacactaaaattacatatgtaatttaggaacttacaatgtaaatacatgccgactattttttgatgaaaaatatggcgccataaatatagctacaccctttttataaactttttaaacgggacggacgcttaaacattagatacggaaatacacgattatgggacgaatgcaatgaaacaagaagtttggaatcctaccttgaatgtgggaccggttggagaaagcctttcggtgtgctgcatgtggggcccaacgcacacagctttattaactacagttagttaacctgacctaaccaccattccttgacacctgcccggaccagttctccgggcccacccccaaccggcagtaaattacggaactgccccaaccagtccctataaataaccgccaaaaccatttccgctcagtttgccaaaaccacc

SEQ ID NO: 8469 - DNA, 1501 bp, Oryza sativa
ctcatcaactgctacccgtacttcgcctacaaggacgacccggcgcgcgtgccgctggagtacgtgctgttccagcccaacgccggcgtcgtcgacccgcgcacgaggctcgtctacgacaacatgctgtacgcgcaggtggacgccgtgtacgcggcgatccaggcgatggggcacacggacatcgacgtgaaggtgtcggagaccgggtggccgtcccgcggcgaccccgacgaggccggcgcgacgcccgagaacgccgggacgtacatcgggaacctcctccggaggatcgagatgaagcagggcacgccgctgcggccgcaggcgcccatcgacgtctacgtcttcgcgctcttcaacgagaacctcaagcccggcccggcgtcggagcggaactacggcctcttctaccccgacggcacgccggtctacaacgtcggcctccgcggctacctcccgcccatggcatcacacgaggcagcgacccaggtaagacggattactcccacattaccattcttttttcgattacatggaagacacacgtgtgttgcgacatcatacgcatagatcagcggtaaaatcttgattgtgcaaagtttttttttccttgattacacggtacacgcgcacacacacacaccagtacaaacgcaacttcacacttacatccaccagtgtttcccaatagagatgaaaaccaacgttacattcttgatctcactaaattcatatgaaagcatatttgcgtaagtataatatttataacattggaatttaaatccataatctcaccatcacatgacatgtgcttattccataaagatcatactgaaatgacactcacgtacttttttttgtctaaaaaacttaacctatgtgaggatttgatataacctactataacgaatctggatagcgtgggttgcgttcaatcatcacctagatcaggcagtcagctatgctttcacctgattgctctcaaaacattttacgtgatgtacgttgtactactgagatagtgaggtggcaatgtgacagagataaaaggccgttggcatttggcaggcaaggaatagaattctccaccaattgaagtgtcccatccgcttgcacttactagcaaaatgcatcatcaaactcaatattatactcctaagttctcttgtgaacctgtcctttacatgagccttgacaagtcatctacctttgtgtcttttttgcaggtgatccattggttcctacttatcgccaccgcatcggtcgttttcgccttatcgtgacagtatcagccactgtacttagtgagtcgtgacaactgcagttaacgggggtgccattcagaagctgaaaatggcttcgcagtgatattagattagaggatagatctaacagaaatttggaaagtattaacccaccaggcttgcactgcctttcgtcttacagtgttacagaggaagagtcatacagaagaattgtcattggtcgataatacata

SEQ ID NO: 8470 - DNA, 299 bp, Oryza sativa
gggttagggataccggacaacatacctctccgcggtgtcgacgttctcggactcgacgtcggtgcaggcgaactgcacggcggcgaccgacaccttactccccgcgcccccgccccccgccatctccctccctccccactcgcttcacctgctcgacctcgcgctgtcgcttcggcgcgtgctcccctccaactccaagagggtggaaatggcagaggagcgtaaaaaaaggagtcggcgccgcagggctcacttactcgcacttattctgttattcacatggcattggttgcgtgggt

SEQ ID NO: 8471 - DNA, 1501 bp, Oryza sativa
atttagctcccctcggagcgcggcctcggccttggcgaagcggttcttctgcaggaactccagcaccagatcgatgttctccgccatggttccctccaataccagctaacccagaggccgaaccccaccgaaatgcttacccaaaaccgccagacgagctaaaaggtggcaaaccccagccacggggtcaaccgaatcgaagcttcagcaacctccccccaactcaggaggccctcccaatgccgcgccgcagccagccacagatcggcggcgcgcgcgcgcgcgtatccccgcgaatcgagccccgcagctcctccgaagcaccacaggaagaaccaacccaacccccttagccgagacggcggcggcccggggaggccgagcaggcacgggcccgacaaccctcaccacccgaatcgcggaaaccctagccgcgcgtccccccaaccccacgccggggaacccagggggggtgagggtgggaagggagggaggccgcggaggggatgaggaacgggggcgcgcgtggggcgaggtcagcgggaggtggggcggggcagatcgagagcggggcgcggccgagcggatccggcggcggcggcgagggggcggcggcggaggcggaggcggaggcggggaagcatttggaggcgcggggtgcgggggatcagggcgcggccggcgtggctgggggcagcatattcgcgcagctgtggtgggggcgtcgcgtcgcggcggtggtggtggtgtggtaaaacaaacggaaagggttgagccccaaaagaaaaaaaaagtaaagtaaatggttttttattacaatctgggatttttccttttctttctttttttttttctcacactatcgtttgggctcgtttggtgtttagcgctcgggcgtcgtggggagtgggggatggatcgacagtcagataagctagggtacgttgcaattggttggggcgttcaaaatttttttggacccggtggccgtggctgaattgggtgcgggggagcgacaacggtccatgaacccccatgcggcgcggctggccaggggagtgtgctggtgctggatggattgttgtttatccgctaataaaaacattgttataatcatatagtatggttttagtttttggttcatggataaggttttttttggttttatactgttttttttctttcacaacctcaattggactgatgggtagggcatagttatcgtaacatgtctattcctacagcattctcttatgtatacaagtttttctttcgaatgtattttagctgttagtatactttagtatatacccctccgtccctaaaaaagccaacctaggactttgatgggacatgatttggacaggcagtcagtcctaggttggctttttttttttacggagggagtaagttataggctcatatacatacaataagatagtgcaaatattactttcggctctataacaactaagatgtaaaagctaagcctctaccgcaa

SEQ ID NO: 8472 - DNA, 1501 bp, Oryza sativa
actgaatatggtttgtagtttctttttggtaaaaaatatagttccatgagatttttagataatgggaaatccgggtctttgcatcagcagatattacaacccaccattacaaaatttgcagcacgtctggctgaaagtaacaaacaccaagaggacaagaaaaccatatgaaaacattgacataaggactaattaaaagaatcaggaatcaatcatatttctaaatctccatccatggcgaagatttgcatgatcattgtctcaaaagtccgccatgcaaactggatattgtccttgtcctcacacttttgcaactggtcctaaaactgatcccagtatgtggcccagtatagtaccttcatatgagatttagttggggttttggtccatgagactagtgaaagtgcagcctccgtgagtccaaggtacctttgacggcttatttcaattattattttaaatgaaaccctttaaaaattatattactttggagaattttttttccctaacagatctattgttgctgtttttacagcgccaatctaaatagttttatgtatagtggtgaaagactcgaagttgtattagattaccatttaccatgcccatgtcagagtggcatacatgtgttaacagagggaatattaggctgaaaaagagtaaatctaaacatcaaactagcagaatttccaagcaattatgcagttagatactaataacatgtttgtatcgaaactaatatgcaacagtgtttcttatgaaatagctctaatatatatcctattaatctcccacactataatctagatccaccacaataagtataatggatatgttttagcgttcctccaatcaacgtagtaatttatagaatgtggaagctttccttttatactgtttttagaatgtaaactagatttcctgcatttcatgcctttgaaaatcttaaagactggccatgtaatgccaatgaaaatcagatgaatgacaaatacaaagtagagaatatcttatcacagattagtgaaggaaattcctcagaaaggttttggctttacaggagatgtcatgcttatttgctaacacaagtgcctgcagttgtatttggagaaactttagtcctctaatgctctaagatttgttgaccgttcttcaatagcatctttaacattgtattattttacttcgtcaaccgttcttacttcatccatcgagttctagcagggctaactttttatatttctcaagctcttgaaagacaaaaacatttctcttttctgaactgctcaggcaacaaggaagtctaatcatgtggttttaggcattgatcaaagttgatagtccacatttatccactagattgaggcatctattgatattagtggattgctatacttttttgttttactgattgatgttttcaacttatattatcttgttcagcaggagtggtatacagcagataagactcttgagtgattcaggtaatcaaggcagaaga

SEQ ID NO: 8473 - DNA, 296 bp, Oryza sativa
cagattaccccacgtctccctctcatcccctcccctcctcgcacccatcctcctcacgccggaaatcacgccgcattcaccctcccgcgtctcgctcggctcttccctcctctctctctcgcactcacccggcgacgccgacgccccacccgcgcgcggttgatcccccgtccaccgctgctcgatttctctcctctcccgcgccgcccctccgctgtcgtcgcatccctcacgtgctgcccctccgtcgtcgtcggatcgtcatgccgcctgccgccgccacttgctcgtggaga

SEQ ID NO: 8474 - DNA, 1501 bp, Oryza sativa
taccaaacacgtgagggtacgttctcttgtgctgaatagctaaatgatttacgatagttatgggcgtacatacaaattaactaaatattaaatattgtaaagttgaaagttagatttagaacaaaattatatgtgcattaatgtatagaaagtttttttaaaagaaaatcgtgccgttaagtattctaattccattctattcgggaaaaaagaacacatcatgggacgatgttggtgattggtgaaggcttgagcggcatacacacatgaagctgtgatactttttatgttcaccctttcataatcgtactaacctctataaaaaaacactttatttcacgctattcacttgggcaaaaactatttatttatttatttttaagacagaggtagtatcatttattacaggtgcatatgtagtacttagccaattttaccctggtgcatcgtatatcaacaaaaattgcctcttgaactctactatttttatatgtagttgacgttgatccattgagataatgcggtgatgtatgatcgttaagggagaattcggaaaaaagaacatcagggcaatgccttatatggggaggaaagcatggtgaaaatttgctaaatattgtgaaaagatgaatgagagggtctacacaaccgttattctcaaataccatcctttttatattatgtagttggcattgaagtaatattcatcttatcatcatctatcaactttgagcgctcacatcattttttaattatttctttaaaaaatgtgatatctttctaaaatgataccatattatcaaagtgcgttatattctaaatataagcatgaaaccttcgtttatataagcctacgattaaatgtaacgcatacattgctagctatgttatttatatatttaattcgataaacttagaggctactccttgatctaattagcacgcactactatatctcacctatgcatgatttgagatctaatccttgatctgtccttcctacgaccttcttctttggaataaaatatttctagaaaaaaaatttatctgtccttcgaccttcttctttggaataaaatatttctagaaaaaaaatttatctgtccttctcctatggccttcttatttggaataaaatatttctagagaatttcacaaaggaaattcaatagaagttctgccaaatccatatgggtttcaaaggagagagccttcccgtctcctttttttccttccatccaaaaaattccaaatggagtagtagttcacatttttacaccgtcgtcttcgcaaatttaatactactatacgaaggaggaggaagctctcgcgccgcggtcgctttccttcccctaaattaaatcccgtgcgacgcgtagagacctcctcctccgctttctcctccaaagcccaagctaatccccctcctcttcctcgtcgccggcgagagctcttcgtcttctccaactcgaccggaagcaagcgcgcttccgatccgcca

SEQ ID NO: 8475 - DNA, 1501 bp, Oryza sativa
taatctattttttaagtttagaataattaaaacttaattaatcacatgttattacaaccacgttttgcgtgaaacacttcatcttcatattcagaacattcaaacatcacccatgtgccccgaaggatttctaattcaagtactggggcacgttcatgggtcaccgccgacacgacggacgcggcagcaaaaggtataagacatgtccactttcgtagtttaaatatctctcaaaaccacaataatttttttttaacccttatcttacagtttatatgcaatttaattccgatataaaaacaagggaaacaaagtagacttatttgtagaaaaatgatgaagcccgcttggcttggcattgggtccaatcttaattcaggcaatcttgggtccattaagatgtcctgaggcagctctcgtaaatttgtcacaacactctctgtcattgatggctgatctccatcatctttttccacttccttcagtaaactgggagaaagggctaggatatggacacaattcttaagagcaggttgcatactttttttggaacattttgctagttcccccaaagttcataattctggctatgctacaggccgccataggagtatagatcgatcccctcatggaaggtgaaattcatggtttgcttcaatacttgcagagttggaacatttgatgctagcaagacacaagttttttttaagagagctaagctctcccatttcattaaggaaatgtaaaattaccaagtctgttacatctttccgacaacatttccacataaacaaaagcaccatcataaacaaaagcaccatcagttcccatgggtacgacacaagacaatcatatcaaaacaagcagggatcctaatgggcggagctaccgttgttggatcagggtcctaggacaccgacgaccggagctaaattccacttgataaatagggtgtagttgaatgtgaacccggtaaaattgttgatctgacctcaacccatctggttttcttgtatgagcacagccactgattaaaatctctgtgattagctggctggtttgcaagcccatcattggtatgattgcccacgtgaactacacaaggcccacaagccaacagataaaagggcgattttattacgatttactaaaagtatatgcagcttgtaaggtctgatgtttctttcagcacaacttcaagtaacgaaattagaaaccaatatttgttgttcacagcttatatgaatatcttcttcagtagtactccatatgttttaacttttccgtttctactaaattggcaggaagcaaacttataacggagccatactttcttctcaatattttatatatacattattagatgctactccctccctcctctgtccagattcaatgctagcacatatctcatccaaccaaaatcttttatattttcttgatggagagagtacatgtgagtgttaagatatagggatttatagggtttatgttatctttt

SEQ ID NO: 8476 - DNA, 1501 bp, Oryza sativa
aatatgtttttttaataggaggagcagttaaagagtacattttgtgttgtatatatgctccctatcaagaataaatatacggagtgcgagaacgttagtttgaattaataaccacacaattaattttcttaatgtgtaactctcacactgatatactccctccatgctagtaaaggaagttgtttaggacaatctttaagtcaaaccttgaaaatataaatcataaataactctcaagttgttgaatttgaaaatgtaaaaattatatgaatagatttgtcttgaaaaatatactttcataaaagcatacatatatcacttttcaataaatattttttatataaacaagaagtcaaagttgtgttttagagaccatgtcgttgtccaaaacgacttcctttacaagtacggaaggagtatatattaagtcgattgggccttagcacctataacagagtcaacattcccgtgatagcgagtgcatatcatgggtaacagcaactacctatcagaggttaattaactataatatactatccttcaaaaattaattcgtttcctttcctgcgcgttagattgcttttgtggtcaacaagagagagagagggagctcctctctcaggagctagctagctagcgagtgcgtccgctgtgcttctattggaggtaacatacatcacaagagtgtactatctgcatgtcagcttcaaccgttgttggcctaaccctgttccgtattgcagataaaatcctttgattccaagcaaccgatcatcgcctatgctttaaaaattggagatatatattgacttgttggtatttatatatatcatgctattcatctctgtggttgcagctagatggaattattttacacattgagcttccatttcaattttttcatgttgtgtccacatggatgtattctttttatacattttatgttatgtgaatgtttggaattgagttgtcagcctgtacacataatgcgatgatttctgtacgtagaaatgtttgatctcttcaaataggcgcacatagttttcctacctatgtgatcttattaatttgttatcataaaccgtacctggttttgaatcaagctacgtgtactaatattgtagttttctgcatcatgaaataaactttgatcagctaaaaaagaaaaagaaagtaacatgtaaaacattacttatgtgttattggtggtttaaaaaccaatacggaaaaaatagattatgatgaaataactccaaaatcaactgcaaataaattgagtttaaaaattaaatttgtctatagctaataagacaatcaacagatgataagaggcaaagtgtatgtgcgtggagcttctacgcacgggttcttagaaaagttcaccctacacgaacaaatgctatatccttttgaccattgtacatccacgcatctacgtaatttagaaactactggtatatgtagtattaacaactgatctagaatagaaaagatggtgtgt

SEQ ID NO: 8477 - DNA, 1501 bp, Oryza sativa
atgacgccgcggcagctttgcgccccggaggccgagagcctggccacgcccccactcccctccgcttaccctccgtgtgctgtgcgctgccagcaccgcagcaaccgccgtccgcggatggggattgctagattggaggagatggtcaagtggggagaaagaaatcgctacagactgacacgtgtggcccaccctatttattttgttttgtaactgacatgtgggccaacgtgggccccaccattttaaaattattattatttttagctgacatgtgggcccacggttttattattttttcgagatataattgccacgtaagcgccacgtcaatgccacgtgggacggagaactagtcaaaccagccacgtaggcgccacgtcagccaaaaccactattcaaaccgccttaggatgttatgtgcactggttttgtaagttgagggatgtgttatatccggttttacggttcagggatgaaaatcagattggacgacaaatatagggacctaacgtgaacttgatagcaacacgagcgagcaaagcgggcggccggcgctacgaggccgtcagcgaaagcccaacggtgacgcagcttttcgacggccacaggctacattacagcccattccaccactaaagccccatttatccacggaataagtccactttgactcccttaaaagtgaccctaatctaatccgtgaccctcaaaagtaaaccggataggatgacttcccgtactattcaaaccagtgcaatttgactccctcagtggttttggatggcggttttgctgacgtggcgatgttgacctgatatgtgttgttgatgtggcacttatatggcattaaaataaaaaactatatgggctccattcgtcattcacatgaaaaaaaattgcgatgcccacatgtcatcctttatctatcctccttccccctctctctcccttctctgtatgtttctcttcctccagattcggtgcggaatctggagcggcggcggcggcagggtgagggctggcgcgaaggaaggaacttgagcgggtcgagcggcggcttcggcggcgacggcagagagtcggaggagaggtggtggagcggcgacggcctcagctcgctggagaaggcgggggcgtctggccggtggcctcccccatgatggtgccgcgccaggctgggacgaacgggagggctaatgtagacggcgaaacctgagatgccgccggccctagccgtgcctcccggtctgcgccggcagggggtgccgcctctgtttctttctgctcggagaacatgcatgtgcacagcgttgcctagcagatgcaagtgcagcgccggtgtggggtagcaaggcgcggccgccatggaatccagtcgaattttggcaggaccagcagctgcaggacaaatccgtcctaccagcgtggtccacccgagtcctgcagatcttgaggtcatggactggtctgattttttttctttgtggtcactgtttgc

SEQ ID NO: 8478 - DNA, 1501 bp, Oryza sativa
attacacatacaacacagatacatatgacatgcattcgattgctttctatagcgggcagcgctttcggtaacaagcaaccaagcatgttcatactactgataatatattaatttgttttcactatgaatgatatgtgacatatatccaaacactcgtgaatcaataatgagatccattacctctctaaaatctgaacaggcatgcacgtgtgattgtcattccgaatcaaagtggtttctgtcaaacggattcaccagaccaattggcagacccctttagagcatgtataatagcagactataagacaaccagaaacactaatgtgcgattgatcgctaccgcgatgggtagcgatcaccacccctcccccctccctccctccacgtttccttttttggtaccgcattactttcctattttagtaaatttatacacctaaagtttatacgcctaaagtttatagtcccaaagtttataaatcaaaagtttatatattcaattcaaatttaaatttgaattcaaatattttttatagtatctctatacatctaaagtttatacacctaaagttgtagacccaaagtttataaatcaaaagtttatatatccgacttcaaatttgaatcgggtatataaactttaggtctataaactttaggtgtataaactttagatgtatagaaatactatatatgaaaaaaatttgaatcagatatttgaattcaaattcaaatttgaatcggatatataaacttttgacttataaactttaggtgtataaactttagatgtatagaaatactatatataaaaaatatttgaattcaaattcaaatttgaattggatatataaacttttgacttataaattttggtctctaaactttagatgtgtaaacttgaggtgtataaatttactaaaataggaaagtaatacggtgccaaaaaaagaaaaccaggtggagggagggagggggaggaggggggcctaccgatcgctaccagatcggtagggcgatcgatcgcccattagaactaccctaagacaactataaacacattttgagaggataaaataaaagagagaaaagtagcggactacagatttgttgccagctgtagcacgaactctaatatgcatgtgtgtatgataggtgagtccatatattaattgtatagtatatgtttatatatagctatggtataaattggctataaaattaactataattcatttggagcgggtagttggccatacccttgctattatacaaccctaacttacactccaactaccacggtaggaaccaatcacaatgaggggcttacataccggacccacaaaagatagcgcaaagaaaaatgggatcaatcttgaactgacaaagagggcccacatagcagccagacacgacttgtggactctgccaaacttaaaccccagcaactcggcttcctcagccctgcgctgcgttgcccccctcctcctccgccgccgcc

SEQ ID NO: 8479 - DNA, 1501 bp, Oryza sativa
acaaaaatacatttggatggttcacaggaatcttaaaggaaataacatgtggaagagagagcagagagagagatacttagcaagtgtttgaccaatttcacttacagtggtgcgaggtcgataaacaatgatacaatgtcgaacacaaatgaaactcgaccaatttcttcgacggcagagccatgcgagtccatctgtaaacaacatcgtgagtgtattagcacgcaagaattaaaatgatgacaaattatgtagtatgtacatttggattgagtgctagattcagagcgcaggtaggcaggtagcgacgggatagagttcgtaatttcgtaaatgcacaagagctaggttggtcatccatgaaagaataacaccaacataacaataaaatacacgcgtggaacaacataatattgcattttattattattatttttcattattacatacatgaaggtcacacaagtcaacacccacaaatcacaaatgtgcattctgatacgtgctaaagaaaaacagagaaaaatgctactaatattgatgcgtctactaacgcacgctcaaaaatacgaaggacaacaccactaaaatttaactaaaatctattcagagtgcacaatattcaagaaccccgggatcttgatgtcatgagcgttgcgcgcgacaaagcgagtgttgtgcgcgcttgcgttgctctggttcaggagatgcgctctgctctgcaccgtcacgtcacgagcaccacgccggcatcaccaagacctcctacttcggggttggattctaatagctcgagtgaacgtccacccgtttattgcatgtcaactaaatggctacgaaaaattttcaaaaaaaattggcaagatagatcaatatgtaatatatcactccacaaacatgcaagttaaaattcaacttctacaagttgtaacaaaaataacaaatttaactgtaaatatacatatagtaatttgagttttgtttgttatttatattataatctgtagaagttgaattaacttgcatgtttgtggattgatacattacatattgatctatcttattcatatttttttaatttttttcataaccatttagatgacatgcaataaacgggtaaacatccactcgagctgttaaaatagtttcccctcctacttcgtgcgcccaacgagctcctcccactcccaggactgctgatccaccgcgtcgaggcgaccgacgcgtgggagtacatcgacttcaatcctacccagtggccggcggcgagggcgtcgacacgacggaggccatgtactcgcggaacaaggagggccgtgcacgtcatgacacggcacgcgccgggccggtgcgacgcggcggcgaacgcgtgaaacgtcggcgtcgggcttcgctatgagtggagcaagttctacgcctccatggcgcatcccgcatgctaccaccttgactgcgacgagccggacgttcgacgtacccgccgggacgccttgccggcgcc

SEQ ID NO: 8480 - DNA, 1501 bp, Oryza sativa
cgctgatggccggtgcaaggtgcaaacaggaggtaattaaattgataaccactttgctcctaacgattaacgaagagactaattcagccctgccctgtgcaccaagtcattgagattctacaatcaacctcctgttttaattaataattatctctgatggctgatcaagtttgctgctggatcttcatcagcttaacgccatctgcttgcagctttctctccggccaaagcaaaaacaggcgaaaattcccctcgccctggaacacctccgtgcaacaaacgcgatccctcatctgtcttgtactcatctactaattgaatagcacagacgatagagatgcatttctgaactgtgcatgtttctgatttttttttgacactggatgagtgaaatttattctaccatgttgtgccaatttttaatctaatcttctcgcccacgtgtaatctctcaatgttcactgtcagacagactgattgtgagttttatctgcattgtacttacttaacaagttaaacagcatcgtaattaaccaaataaaaaacactagtattagctagggttctagtagcactactacttatcgaaaagagagacaggcaaacggctagcctgagatgtcagacagcttaaacacaatgctaatgtttttaagctaatgaaacactatactaatgaactctacaagtctatatataccgggtatgtattaaccttgtaacaaattttgttaggtcatttgcccttgcaaacctcacatgaacatgggcatgtcccctgagccatgcaactccatctcagactgttcccagcagcagagccatcatctgactctgacacagcaacaagattcaacgattatttgtactaatcaagaacttgattattactaccgattctacgacgtggacgaagcggcgtttgatggcaacgaggtagagctcgtctccaggttctccaaggtcaccaggatggaccacatgatcagctcgccgtatcagccgacgtggtcgccggcacaggccgccgtcgacgtcgtcgggtcgtcggagacgtcgcgcgtcaggaagaagaggttctgggacgttcttgagagttgcaagcagaaggtcgaggccatggaggctatggacacaccggcgacggcgacgttccgggtcggtgccggtgatggcggcggcggcggcgggggtggcgcaggaggaggaggaggaggagctgacgggatgcgtctcgtgcagctgctggtcgcctgcgccgaggcggtggcgtgccgcgaccgcgcgcaggcggcggcgctgctgcgcgagctgcaggccggcgcgcccgtgcacggcacggcgttccagcgcgtcgcgtcgtgcttcgtgcaggggctcgcggaccggctgccgctggcgcacccgccggcgctggggccagcgagcatggcgttctgcatcccgccgtcgtcgtgcgcggggcgcgacggcgcgcgcggcgaggcgctcgcgctggcct

SEQ ID NO: 8481 - DNA, 1501 bp, Oryza sativa
taaccttctgccactcacttttctcacctacctccactactcattcaatcataatcttctatcactcatttctactctcttaataaccgtgtacaactttaaaacttcttatattcttgaacggagggagtaattggttagagccacctttgctgtcactagagttcatagaggttgatggttgcaaaggataagcatatcggagcatagatcgcaacacatatcatatgaaaagaaatatgtaagattttgctcaccgccatcccttccctcattcttggtggcggagctagtcgacattgtcaagccaaagcgaataatagcgtttctaattggctggcctgtcttttccataagtcaacaaacaaccaacccttctctcatctctctggtggagccaatggcgtcgtctgtcttgagcaactaatggcgtttctaattgtctgatatttcttccacatgtcaataacaaccatcccttccttcatcctcaacgactaatggtgtttctcattggccaaccatttttcctacacgtcaaaaccatctattccctcatcctcagtaatagtgccaccatttttcctacacgtcaaaaaatcatctattccctcatcctacacgtcaacaaaccatctatagtctattccctcatcctcagtagtagtgtcaccatttttcctacacgtcaacaaaccatctattccttcatttttcatacacgtcaacaaaccatctattccctcatcctcattagtagtgccagcgacatcgttgagccccagcgactaagagttagccaaccatgcagcctgatctaggaggtggctccaccattgcccatcttcctccttatccgtttttttcacacaccaccattgctgggttgtggccaatgggcgatcgacgatcgatccccatcccccctatacgctctctctccccccttcctcctcccattcttctcttcctactacaccataaattttaaaaaataaaaaataacaaagttggaaaaaatatgtatagaaatactatatataaaaaatatttgaatttaaattcaaatttgaaacggatatgtaaacttttgacttataaactttagatctataaactaatatttgaattcaaattcaaatttgaatcaggtatgtaaacttttgatttataaactttgggtttataaactttaggtgtataaactttagatgcatagaaatactatatataaaaaatatttgaattcaaattcaaatttgaatcggaatataaacttttgatttataaattttgggtctctaaactttagatgtgtaaacttgaggtgtacaactatagatgcatagtaaagtaatgcggtgaaaaaaaaaagagaaaccgtgcggaggagaggagagggggccaatggccccttagcaatctcgaccattgcttcccattacgttgccaccattgtcgccgccgcctcagcctccctctacgccgaatcttaactggt

SEQ ID NO: 8482 - DNA, 1501 bp, Oryza sativa
cggcaggccagctggccattccagatagacaccgacggtgaaaagaacggcttgactcggttgcgttgcagcctgcgtttttccactttgaaccttcgtgctctcgcccgtcgcgtctgactggttactattactcgtatatacgtaatacctccgtattttaatatatgatgccgttgacttttcgactaaaccattcgttttattcaaaaattttatgtaaatataaaaatatttatgtcatgcttaaaaaatatttgatgacaaattaagtcataataaaataaatgataattacataaattttttaaataagacgaatagtcaaacgttagacaaaaaatcaacggcgtcatacattaaaattaaaatatggaggtatatacgtcatacgtatattgtacctgctggattggtcattggcaacgcgttactacatcttaccacatgattacttataccccgtgccgccgtgcgtacgtgcgtgccgttgaaccgttccggttaatcgatcagctgcttctcacaatcaaaattctccgcggtctagttgtctatagttataatcgccgtgtcgccggctcacacgtactatgcgcacaagtagcacaagtacaacgacacggtctttgcgacgagcgaattggctgcaggatgcagggggtatcctccgccgctcgtggcgttgacggcggctcgctcgcgggtgaggatttgttacctcttcccagaaatcgcctgacccacccgcaccgacaacacatggaacgtgcgtgatcagcaacccctttttttctgggaggaggtagagaacgtgaccagcaatcttgggagtgagaactggatgctgtgtactagtactaatctcggatacttggccttgtgaacaggctagctaattggtctcgattgcgctttggttagactggttaaaacggttgacacttacactaacccgtaaacatacaataatttcagaacattctaacggaattcaccatgagaagagaaacagagggaggcgggggtttgaattgaaaaaacacggtcgcatttgggagcgggcgttcgcgtcggctcggctcggccgcatccacggaatcaaatcaatccaacgagcgagcgagcgaacgaaccaaccccttcttcgcctcggcttcgcttccccgtcttttccttccgcctcaccaacctcgtctcgtctcgtctcgtctcgcctctcgatccttccaccccacgccgccctctgccatcatcgtcgtcatcccatccggattgccacccaaccaatcgccatttgcttctcgctttccctctcctcccccaaccactccatcatcattcgcaatccaatctcgctcttggttggcgtcgattttgacgcggtctggttcgtgaatccgacggagccgggtgatctgcggcgggacttgcagatccgagcgggcggggcggggcgggttcgctcgtcggatgtgtggatcctggtgaggtgaggcga

SEQ ID NO: 8483 - DNA, 1501 bp, Oryza sativa
tataaatttttttaaacaaacaccgtttagcagtttgagaagtatgcgtgtgacaaaaaaaaatagaagttgagagggtacagaatacacccttggaacgaaggaaaaatggaagaaatttagagaattagaattatatgaaaattgatcctttggaacaaaggactggatttccacaaaattctttaaaattcctttggaataatcaattcataaaattttcagaggaaaactaacctaatgctctctctttctagagtcatgaagttactatatttttttctttggttttgccaaaagacatttgttacaaactcatgtggaccatttttagattcaacatccatgtcatcctatctctatattttttctattcctttattttctaaatcatgtgttctaaatgagctcttaagctataagctaatcatattacattgcttaattaagtctatgttaaatggtattggatcaagagaaaaaagtctatcttttttttacgcgcacacttcttgaactactaaacggtacgtcttttcgtttaaaagaatatctatagcaaagttactttaaaaatcatattaatccatttttacaagtttgaaataattaatactcaattaatcatatgttaacagcttcctataaaaaaatcatatggtaacggctcacctcatttcgtgtatcatctcaatcgtctcatttcctctcatctcaaacacatccttaaaaccaagattaaaattcactacgccaatgtttaaagatagggacaaaactctatttttttaataacgaaactctatttgaacaaatccagaagatcttatctttagctctatagctcaacagtgacttttggcttgaaaaaaaaacctgatggacaagctttccatctctttagcattaatcctaatgctgatcctgtagctggtaatccgctatcaaccagcataaacaaagtagaaagtactgtacaaatcaattttctgtatacagctatagaggcgtgcaaaaatctcccttaaatccagccgtccacgcggataccaacggccagatctcgcatatcatcgtcacctccgctcgcttagctctagctctcagccgcccgctgctccagctgctcttccgttttttttcccctctctctcctcttcgccgcccgcggcgcgccttccagaaccttccagaagcttcctcccgccccgatgtctctccggaggcgggagcgccgggtcatcgccgcggccggcgcggcggcgctcgtcgccgtcggcctcaacctcgccttttccgccgtcgccgcccaccgccgcaggaagcggcgaggtacgcgccgcccgaaacccccccggagttttggttacgatgctcccctcatgtcgctctactttttcctcaagctgtgcacgcctctcctgcttctgctcaattgtgtagcaatgtagcatccgctgttgattttttttttttttttggggggggggggggcgtgaag

SEQ ID NO: 8484 - DNA, 1424 bp, Oryza sativa
tagtatccagattttttttttgaaagaacaaaatcaaaaaaaaaagaccaagttgtcagtcaaagtaaaaactgtcctgaaactaactatacaaagaaggggtataatagaagaatattacatggatttgcttagctagctagttgaggcagtattccatttccacctagttggtgctcaattagtggacctagcatgtttgtatataaacttgcaatgctagtcatagatgcttatttaactgttaataaagggttcagctttaatttcttcgcacacactctatatgcatacctaacttaacagttcacaagttgttacataaaagaacagttggcatctccccttctagatatcaaataaaaatgataaggtcacttgccacagaatcacagaagctgccagttgacataataattctccaattgtggatggaacctaacaaacatattaaatgtgtgatactctaccttacaatttgcagctagagtgacagggaaatggtgttacggattacataatattttccaaaatattcttaggcacattccttggtcactgtatcgatttttcagtgttagttttatccatccacctgttcttaaaaagaaattatgatcgtaaaaaatatcttagaaccacatgttataccatagcataaattactctagttcctagaaaaagaattgccttcggtcataaatattagacgttgagaacaagattttatcaaactctttaaacattgatcatcaataatttcttaaaattatttgtttaaaagaaaaaaagttgtatgtcaatttgccttgaagggttatacatttatactacctccattctaaaatatatagtaacctattattggacatgacagggatctagtactaggttgttatatattttatggcagagataatatatcataatttcatagaacctaataaaattttatatacttattttaatacgagactgattgttaaagttttaaaaatttaattaaataattatttaatcacgagccagagatgagggaagataaatagacttcgcctgagaaatccttggcccaacctactggcccaacttggcctgcgaacaaaagtgacggacgcgaaagcaaagcaccggctccgcctccaggctatgccgcgtaagccgggggctatgtattggcggcccatctggctcggaccccgcaccgatcaatccgggctcgtgccaccgcatccatcgccgagcgcgaggagagctgggtttttcccgtgagcgagagcgagtgatggcggcggggaaagggaaggggaaggagggagagtgcgacatggcggcggcggcggcggaggcggagaagaagggagagggctcgacggtgtcgcgcggagcggcgggggagcgggtggtggaggacagcggcggcg

SEQ ID NO: 8485 - DNA, 1501 bp, Oryza sativa
agtgtttgtgcacactcagggtagtgtaagcccaaagcccagtggaccgcgggtgtgaggcccgtatgtgcctgtgtgtggggccggtcagggctaaggggcaccaatgtgtgacgaggaagattgttgggaatatagcttttggggtgtagtaaggctttctcctggttgggccaacgtctcccagttttgggccaacaggagtgtgtagtaaggctttctcctggttgggccaacgtctcccagttttgggccaacaggagttggggccgcacgcggccagcaccatagcggagccgcgtgcgcgcccaccgccggcccgcccctacgccgccgcccatcgcccttccccgctccgtgccatgcgtgccgctgcccgttgaatgacgaagatagaggaagagagaaagaggggatgatatgtgggatcctaccattaaaaaaataaaatgctgactgaactgtcacgcgtacagggtgaaaaatgtccggttttgtggttcaggggggtaattcgatcgaccgtgatagttcagaggagtaattcgtattttttcctttacaaaaaggaatactctagttggtactatctccttttctagagatcaaagatgagtgatgtggcatcagtcgcctaatgatgaagagcagtactcatatcttgcagtttgcaggtcaagtaaaaggaaaaacatggcgtgacatgatcacaattcacaaactctttcggcttgcacactctttatcttggtgcatatggctgcagaggaacaatagaattttcagtggcagctacgaagttagcagatgtagtgcacatgatcacaaacctgtgcaaggcctgagaggaagctttagctacaatgtactagttttcatggcttctctgcgtttcgttgttgttttttctgctttctcgtatcaatgaaatggcagagctcctgcccctacactcgatgaaaaaaaaatatggtgtcacagaatatttgctaaaatatccatattactcctagtaatcaggcatgttccttggttgctccggtgacttcttagaaggaaattaagatggtgaaaattctcctaactatgaaccacttgttaattgttactagcatcagttactgtaatccatcattatgccggagtccgagttgatttaataaatcttaagcggtgatacgatccccaacgatcaaatcaaagagacaaatatatacagtaggagtcttcagagaaaaattcaaaatatgtaaacgtgaggaaatttttaccaaccgacaaaagaggagaaaaatgggagcaatgtactgtatgacaacatggtcctcataaatgggccgaatctattacaattgccacagcctctggcccaacgtggcccgcaaaacgcagccgctctcgtccagctggcgtgccaggtaaggcttgcattgcagtagaaaaaaaaaacgtaacggacacgaaagcgagcacgcctcctgacccgaacccgctcgccggc

SEQ ID NO: 8486 - DNA, 1501 bp, Oryza sativa
cacgcttttcaaactactaaacggtgtgttttttgcaaaagtctatatacgaaagttgcttaaaaaatcatattgatccatttttgaaaaaaaatagctaatacttaataaatcacgcgctaatagatcacttggtttttcgtgctcaggagatgggttcccaaccccctccaacgaatacagccttattttcttcgcacacactctacatctaacttaaaagttcataagttgttttacaaacaagcatagttggtctccctttctaggttgtgtttagttccacgccaaattggaacgatgtgacggaaaagttagaaatttttgtgggtaggaaagttcaatgtgacgaaaaagttataagtttgaagaaaaaagttggaatctaaacatggccctattagagagatcaaagatgagcgttgtggggtcactggttatagactcagtaaattttgctgaatgagatacaatataatagtacttcagtaagttcgccgaacgtgcgatactctatatatgttgcagtttgtaggtcaggcgtgacgtagtatttgctaaaatatccttaattaggcatatttcttggttgttgtaggtgaattttcagtgttagttttacccatccacctgttcttaggaggcaatcaggctgtgttctttatcacctgctcccaatttatatcccttattttctgcacacacgcttcccaatcggttaaatggtacacttttttaaaggaaactatatgaaaattacttaaaaatattcatactattttattttttaagtttgttttagctaatgtttaattaattatgtgttaatgtattgcttcattttgcgtgtggggatgtgaagtttccaaccttcacctcacaacgcaacctaagatggtgaaatttctcataactagcaccaattactgtcgttcatcgatactaaacctgaggagatttaacgtacgaattcttttcccagccgaaaaataaaggaatatgggagcacgtacagtacgatagcatggttctcaacatgggccgagtccaatacaaattctctgcccatggaccacaaccttctggcccaacacagcctgcaaacacagaaggttctcgtgcagctggcgagccagctaggcttggagaggaggaaacgtagcggccgcgaaagcgaaagcgagcacgcctccgtctccgcctcctccgggctataaaaaggcgcccccccatttggctcggaccactcacctatcaatccgtctcgtctcgtctcgtctcgtgccagtgccactgcttcaccgcgagcgaaaggagagttggggttttgcgagcgagagcgagtgatggcgaaggggagcggagaggcggcggcggccgcggcggcggcggaggggaaggggggaggagccggttgcggcggcggtggtggagatggagggagaggacgcggtggtgccggaggcggtggcggcggatgcggagaaggcggaggagaagg

SEQ ID NO: 8487 - DNA, 1501 bp, Oryza sativa
ttacatttatctaataaaaccatgattggtttttcttttgtggaccaatatggaagtagaaattcacataatttctccataagacaagtcttatttgagtcagctacacaagttttatctgcaaccagacattcataagctactcagcattagctgtagattgtcaaaaatgtgatttaactgagaattcctcataataatcacgggttaatatagtcgagaatggttctactcaaaacttgaaacatttaattctgacatgcttatgctttatctgatcatctcatactatttgtagggggtgataacagaagatgttgttgacctaaggaagtctattgaggctcctggaatggcagttcttcagtttggtaatgttccaaagccagattatgtgtatattctcttttgagaaggcattgtgagcatacttgaatatatagattcgatgtctaaatgttcgtactcccacttttatgtggtcagcttttggcggtggttctgacaatccacacttgccccataaccatgaatttgatcaagtagtatacaccggaacacacgacaatgacacggttagtttctaaattattccaaagctgtctattttcaatatcttgtcaagggctgctagcgacacaagcatacaaagaatgctgacgctcttcaaccatgtattcctcaggttattggttggtggcaaactttaccagaggaagagaagcagactgttagtgtctcccaactttcttaaataggcatattacactaccttcaaccatattgtcatattcacgccttcttgtttcaggtgttcaagtatctgcctgaggctaataggactgaaatctcatgggcactgatcactgctgccctctcttcagttgcaaggacatccatggtaaccatgcaggacattcttggcctcgacagttctgctagaatgaatactccagctacacaggttaacagctgcatccaatcaccttgtataattcacatatactgctaaagcagtaattctaaaaacatcatttttttttacatccacagaaagggaactggagatggaggatgccgagctctgtcagcttcgacagcctcagccctgaagcggcgaagctgaaggaattgcttggactgtacaaccggctctaaatatatttcagcgctcgttttctgtcgcttgaacttacagaaatctgtcataaaaataattgagcaatgcaaacattttggctgcaagtattgttctgagactctggtatacctgtcatataataaagcgttgtaccatgtttgtgtcatgctgaatggtgagagtcgctgactgatttcgcgatactccaaaagcagaggtaaatactccctccattctataatataaggcacaaacacttttttttaatgttccataatactctctccgtcccaaaaaaagataaactctggtttccgtgtccaatgtttgaccgtccgtcttatttgaaaaaaatatgaa

SEQ ID NO: 8488 - DNA, 1501 bp, Oryza sativa
aaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaacattacacattagtagttttgtaaagttattgtaaaatttaaaattatgttgtcattttaatatatttgaataatataatgagaaaacatatatgctattatatgagagaaaatataatgatgctagccgcgcaatctgcgcgggccactatacttgttatcttagaaaaacaaccactcctagagtccagagagcacaacttcccatcctaacctccctcctgagtcctgacccatccatttcttcccactcgctcgcccacctcgccgtcgccgcactcccccccaccatggcgtcgcgcgacctcgccgagagcctcctccccgtggggggcggggccgtcaccggcaccgtcaccgtcaccggccacgacgagtacgacgagcgcgcgtacgactccgacgacaaggtctccatcgccgtctcggactccgactcggaggacggcggcggcggcggcggcgacgcca

SEQ ID NO: 8489 - DNA, 1501 bp, Oryza sativa
ttttatataggttcgggccccttatctgacaggtaatagccctacatcttgttggccgaagccggtgttgctctttattcatctggatcacacaaatacaatatatgagataacctatctagctatcatcgacttggcggctagataaccaactcgcagtcgacgacaaggtagtcttcctcctcgaatacggactcgtcgagatcagagatggcactagatccctcttgccggccttcgcaggcaccgaatggggtatgtctaggcttatctctgacgtcgatatatggcggcgtattggtttgttatcacactttattatattttgacgaaaacttaaacattgtttcactacttgtagaaaattgtatcgactcactttataaaatatttcagagaaacgcaacactaaaaaatactgactacaacatcaacaaccaatatatgaaatattgaatccaatgagtgaaacatcgaaaaacatcatatgaaataaaaaatatttttgcaactacttgatgctgcttaaacattttatatcatgcaaccaacattactttcgaagaacacaatgtggtacatttgcaaatcaactaaggaaacaacgtaaaatactaaccgaaacaattaaatgaagcacttgcgatatttaaacaaatccattaaaaacctaacttttttttgtcggaatatataatcatgtgcggttttgttgtaaagatttaactgtaagaaattattggtacaatcgaattgtagatcagataaataatttagaagaaaaaataatttagaaaaaataataaggttattgcatgcatggggttaaaagagagaacaattagataagaaaaaaaatatgtacttataattctaatagcacgtgcaagtaagaagttacgtaacatacaagcatgaaacaaagcagtaagaaggagaccacccgattttatgattgggatcaggttcctgacccaaagcattatctggtgagttttgctttgttatattgtattttttcttgcggatggtcgttcgggtgagattgagaacactagttgttatggactccactcctactacaatattgttgagagaataatggcctatttgacataggtacaggtctcagatatatggtggattcgaagtttgtatattaaattatagtggattaaaattttaaattttatatagaaaatataaaataaatgatttatcgaaatgttatctatgtaatcatagatctatatatatatatatggatttatagacgtaggagttttaagaaatcttggactgaggcttaagaccgcttagcatttccatgttttaagtatggtttggtttgtggacataggaatttaaaggctagacagtcttaagttttcagtattcttcaactgaggcgctagggaagacaaaagagaaacaaagatcggatatggcgtgcgatgtgatgcgcgccagaaagcacgagaaaatggtaatttggccacga

SEQ ID NO: 8490 - DNA, 300 bp, Oryza sativa
atgtatacctaagatttttttttaaaaaataagcatatatactaagtatttggcatatgtattcagaacaacaaaaaagccacaaacagtccaataagcaatcaaactacctttttttgggcatgcttcatcctccctcctccattggcccattggcccaagttactaggcccaaattacccactcctctcatctctctctcactggccactcacccctttctctcccctcccctaaccagctaaccctagcaaagctgcgcgggcggcggccggcgagcggcgagggagtgaggtggca

SEQ ID NO: 8491 - DNA, 1501 bp, Oryza sativa
aggcactaactcaaccgagccgattgaatcatctcgatgttcaacaataaaatcggctatggcctgccccttgactgctttaggtgattcatatctaagatcaaattctgtcaaagcatatatccacttcccaactatccctttcaaaactggagccgataacatatatttgactacatcggctgcacactatagtgcactcgttggataacaaataatgccttaactttgtgcaagaaaaatataaacataaacacaacttctccaccggagaataccttgtttctgcatccaagagcctgtgactaaaatagaaaatagctctctccttgccttccaactcctagagtaaaccgagccgattgacttctcatcggctgataaatacaacctgaaaggcactcctttctgtggaggattaaaactggaggggaacttaaatattccttaatattatccaaagccctctgttgttctgccccccaagtgaattcttgatcggctttcaatctgagtaaaggtgtaaaaggctctaaccttccagacaaattagatataaaccttctaacaaaattaaccttgccaatcaacgactgtagctgtttcttgtcctctggaggtatattagaaacaggctgctggttgtcggtcaccaaattcctatattagggaaacacaccttcaggaagaaacaccgagcccttagcttgatgctcagcaatcgtaccatcaaccacagacttgatcatatttgtcaaagtattgacaagcactcctgattggttgatcaaagcatgatagacagcatagtcaatcttctccctctgatttgtcatctttgggctcatcatctttatctttatcacctttagccttgccatctttagatgtgcctgtctctgaaccatcattgggaacttttagcttatacctctagataactgtgcatgaacgagtttgtttgaatgaatgcaggtactgagtctttaaactgttcatcatctgttcgtattctaacatctgttctggtgtcagcttatccagtgttattgggatgatgttttcgggggcaggatcagacggtggtttagaagtctgcttaccgtccaccatgacgaaaaatcgttacaactcgtgtcccactaggcgtgccaaaagcgtgttgatgcgaaaaaacacacactggcctgggagatctgcttaactccagtgcaggtcctaaatcttgctcttgggttcaaaggcatgccagttgatttgatcctgcaatcaacaagaaagaaagacaaggaaaccgaggttaaatccataaacaatagccgatcggctagaagccgatgacatatcgtcaatcattaagccgatgttattggcattagatcggcaatgaagaataaagtaatataaagctaaatctactccgataccactctatattaagatatcaaaacagacagaatatatcaaacagaaggcccaatatatttttgatgcaataaga

SEQ ID NO: 8492 - DNA, 712 bp, Oryza sativa
caatgtgtatatatgtactagtcaagggttaaggatataataatgcatcaatgtgtatatattgcatttatctttggatttatcttcatgcatgcaaatgttaaggatataataatgcgtcaatgtgtatatatgtactactagtcaagggttaaggtatcatggtcttttcccatgttaggaatacctcttttactcaatttatgggcctaactctatggatcaggcgttccatcctaacatgggaaaaaaccataatactctaacccttgactactacatatatatataccacatccttaacactactttctagtactaatagaatcactagacagtggtacttatctgtttaatttcttccattagttggaaacgacctcctaaactgtagttcaatttaaccagatcatggataagatagagcacttgaatttatttactgcgttaaaatttgcacctaagtttttgtgctatatccacattatagagtattggtattattatgttagccattctcactatacaattatgtggacctcagatgaataaaatatcttgcatatatttatttactaattagcactggtggtcaatttgttaacatgcagtttaaggatatgactgcaagttttgtgtgagatgtacgtaatcatgcttttagtcggttataatgacttgaggcttataatctttgctaaatgggacaagt

SEQ ID NO: 8493 - DNA, 1501 bp, Oryza sativa
ggagaagctactgatcctgacactctgaaatgtttagcaccagatgactcacatgaaattcgcactgaatcaccgatgatggcatcatgtgttggcgccttgtcgatgatcacagctggctctgacatcgctccgccattgctgcagcttccattggaggaagtgaagtagctggagaccttgctaggaaggaaattgcgtccatggctgcaggagatcgctgacaagagtgtcttgctccttgtgtcgaagaggatcatccatgtttctttgatgcggcaatatctcccctcggattctcgctcatccaccatgaagctgatgaggtggggatcgtctatgctcacgatggggtgttctggaatggcgtgtgggaggccggcgtaggcgtgggatgaccagagctcgctggcgtcgaccatggcgtccatggtccaggccatgtcgccgctgccgtcgtctaccctgagtatccaggtcttgatgatgaaggcaccggtagaatggccgcagtaggtcgggccggggcggccgcagcagcagcgggggatgacgtcgatgaacttcagcgcggcgccgccgccggtgacgcagacgcttcgctctgcgatgacgtatttccgcgtgtggtcgtcgtagtcgtcgtcgtcgtcgttggattcatcggtgagggcctcggggggaagtggcacgaaccgcagctgcggattctggtcgaacacgtcgtcgacgtcgcagaggatgatgccgcggtacaggtcggcccagcacatccgccgctcgccgacggggacggccatgtcggtgatccacgacggcagcttctcggctctaccgtcgaagtggacgaccggcgcccgtgtgacggtccactcgccggagcggagaacgaggagctcggcctcctccagctcgtcgccctcctccatcacggcgagatccaccaccaccatgtcgtcttcgccgcggcgcaggaggccggtggtcctttcatccagatcgtggcgcggccgccaggtttcactctcttcttcatccgcgtcggtggtgacgtaggcagggagcagcgacagcgacggcggccgtggcgggtctgggcggcggagccggcgttgtagacgaagtagtcgagcacgccgtcgtcgccgtaccggtatccttctccttggtaactcaaccggacgagccggagtcgccatgggcagccacgacggccaggctggcgccccgccccccgccgatgcgcgggaagaagtcgaagcatacgcgcgacgacgccggtggcgcgtcgaggcagagggagacgaggacgtggtggccgccggaggagaagacggaggccgcctcggtcttggcgtccggtgtggagaagggcgggaaggagtcgtcgcgctcgtagccctggtactcgccgtagcggcagagtatcacccaccgtgggtagccgccggcgccggcgccgccgttgccgccttggtccgccgtccgttgggtttccatg

SEQ ID NO: 8494 - DNA, 1501 bp, Oryza sativa
aacaaatttcgcaattagggtttttaagagataattttcccgctaggcgccacgacggaacgggcgctacaaccacgtggccaccacctcagccacccggccctgcttgactcggtcagccgcctcttccctctcccgctcgtgagctcggcctaccagccggcccatatcctctctcactctctcccgccaggccatgggccatttccttgcagccacccatgaaccgaagtctatgtttcctccctccaccaaatcacttctcttacacaaaagtccatctatcctccccaccgtttgctggccccacgtgtcaatgagtcaaagatattctagagaatgtcttaatccggagattccaataattcgtcccctcgagcccgcatgtcagtggatgtcaataatattcttgagaatattatttctataaattccataaaccatttcccgtattccagaaaattccgacaaatcatctccttgttcagaaaaattcatttaaacttccaaaattcatatcccttgatccgttcgtccgattgcctccgttccacttccaataattccattaaattgtgatatatctaatggcactattaattagcctaaataggatattttatttggtctttttttaggtttttgattgtttgcgcctagttgcggttactggatatttttcttcaagcggaattctcgaagatttgtgaagcttcgtgaagaccctgagcaaggcaagccacctttgaaaatattgagcctatatttgaacttctattgtaaattattatatcatgttcccttgtaaccatctagttgcgcctcgataattcgtgcactctgtgcgagtatcgacggtcgccttccaacttaaaatttgagtaacttcttgggtaaaacttggtttacaaaagctttggaaaacccgatgcctgagtcggtgccttgtgaaagaaaatgagttttaaaaatgaaactcgcgacacaaggccattcctgggtggaatacttgtgcggtcgcatttaaggaccgattccttcggaattacatccgaccatacaacattgcgaccacatgggtgtaatgggacgcccctggctgagttattagctaatcaggggaaccatgatgccaagagacatgtggattcaacggggtggtgtcggggagaaccctcgggcttcctggcacagtattgtagcgcccgttccgtcgtggcgcctagcgggaaaattatctcttaaaaaccctaattgcaaaatttgtttctttgcttgatgtctagtgtccgtgccatctcaagatctcaaatccccgatctatcgtcgagatcaattccgaatccaaatccttccaaatcaaattcctccgcaaaagtctattttgcctcccccgggttcgatgggccgaatctctctcggcccatctcctcctccctccccggcgctctctctctctctccccctccctcttccgctctgcccgcgcgccgcgcgctca

SEQ ID NO: 8495 - DNA, 1125 bp, Oryza sativa
tccaagggacggaggcagagcccctcctccctctggctcgtcgcccccgctcccctcctccttttcccaaagaggcaaggggcgagccccctttctctccctccttttcccctttttcctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctcccttctcctctcgttgtcccatcgcctccactccattgttgctgcccctctgtttcgccgtcaccgttcgtcgttgcgcgtgtcagaggagccggcacgagcgaggacgcggaaggggactccgggcgcgccctctccttcctcttccccggcccgaggccagagagattactcccgcgccgttggcttctcgtcactgcgcccgcccgcacggtagtgcctccctccgttcttcctcctcgttccatctcctccccttagactcgagtagtagcacgagtagcctccccgtagctagccggcgccgccccgaccgttgccgtcgctcgccgtgtactcgccgccgtcgccgcccgagctcggaagcgcctctcgtcgccggcctccctcgatgcgtttcctcctaatccggaacaagggacggattcccgtagccgcgtagatgctctcgccaccgggaatcggcccctcgtgacctcgtcgccttttccctcttccctccccgccggttgccgccgccgcaatccgccgtcgacgcactccctccggcgaatccgagccgttggctcgtctcccctcgtcctgagcaaccacccggtgtgctcgctttcgcctgtatcgccgtggttcgctccgccgctcgccgctgtcgtccgccgtccgttccggccggcgtagtcgtcaacctcccgccggcccgcgtggcagccacgtaggcgccacgtaggcgccacgtcggcgccagctcggccaagaccgggtcgagccgaccccggtcagcccctccccgtgcgcgcgttccaccgcgagccgtgaggctgcgcgtaggcccgccgcatccgtgtccaccgcgaaccgcgcgcg

SEQ ID NO: 8496 - DNA, 1501 bp, Oryza sativa
cgcatgcatggatgatgaggtttgacgaatccattggtcagagtcaacaaaagcatatgcatgtgcgtgcgtgggactttgatagcatgcagcacaaaaagaaataaaagcaaaggaaaggttcatgtagcaatggaaagatcaattgggatagcattcgatttcgaccaggcttcatcagattctccctgcctttagatttgatcttggagagacactctcaaagatgatcaaagggccgtacattggattgtgtgaaaagatgagatttatccgtgcatggcaactcgagtagtacaactacactctctgcagtgtagtagcctctgcatcaactagaacaattgtgtcattcagtatgcaaaattcctatctatatgcaccataacaaattatgatcctccaaccggtttttaatgtttaagtgtatggttaacttttaaacgtgggttttgactgttcgtcttattaaaaaattacgtagttattacttatttttgttgtgatttgttttgctattaaaaatactttaagcatgattggaacgtatgactaaaagtcaagaacaatctacatatattaaaaatcggaggcagtacaaatagacatcacatttttgcctgactacttgtataccgacaacattcaaagctctcatccatggcatattcttcacataatttgttactagttccttttggaatatgaagtcttttagaacctcgtggaaacgtgcccatactcttcaaagaggttctctatacatgtattttgtcttgcatataagatttctaacatcaagttcgatgaatatccaacatattggacatgcttatgtttgtagtgtaacccaccctcgtccttcacatctctctttccctagaactagctaccagtcataactataacaatctagtcttgtatgaccaattccctatgacgaatagggaaaatgtcatcgatctatgacggattcttaaaaaataataagtataccctcgcactacacatcttccgctaagttgatagggtatgttgctagctattattgctatcctccctatgttacttgacctctttcttcactgctagtctcctttgctaggctagtgccaatctacttgctattgtcctcttcctcgtaatccaatggttcttatgtatgtcctgactatctgcacttttaatctcacttgtcttcaacctaacaactctagtagcacgtgccatcactgatctcccacctggggtgcgccccaaccaggtggagaacgaccctttgcaccccttggtcgtcctcccgcccctataaataggtaggtaccccttcagggtttcttgagttttgtttagattaaagtttagctttgctactttgccgtgtaatcccgtgatcggttagatcgccggttaactcgttacggaaccccaacttatcatttgtattcaattcctatctgcaattcagattgcttttatcttgttcttgcttgtttctttg

SEQ ID NO: 8497 - DNA, 1501 bp, Oryza sativa
tttactccattcaaactgttttgttttttttcattccctaagataaaaaacgtgatgatattctaatgctgcgtgtttaagaatcctgcgtttgaaaagagcccttagtttttttagtactttcattttttttcgattactcgtagttagattcttttatataggattacactatattgagtttggtgctaaaattttttattgttattattctttcaaatatgtcacgagatactaccgataaacaagtattgcatacgccggctgtcatgatgtcatctacaatgcactctctcatgctatgtttgagctgtagataaagagaggagatttccctcgcttttcatgcgcatgccttttaaactattaaatatttttcttaaataatttttatagaaaaaatgttttaaaaaatcatattaatatatttttaaattttaaaataattaactgaattaactatacgttaatgactcacttcattacacgtatcttctcaatcttctcccttcctccaccatgaaaaacatttaacgtgggtcagtacctaccgaagagactatcacaaaacttagaaataaacttgcaaaaaattaacctttcttttgattccaaaaaaaaatttgaggaaatcttcatgttagactagagaagtattagttttggataagccaaatatccgaaaagatagaaagtggagacgacaaagctttgaacagtgtgggtggcacgtccgaagttcgccgggaagaagaaagaaaatccgaaggcgccaggaaatgggggagaattaatgctgtctataaatagtaagctcaccggagccagaaatgcggatagtctcctccctccaccaccaccacctccttccacgatccctccccctcttgatcccatccgccgccggaggagatcttgccgttcttgcgcttggatctagaccgcaagatcggtgaacggcgacgctctcattggttggtttattagttggctggtttctctctcctcgtcgattcttctccggcgaacacgccgccgccgccgcttcggattcaaggtattcttctctcctcgccggccgccgccgctgattttgctacggtcttcgattgattgcttgctgtccggtgtcaaatccgaatatattctttcttgatttcttctcaggatcttgcattgcctgtctttccaatttcacattggatttactcgaactgattcgtgctgaaacaaatttgaccaagaaaagaagaggaggtcatcagcaggatgaagagggtgtcgtcccacgtctccatcgcctcggaggcggagatcaacctcgatctctcgcggctcctcatcgacaagccgaggctgacgctggagaggaagaggtccttcgacgagcagtcgtggagtgagctctcccaccgccagaacgacggcttcgacagcatcatgcactccccggcgttcccctcgggcttcgactcgcccttctcgctggggacgctcggtg

SEQ ID NO: 8498 - DNA, 1501 bp, Oryza sativa
taaccctaattaaaaattcaaataaattatataaataaaatatgagtaatattaatctagaataaatccattggttggaatgacacaaatattgggtaaacttctttatacaaaatctaggatttataaaatcaaatttacacaaaaaataggctaaaatggggattaaataggaaaagacactattcatcggccgccaggtgttcgacgtggtcccctaacccagcccctcctctttccccctctctctgtcgcctgccaccgcgccgacgtcgccatcgccgtccctgccccgcgctgccgtcgccgtcactgcctcgcgccgcgcgccgccgctgtcacgccgtcctgcgcccgcgcgtcgcgtccgtcgtgtcgccgtcatctcgagccccgcgccgccctgtcgccatcgccgcgcgccgagccccgtgccgtgccgcgccgtcccgtcgccgcgtcgccgtcccgtcgccgtgtcgccgtcccgtcgacgctccgccgtcgtcgtcgtgtcgcccgtcgccctcaccgcgcgccgagccccgcgccgtcccgagccccgcgccgccgcgccgccgtcgcgtcaccccctcccttctcttccctcttccccttattccctctctcccctataagagccaccgttctcccctctcctcactccatcttccccctcctctccctcttccccctctccacgcgccgccgcgccaccgccctcgtgctgtcgtgccgccgcattcgtgaccgccgcgctgccgcctcagtgtgccgcgccgtgcgccgtcgtcgccgccgtcggtgagccgctgcccccctatttgtcgtcgtgccgccgggtagagagggagccaagaaagagagaggaagggagaagccgagggagagaaagaagagggaaggaggagagaaaccggaaaggagagagagaaaggagaagaaaagaaaagagggagaaaggagaagaaaagaaaagagagagaaaggaaaagaaaagaaaagggagagaaaaaggagaggagagattagagtgggccccacgtgtttagtgaatagtaatccccttcttaatctttattagttgagtctattacatgtgggtccgggtggttaaaaatcaaattatagaagttttatggtctcgagttcatgacatgtgggccccacttgttattagctcttcctatttccctttagaaaataattcggtaggaaaaaggaataaacccggggtcccacttgtcaatggatatgtcttggattaaaaataaatcgtttatgaacagtagcttttcgcaatttctcggattaattcaaagttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagt

SEQ ID NO: 8499 - DNA, 1501 bp, Oryza sativa
tcaaatttgtttcagcacgaatcagttcgagtaaatccaatgtgaaattggaaagacaggcaatgcaagatcctgagaagaaatcaagaaagaatatattcggatttgacaccggacagcaagcaatcaatcgaagaccgtagcaaaatcagcggcggcggccggcgaggagagaagaataccttgaatccgaagcggcggcggcggcgtgttcgccggagaagaatcgacgaggagagagaaaccagccaactaataaaccaaccaatgagagcgtcgccgttcaccgatcttgcggtctagatccaagcgcaagaacggcaagatctcctccggcggcggatgggatcaagagggggagggatcgtggaaggaggtggtggtggtggagggaggagactatccgcatttctggctccggtgagcttactatttatagacagcattaattctcccccatttcctggcgccttcggattttctttcttcttcccggcgaacttcggacgtgccacccacactgttcaaagctttgtcgtctccactttctatcttttcggatatttggcttatccaaaactaatacttctctagtctaacatgaagatttcctcaaatttttttttggaatcaaaagaaaggttaattttttgcaagtttatttctaagttttgtgatagtctcttcggtaggtactgacccacgttaaatgtttttcatggtggaggaagggagaagattgagaagatacgtgtaatgaagtgagtcattaacgtatagttaattcagttaattattttaaaatttaaaaatatattaatatgattttttaaaacattttttctataaaaattatttaagaaaaatatttaatagtttaaaaggcatgcgcatgaaaagcgagggaaatctcctctctttatctacagctcaaacatagcatgagagagtgcattgtagatgacatcatgacagccggcgtatgcaatacttgtttatcggtagtatctcgtgacatatttgaaagaataataacaataaaaaattttagcaccaaactcaatatagtgtaatcctatataaaagaatctaactacgagtaatcgaaaaaaaatgaaagtactaaaaaaactaagggctcttttcaaacgcaggattcttaaacacgcagcattagaatatcatcacgttttttatcttagggaatgaaaaaaaacaaaacagtttgaatggagtaaaggaaaaactgagaggagtatacacaaagaaaaaaatattaagaggttgcagctccaaaattcgcatgaaataggaaaagcatcagtggtgtggtgttggagtcgtgggtgcatgactccagtcaaatcctagcttccacaaatattacacgtatgtaaatgagctttcaacatggttttaatgaaatcttgagcgtgtttcataaaaaaaaatcccataaaacatgcccatagaaatttcaaaagaatcccggagatccaat

SEQ ID NO: 8500 - DNA, 1501 bp, Oryza sativa
cagccaatgctacagcaggttcatcgatttcctgctctactggttccgtgtatcaatgccaagaaatgtatgtatacttcacacagttactaataattactattatcaatccctcttcatgatgcgaatgctttatgataatattaatcaattcctcttctttaaatagtcatatgtgataggtcccctgtattctgaagccacaccatttctgaaacttaacatgtcttacagaaattgttctagaactttcctgtgttccaaaccaactttgttgaatggtgttctaattatttggatggtcaattttgcaacatatctctaaactatacatggaattaatacttggtttgttcgactgcttagttttgctgcacatatattctatagttgctttcatgatctaatcctggactcctattctaaccactggacccttgttgctttctaatatcctgagtagaacaacatataaatgtttcatttaacaatagtaagctcatgaacctgtaaaaatctttgatcgccgctacactgcttcatttattcatagatcataccagtcttctaatattgatggtgatgttctgttccagctccttccacctgatgctgctaacagggagagctgctggtatggtttcatgtgccgaacccagcaccaccggcctgaccatgctaagaagctcaaccatgtctgtcgtccaacaagaggcaacccctagcctgcctcgttctctgaaaaaaatcatctattttcagtgttcaacagcagcattgtacagcaaagagcaagtgccataggctctggtttctcagtgtttaacagctctgtttgattagtaggaatgattgtcaggtacatcaaccagtttcaaatgcctaaactgatacaacctgtttatcttaatctctcctattgcaaccttccatacttatgtttttgcaatgcaacctcacatgctttcaagttgctatttttcgcccatctgcgagtgtttgaacagagggagcagaagagttcttctgaaagagaaaaatgcaactaggcaaggcctggctggcttgaaagcttgatagatacaagaaccagcacatatatatatcctgttaattaattaatcttgaccagtgcctgaaaacgaaagcgcattgcacttgcactgcatggacacaagctgttgctgtgacggcagctctgtcggcaggtcaggggatatgcatataggagcattcatatctgcaaggcactccctccgtatcaaaatataaacactttaaattatttaacaaatactaaaattaagaaaaaaacaattccttccagtaacattagtggttaatttttttaaattttaattgcttagattcctctctcaaacatctgattggctggaaatatatggatttctgtgtattgttccgtgcctagaaatacttatattatggtacaaattctaaacaaatgcttatattcttgggacggagggtgtgtataatt

SEQ ID NO: 8501 - DNA, 1501 bp, Oryza sativa
tttggactaaatcgtggaaatcaagaacgaaaaagagaggcacgtgctgacggtggccgaccggccttcctgaagggggctcgcagtgcatcaagccaaccaaccggctgttggctgatggcaaaatgcgggaaattcagaattcacttacttcctccatttttaaatatagcacatttagtacgagtgagttagtttagaaaatgaactaactatcctgattagatatttaaaatataaaaatggagataatacaatttaacattaagttattattcacgtgtcacgggtatgtcgacatgaacaatacggagatcggcagtggcataaccccatttaaatcctataaaaatactacacaatttctgaaaattgttaagttgggtatttttcatctttgtccctcatggcgatctcgcgcattgctgtaggaatttatagatctatatatgaagaaaaaacttagtacttaaaatatgatagggatcatggtgtacaacttttgaatcactatgttaaattttaagttgcaattctctgtcttctagttagctttatttcagctagatcacgaagaggaacgatgctaagaaggaacttagcatcaattatcaattattaagagagaagaaatggtgagaaaacccagcgttgaggggccaacgagagcacctggtagctccctaccaccgggctacaacgccgttctcagcagggggccaccaccatccttccatattcggccaaaacactaccttataagtgtgtttagttcacgtcaaaattgaaagtttggttgaaattgaaacgatgtgatggaaaagttggaagtttatgtgtgtaggaaagttttaatgtgatggaaaagttggaagtttgaagaaaaagtttgtaactaaagtctaggtcacggacaaacaggagaagaagaagaacatgctgcttgttgtgactgcaccgacgtctttcgtggaaggacgtgatcctgcggtccggcacgccgtggaataacgcatggcgatcaaagaccaaggacgattggaaggtaagctggctcggcccttcttaagaggctcaaggtgagccagaggccatgatcacatcataccttcttcctaaccttgcaaaattagggaacaattaattcagctactagtagctgaatttggagctagctaattaacaggatgttcagagctgcgcagctcctcctaggtacatatcaggcttaattgtactgtgttagtgagagtgagactccaaattactagttgattaggatgacttgataagtgcatgtccatttgtgtggctggcagggagacaacagagctcttggggcagcaacttcgcctgcaggcttcgtcagtggcttctccacggcttccaactctgcgcagaggttcgctctttggtcaagttcgttgtactaaaacgtatcacatcataaacttttaaacttttaaagaattatatgtaaggatagtgattgagacaatta

SEQ ID NO: 8502 - DNA, 1409 bp, Oryza sativa
agcgagaagcgtggagctgcaccttctccctaacggcaactggcagccgcccatctctctgctgcccgtcgcgacgccctcctcggcggcggtcaccaccgccgcgcagcttctcttccgccgcgcgccgccgctcagctcctcccttgccgcccgtcgccctctctcgctctcccgccgcccgccgccgctcaactcctcccttgccgcgccgcccgtcgccctttcccgcgctgccgacgctctcctcctctcccaccgcccccatcgtagccagcacctcccttgccgcgccaatggcaccaccctcctccacgccgctgttgccttgtgttcccgcgcgccgccgatgcccagtcaccgcgccggctccccaccgacaaaaaggttgagaggtggaagaagaggggagtgagggtgacatgcggccgccgccgctctgcccgcgaacctgctccgctccgccggcccgctcccgccggccgccccgctccgccccgtccatcgccccgctccaccggtcagtgaggaaagagaggggagattgggagagaggaggaagaaaaggggtgaggatgacatgtggggcccacgtgggccccaccattttttttattaatttctatgtgaaactgacatgtgggtcccacgagctttattatttttccggatcgaattgccacgtaagcgccacgtcaatgccacgtcagatcaagaccaagtcaaactagccacgtaggtgccacgtcagccaaaactgccttcaaaaccgccgagggacctaatctgcaccggtttggatagttgagggacccgttgtatctggttttgcggtcgaatgacgaaaataggattcgttgacaagttaagggaccttagatgaacttattccattatcaaagcttcctattcaatttgggccgaactcccattcatttggcccattccttccttccttctactccctccttcttgagctgccagcccaactgagccgaagcccagccgagccggcccaagccaggccgcctcctctccccttccgtgggagcgccgccgcctcgccaagttccgatgccaccgccatatcgcgccgcccgctgccgccacgccactgccgtagccatcccgccaccgccgcagcaaaccaggggccctcgtggcaccccgacagccaccgctgcggccgccactgctcagccgctgtcgcccgccgcttttgccgccgccgcccaccattttcgccaccgccgcacgacgccgcgccacgcgttgccatgagccgccaccgaccaccaaaccactgacgacgcccaatccggcgaggacacacgtcgccgcccctcatcattccgagccgacgccgagctgtgccgtcgtcgacttctctccatccaccgacctcccca

SEQ ID NO: 8503 - DNA, 1501 bp, Oryza sativa
ttccaaatggagtactccctccgacttcatattagttgtcggtgaagcaatgcattgtgtggatgataattcctacgtttgagcatttctgtggaggtttatgacgaatttcaccctgttaattaaactaattaatgagttaatgatattgttgtttgcaatatcaatattgcttccactaccatggtgcataatatgactaggatggtgtctttaaaattaaataagcagccacctaaaatgaaaaataatgtggtaagtgaataaatgaggaaaaagaagaaaatcatgtcttgcatgagacttgatttctgtacaatatccaagacatcatgtaagataagtagcattaaatttaagtatggaatagtgataatgtggagtttatggaaactatttatagtgtcttgtgatgaaatggcctaactaatcagctccattgcaagggcagcatggtgtggtcttctatttaatttaatatgggtaatgtaggaatagttaccctaattaattataacttgatatgtgagattatgataaaaatatcaataaatatgtaaagttctagattcctatgaccatctgcatgacgaccagctggcagctgattaactaacggcagtacgatctatcaacctgaaaccaattaatttttaacgagtttgttaacttatttttcttccttcttagtacgtagtaggagtatatataatatatacaaatagccggtcaattttgatctttcaaattgagaatacgtcctctcgacctatactggtcggcgttcaaacaaaaatccatatgcatatgcatatgcatatgcacacgtaacgcggctatatctagccttcttatattaaggaggttcgtagtatccatctttgtcgatcgagctagagccaacaacgatcagctccattctgcttctgctttatttctaccttgctaattttattaggatagtaattaagcttgcttaattattcgttctaccaggatgttcagatcaacagcgcaacgcctcctcaggtatgagtttgaatgttaattaattagatcaagatatattgaggaagctaatttgatttaaacatgcattttacacaaatctttgtttgctgtcttcgaaattgtaaaatgcatgttttgaaaccaaattgacaatacatatagttttttcatatatttcttcacaaacatagatttgtgttctcgcctatataattatatttgcattgccatttctatttcttagtgtgtatatacatagataacatgataacttgttgtctgtttttgtaatgttaacatgcaagagaaaaaaagtgtatttacgatatgtataatacattaatactttaggtttaaggccagggtataaggctgctagtaccgcgtattcgtatacgtacatgtgatctgaccgcgtattcgtatacgtacagggagacgaagagagtggttggcccaaggatgacgacgatgacgtcgacttcgcctg

SEQ ID NO: 8504 - DNA, 1501 bp, Oryza sativa
  unsure (1)..(1501): unsure at all n locations
gtcgatgctacagtcaagcatcacaacgactagtgagttgggagatttatgtggagcggaacaatgttactctacagtcgtgagtgacagtagagcggctagggtcgcacatagctcaaggactagtgtgcggcgtattgtggaggtcgagggagtagtgaggctccgaccactgtacgcgttgaggcgtggggtgcgaagagcaacacttcgacctgaggaataggtcatgtcgggtttcacaaccttcagttcgacgtcggggtcgtcagaccatacgagcgtccccatagaaggcataaagttccacggcggctatttagtggctaaaggatggtatatgaatggtttagaaatcaaaggaaattgaattcaaaaaggggttttaaatagattaaagaaataaaatttaaaatggtattttagaataaagaaaagggcatttaaagaaattaaagctgaaatttttacattttggtcctttttgaaaacttattttacaaatggacccctagaaaaacttaaaccagaaatgatcttttttggggcgccagagtggctggcgccgtcccccaacatggcggcgccagtcacactggcgccatgctcgtgccaccgtggcactagggcctacgtggccgtgctgacggaacgaagggggggcgctagccacactggcgccgctccacacagaggggngccagcatggctggcgcaccccttcagtgtgggctgccccctttaacctgcgtgggccccaccatcttcttctccccaccctcattcgcacccatctccagcccgagcagagcagcagcagctctccccctctctctccccctcacctctccacctcaaatccactccatttgaactcgtttttcgcgggattttttgtgaaaatcgaagagaaaggtagactcctccattcccccctcttttttttcgtttttattggttgaatttgtagatcggagggtaaccctagaaccccttttttgcccaaatttgtgattttatcatttgttcttgggattagcttgttgtagtgctacatgtttgcaatgtactcattggtgtcacgaatttttgaaccatatatgtggtatgttaatttttggatggtttggttggatggatgcatgaaaaattagggttgaggcatgaaagtaaatttaatttgatggacttgatgctatagcctataggttaaacttttaaccattaactataagaaggggagacaagtttggttgcattatagaaattgattatagttattagaactaggttgggttgtatgacggagtatttgtaatatttcgatgtgtaatgcactagtaaacttgttgatatttgtacgtggattaaatattttttgtggagtactagctttgggacaatttaagttatgcattggttataatatgtctgtttggactacgtttaggaaggaagatttaatttttattgcaaagttatatttgattttttgtgtaga

SEQ ID NO: 8505 - DNA, 1501 bp, Oryza sativa
tatgtagaattacttatccttggtctgtatgacaagatgaaatataactatcaaaagtaaaaataaatggagggagtactacggattatattatacacttagttacaaagacaaattaaatattttcattaataaactaaacatataacttgaaataaatggtaataacaatccagttgaagaacaatttcttaagaaaatgtgtttttcgaatcgaaaaacgagtaatctgtctgttttaatagtatgacaaataatctgaaaagaaataaccttaatttttagtttttgaccgaaattgagccgtatttggtcgtacaatatgtactacgttggcatgacttttttcaggtgattcaagactcggtcggaaattagcagtccttaataccggtcaaacgaggtgtttctagaaaatggtggactcgtagtgctctgcacttggcaataattttaggcatgaaactggttaaattaatttccgcgtgaatgttgccgattcgattagttaattactggatgataatatatggagtaatcatatgtaagttaaggaaaaaaatatgactttattaacagcagtaaaatgttacagtgaaattggaatgtgttaaacgaacgtattcacatctcgttttatgtcttctttgtatttgcatgaagaaaaacaaattataatcttatcgatgatttgttggcttatctgccgcatccgaactttaaaattttccattctagaggttattatagatgttctattatagtttatttacaacattagctttttaaatcacttttgcctcgtagtttcacttagttgtttataagagaaaatataatttattggtaaaatttttacacgtgtttttcttatcggtcatagccagtggcgttcgtgcatagtactccctacattccataatataaggcacaaccacttttcttaaatgttctatagtataaggcatgcatgtaagcatgcaattaactatgacatcttctttattaaattataacttttttaaatcatccactctcatattatctaattctattggatgcatgcattatatttatgaggatgatacacactacaagacgataataattatttcttggtctttggattaagggtgattgtgccttatattttagaatggagggagtagttacgagggtcgcataactccgagtaaattattcgatactagttaatttatattatattataaataaggtaattaagtatgtattggatctcaataatttttattctgagtctatcactcgtcataactcaaccaaccaaagcataatttatcagctctaaaagagtagcagcattggagcagcaggcagaaatatgaacaaatttcaaattgatctcaaattctatgtaaaaatagtgtactcatttctactagttgtgcatgcgaggtgttcagctataaatatcaactgcttccattgcgacccgtctgctctcctccaccgccgacga

SEQ ID NO: 8506 - DNA, 1501 bp, Oryza sativa
aataacactatcttcgtaacagagagtttagtttcacgggcggagaataataataatactctgtcaactgtaaagaatttatataggagtactctggaggtaaaaggggcaaaaaaaaaagaaaaataatcatgcttgtccgagcaacaactatggtacactatttcggaatgcataaatataccatgggtgactgaaattctaaaattttcaattgaagagcttcaaagatttcaacgaattccgctaagtttgcaaaatcaaatagaatttgaaagtttcggctggtaaaatatcctaccgggaccctccaataaaccctgaaattttgcgagttttgggaatttagttcctgtcaacagctgccagtgccacacccttcccttacctctgaaacataggaaattttgcaggatttccatgagaatttttagtggccaccacatataaagcgaagcaaaagtcacatggagcctgattttttcccccataatccgtcaaaattccaagcactttgtacttttttgctgctggaattccagggcacagcacatcgatctggcccttgggcgattgacaattttgcgccacatagcagcagcagataaggttttggaacggctgctacacgtacgaaccaaaaggatgaccaagaaggagaatttgaagatttttttatagtattaattatgattgttgatcgaattcgtcaatggcaaaatcggcctggctctggctggctggctgctaattcattccagaaggtagccaggaatttggaggtaggactagcatttacatgaattttcttgaactgaagaacaatcatatcttgaggtcaatattgaagcacaagttaattaggacttcaatttaccaacttatgtgcgttctagctctatttaccaactccttgcctgtaaaggtttggagattatttggaataattaataggagtattgcttgtgttgatgtgtgtaattaacagatacttgtaatattaattctggtgtttggaacatgcgcttattgctaatgtgctacttacattcttttttttttcttactacccagtgctaaaagagtattacacgttaggtgtgtaccagtgcttcccaattactaatatacaggggaagagaagaagaaatgaagagtatatatgcttctcacttgcaaccatggaatggaattaagacacaaattcttcatgccggaaaattccacaatgcacggctctcacacccctatatatatggtcccaaagtttggtgcatactcccatctgcaacagagaaagattgtgccacagtacaaactacctcattctccatcaggtgcacaatagaagaaactaaggtaagcactacattggcacccattcacccaagatccctatttctctcttccaaatcttcctctagcatgaagataagattgtacttatgataacgaattatctttttatttatacacatgaatatttagattctcaaagtga

SEQ ID NO: 8507 - DNA, 1501 bp, Oryza sativa
ccgccttcaagcgcgactgcaaggccggcaagctcccaaactacgtcgtcatcgagcagcgctacttcgacctcaagctcctcccgggcaacgacgaccacccttcccacgacgtcgcccatggccagcgcctcgtcaaggacgtctacgaggcgctccgctcgagcccccagtggcacgagatcctcttcgtcatcacctacgacgagcacggcggcttcttcgaccacgtccccaccccggtcgccggcgtcccttcccccgacggcatcgtcagcgccgcccccgtgtcgttcgccttcgaccgcctcggcgtccgcgtcccgacgctgctcgtctcgccgtggatcgagccgggcaccgtggtgcacgacccggcgtcgtgcggcggcgcgccggagccgacgtcgcagttcgagcactcgtcgatcccggcgacggtgaagaggatatttgggttgaaggagttcctgacgaggcgcgacgcgtgggcgggcacgttcgacacggtgctgacgcgggcggcgccgagggaggactgccccgccacgctgccggagccgccgcggctgcgggcggcggaggcggaggagcaccgggaggtgtcggagttccaggccgagctggtgcagctcggcgccgcgctgaacggcgaccacgacggggaagggtacgaccccgaggtgttcgtccgcgggatgaccgtcgccggcgccgcccagtactgccgcgacgcgttcgaccggttccgggaggagtgccaccggtgccgcgacggcggcatggacgggtcccacgtcccgatgctgcagccggcttcggcttctgcttcgtcttccgctccggcggctgacccgccggccacggcgccggcaccggcgacgccgtcggctctgtccaagctgtgcggttgcttcccatgcttcaatgcgtcgtaggatcgagagcatccatgaattgcaaatgcaactttgtaagtgtttgtttcatacttttcattactccagaagatgattgattaatgattgctgttgattcattaaggaaagattgggtttaattaaacttgtaattatgatcatgttgatgttgtttgtaattgttactatttgtttgagcaataaaagtgactgctaataaagtgtgaaaaaaaggcatatgattggagcaaatttgtctgaaatgtggatagacacaaggctgcgttttccgtcctctcctatgtcagccattgggttttatagttaggattggcctaatcgtccggaaggagattaacggatgatgagtaatgacgttgcgactttgcgagagtgcgatcgtgtgcagtgcgtcggccactttatagggtttagttggccaaaaggctcaaggcccgatggcccggcccatggcacagagttttggcccggtccaagcacagcatagcccgatctttgagctgtgaatgggcctcttcgtcggcacgataagatgagggagccaacgtagacttattcta

SEQ ID NO: 8508 - DNA, 1501 bp, Oryza sativa
taagaataaggacacgaggtattagtgccacaagtgcaaatgttggtttgaaggcaaaaacttcgcactaatcaatcagatgtttcagttatcaaatacggtttttatgtaaggagattggtttgtatgtaaggagattggatgatggtatatcgataagatatttcattttgacttcgatgggatattccattttgacatattttagttggtggtcatcaaattttaggtgcagctttttcatttgatattaaatctagtagttggaagttcctatatcagttgatcagaattaatatttactacaaacctaatgtatatgtgttttttctaagtttcctaaatattaatattatgtttatgactatcaaacactaaatattattgttaaggtagcacaaatttctatgagaagtttatttaatagatgtttctttaatcttatatttttttagatataaaaaaattgtaatgataattgctgaagttgatgatcatgttgctagtagtgcataagggtttagtcgtgaatatgtgtagggctacaaaagaaaatacgataggctaatagtagaatatgctgttcaaaatgcaattgaccaacttaaatactgctcctttcatattataagtttttaatttttttaaagaagtttgacaaagtttatagaaaaatataccaatatttataggatcaaattagtttcattacatctaacattgaacatatttgattagtttctttattttgtgttaaaaatattgctataatttttataagatgttgataaacaaacgcatctgccgaagggcaagcttcactcaatatgtgcgatataaagtgataaaatgtattgatttttataaaaatttgatcacctattacatgctcctgacgtctatttataggtttacagccctgggtttgtaaccctagggttttggtgtacaagtgagtttacacaaacgcccttatgacatgaacatttataggggtaataacaaacctttggctcagctacccggtctatgggcttgtcccttcatgggttgtttgcgggccttcttgattaacagggcgttggctgtcgtattggcttcgctgcttggtcagagcgatcctttggcaatttctccgctactcagtgatcagctttgccgcttactgggacttcgcctcttggttgtcttgcacctcgtttcgcggcttggcatttatgtgtttcggctggctcggtcgaaggccctcatgacatgcctctaacataaacttaatcaaatgtaaaaaagtttgacttagaaaaagttaaagcgatttataatatgaaacgtaggtagtaatcagaatttgacctgaaaatccctatctctactattataaaaattgaagatgtttctgccgaaattttggtatgtcatccatttttgagttagttgtacatcacccgtatccaattcgacatgagtcaacgtgagtccataataactattatatatcccc

SEQ ID NO: 8509 - DNA, 1347 bp, Oryza sativa
atagccttcaaaacactgttgattcgaaatgaccatggaactgtaaacctatcctatcacgacgaagtgtcgacatgcgtaaacaaggcttaactatagcaatcagccaactaatcaaatagtcatcgaccaactaatttaacttccgggccaaccaaccgtcaaattatcttgacaacacagtgctctaatcgccaccatcaaaccgtacctgctatacttaattattcgacagtatcattagattttccatcccacgtaatcccaatttcataatcaaaagtactttaatttttacttaattaatcgatataagtttaactcctcaatacgccttccatctcataaaaaattaacttcggggaataaacctaaataagcatttttccagattcatctttagaggttgtcttttttttttttacggaacatgtatatcatgtggtccgttctaaactccaacaacatccagatttttcctcggtttccattagcacgtttttcaaactactaaatagtatatttcgtacgaaaactttctatatatagaagttgctataaaaaatcaaataaatctgtttttcaattttttaataattaaaactttattaactatgatttgtttcgttttacgtgcgtacttaatcttcatcctgtaatcagattcgaacgggaccatagtaacatttctgagttaattttgtggagaaaagtaatcgttgtttatttacgacatgatccaaacgaccgtaaactaaaccgaactatttcacgtgaaatgtattgttcctttatttcacgcttacataatttcactctacccacaatgacagtaaagcttaacttacctaatctactgtttaactcttttgttactcactctaatcaaattcatttgacgtagttctcccgacgtcaaatgttccttattcgagggagtatatatgacacatctcgagttaacccttaaaatttccgtagagaatcgttttttctttggcttaccatcagccgcagctaaaatttaaattttaaaccttagttttagagttgattttaatatatttttcattatttatttactactagcatttgcttttaaacagctaaaaacacagatataaaatttttacctatcaatattttttaagttgctctctaaacccaaccacaacattaggtctctatttacgacacgactcaaacaacagtaaactaaatggaactatttcacgagaaactatttttctcctcttttacatgccggtgatttagaaggagatgatcacacaattgcacaaacaagaaggatggctgcagttcccaagaaagggaaaaaaaacacag

SEQ ID NO: 8510 - DNA, 1501 bp, Oryza sativa
gataatacaaaaggctgtggggcctcggggctcggagtcgagaatacgaagcgccacgtacgcgaagtcgccatgcggagacatgtgtggactcgaacgggttttcggcgctctagcctcacacgaatacatgggccttctctgattgggctgatttttttgaggccctgaaaatttggaggccttgtacggtcacatggctcgcacgcccacgtgcacggccatgagacttggtgcacgtgtgaagggaatccagggcgagggagggcacctatgcagctactacctcaacgacatggaaaaaagcaaacagtggtgagattcttttcaaagttatcttaataatataatagaatgatagattttgtgccgcataaaagttagttgctagtatcaagcgtagcaaacctaccaccctgcgggtcccgtcaggaagccgctgccctaaaacgggcacgccggcactaccgccatatccctcaactttctaccgtatgatacagctgtagaagcaatccccctcaccctctacccccaccatacatacgctgattcttattaggatggtcgctatctactatccatgaagaatcaaatggtctaaatagcatcaccatcaaggatgactagaggttggggtgcgccgcctgtagacaattaagttaagttaatagatcgtaccttgtcttgtatttataggaaagtgcattatgtaggacaagcacctaaggtgcaaagctaattagggtggcataatagtggagggaaagtcaatagtttacttccatagtgatgaattttacagtcgagttgtagcaaaagaattatcctatgataacacaaggcattgatgtgctcttcatagaacactaattgttgcttagatgtgagctgccttatagaagtggaagacgcaaatggactgaagatgtatgttattctgcactgcaaaatttgtccatcatttctttaggctgcatcgaccatctgttgatacatgtaaaaccatggtggttgaatcatttcctgctgtttggacctggatgttgattgttttcttgccttccatgagtggctgtatgtacttctgggaaaattccttagtaaagtactgtaatggagactgcatgttagctttttgttacaggcataaaaagaaaaatagctactccctccgttttatattatagactttttagtattattcacatttatatatatgttaatgaatctaaacacatatatgtctagattcattaatatctatatgaatataggcaatgctagaaagtcttataatataaaacggaggaagtattaattacagttactaaaagctgaatagtatgcggaagaacttactatcctatcttgctccatgaacgtggtgttgatagtgacaatgtagaatttgcttgattggctcaggaactgctcgatttcagttctttatgtcagatgtgacttcaacgttttttgcacaaaagcacagatccttgaa

SEQ ID NO: 8511 - DNA, 1501 bp, Oryza sativa
aattcgaacgaatccaaaaccctaaccctaaccctagaagttgctgccaccgtcgtcgcccgcctcctctgccaaaccggccataaccgccaccggatccgagcaggggacagccaccgccgctgctacatccgggcagggggcagccgcctccgccggatatgggtggggggcggtcgctgtccccctcgtcgccttccacacgcggccgactccgcgcgcacgccagccgcctccgtccgccaagacgcccgctgccgctcccgaccgctttcctcgaaccctacgcagccgctcccgagcccgttgctcgccgccccggccgccgctgcttctcccgatcccgccggcgccattaccgcgcagccgttgccgtcgccgttgcactaccgtgaggataagagagcggataagtgagaatgagaggaggagaggataagcggtcagttatggtttactgtaacctaacgagggtctcgtacatgtgctatctgtgtaacagcccaatatgcagaagtcgagagtgttagtatcctctccataacagaatataagaagttttgaggttggacacgattattaacaaattgagtagagaattaaatgtagggaggttgtaattggttgataggtgaaggtaggtggggaaattgcatggtgcagagttaaaattagttgagaaaagaatgttggtggagaagttggtatattctgaggtaaattctgagtattagaagttgttatgttttgaaatggaggacttgtaaataacaaaccaggctgttcctaaacacctaaaccgttgcatagagtgataaacaacacttttaatacatcagttattgaagtttttgaaacccatctcctgcatccacttgcatgttaaaactcttgatagctgatacactactaaaaaatcgattttcgcagtcgaaaccccctccaaactctagacaggcataattacatccgcatgaaaaagtatttggatggggttcggttaaggtcacctgtgtggagattatggataccccatacctacacggcatgtatagtccgactgggtatggggtgccatgtatagatagaatatctttaagaggactcggattaaaatctaaacttgtatgtcaaggaaatatccgagatcctagtcggttacgattgtattttatctgtaactacatattccgttagggatatggactatattttgtaatacgaaccccttcccatatataaggaggcgtctgggtgcctctaggagcacgactttctcccagatcatatgatcaataatacactcggcagatcaatccccggacaggagtagggtattacttcttaattaagaaggcctgaacctgtataaaattccttgtctctaaactcatccacttttcctgcttgatagccaccccttttaatattgccgaaatcttgtttcaacagttggcgcgccaggtaggggtagcgtcaagttcttcgccgactagtgcga

SEQ ID NO: 8512 - DNA, 1501 bp, Oryza sativa
tttaccgttttttacgtgcacgcttgctagactgctaaatagtgtgtctttaatataaagggtctatttaaaatttccttttaaaaaccatattaatcaactttttcagttttttagctaataaataatcatatgctgttccatctcttcactacaccatgtccaaacattcccatccaaaatcatatggaaataattcatctatacttttgccgacggacagtttgtctttgaatgtggtctttgctaaccgattttccgttggggattttgtgtcatgctgtagtgtttgttttgccggctaggcaggaagggttcccaacccctaaaaacaaatataccgttgaaaatactattttcctattaatgtgagacactttggttatttcctcttacaactaaaattaagatgaatcaacgggatacagacggcatgcaaaagtccctggcgtatatcttttgttgtgaagaccaacagcaaattaactcatcagcatgtaactaaacttttgcctgcatgcagtgagtattaacctatcccatagaagtttcttttgtatgcatgcatccaggtctgtaacgagtcttaagatggctgctcaggttccggtcaacaatataatctagcaaaaaggcaagatcttcaattatgtgttagatgcatcgagactaccattacgaccatctcatttttgaaaaggaaaaagtatggattttccccctgaactaccacggtcatttgatttatccccttaactacaaaaccagatattttacatctcgagcattacatattggatgaatcacccccccgaatcaacccgaagcggttggaggtagaggaaggcagcgacgaccaccatgagacagcggatgaagacagcgtgcattaggcggcggcagcagtggcagtaacatacgcggtggaaggcagcgtccccgccacatcctctccctcggccgtgtctcacccatcgatcttgacgagcgggaaggccaagcaacgacgcgagtcctcgagggtcaacctctctgcctcgggcctctgcatccggatactgccgtcgatacggtgccgcttggacctaccgtcgcggcgccgccagttgggatctgcggcggtggagccgtagctctcatgaaggcggcgacgagcctgccgccgtctcctagcatgccgcccacccctttcctgcagtgcagcgcggcggcggtggtccaggcagagaaggcagcggcggtggtccaaatggaggtcacggcggggaagggcgggtggcgggcgcggcagggagggccgtcatgggagagcaagctctctgccgcgtgcggcaccagccccgcctccgctgcctgccgcccaccgcccgggcgatccccgcctcagccgcttgtctcccgtgtgagctctgcctcagtcaccagccgctcgtgtgttctccgcctctgccgccagcaacccggtccacctcctccgccgcgtgggcgatctccatctcta

SEQ ID NO: 8513 - DNA, 1501 bp, Oryza sativa
agccaattgttaggttactgcctacggcgctctgcccaccaggaccgaggtaaccaagcattcgacatccaaagaccgtgaacttgttggcactgttagagaatgtgaaaggacttcccgtcaagctcagatttgccttgtcgacgcagtccatgtcatgtttcgtcatgttgtagcattcgtatgacataggcatcctcatgcgagcctaaccttctggcaacgagatgttgagcagctccacattccggagaagcagcttgggtatgctgttaccggtactgttgcagatcagctcaaaaccaggcatggcgcagccagcctgacctttgatgccgaatggaaaagggatatctatgctaccacaacttctctggcaggtggatgctgcaactacagcaagaccacctgaagttgctatggtgagacatagtagagtagggaagatcaatgcctgaatcatctttgttgctggaaaaaataagattgctagctagatgttgtccacctttgtgtccaaggtctggtatatatagctccatatgagtgatataagtttattagctagcaattttagctttctcagttttttatgcaattttagctttcgctttttccatatttttcccagctaaaatgaaattactctcataaagtacaagtcctcacacccattaatatcagcaatcgtattctccgattttcatatctcgtatttccgatgtacttaaatgaaagacaccagaattatctgatatagatttataattgtcatacatttattgaaaaaaaaagatggagtattatctattagcttcatcagaatgcaccgctcgaaataccttgacttggactttttctaggtcttcctcacttattgctttaccaggaatttccatgactagttgttttcacaacaccaactctatttatgaatccaattaaataattcatttgcctgcatatccatggacatacatcacaccagcttgtcataacccgattcaatcgtatacagaagaaatgcatgggtatgaataattgtctagctttgcatccaatgaattctagctctaccagggagattcttttctattgcagtataatattttagataatggagagtctgatgtctgcacatcgcgcatccagctacctaaagttcgcaatgacaaaaatccaagactatgcacctgccaaattgggacaagagatcgttctctacccactccaactctgtagatccattgagcacattatccggacacggaaacgagccgatcggaaatataatctacaaagattataaatacagcaacaccgcacatggccaacatacagtgcaccagtcccatcaatattttgtaatggcatatatatatgcatcctccttaattaaatggcagatcggtttgtaattttcgattcaagccaatgcatcgagccagctttttgtttttttcattcctagaaccttaaaggtgcaggttcctaaacatca

SEQ ID NO: 8514 - DNA, 1501 bp, Oryza sativa
ccataaccatccactcgatccctgggaaaccagcattagcctcgtgacaagggaaacatagaactaatgaacacaatcccatccgcgtgcaagcaggttaatcacacaaaatggcaccaaattcgacagcgaaaggagctgggtaaggggagcctcactcgtttccttgttagtttatcatccacggtttaaaaacctttttttttaagaaacactgcaaacacagacactcaaaaatgctcacacattcacctttatgaacacatatatacatcctaaacctgtaaaactgtgaacaccttcaaaaaaaaaattggaccaacgtatcttgagattgactaaatcatcacggacgtctcgctattgacgggtaacgcctaccactgaagggataattaggtttaaatgcaagcatccatgtcaaatttaaaacttaaacccgggttaaaagttttttctcacatagtctatttatcagcatcggcttgaaaattgttaataagtcagttttgaaagtttgcaccacaatcatcttagcttgtcatccaaagtcaaattttaaaatgtgaaactcaattttagagtttaatttgtatttttttccatggcagtcactttcccagttccggtttttgaattgctgctattaacgcagttatgaaagtttgcaccataatcatcttggattttagaacttgcagcctcgtatttttatttatgcttatgcttatcaactaaaatttaaatttttcaaccttaaatttagagttgattttgagggttttttcatcgtagcttattttttagctttgcttctaaaccgttaagaacacacatataaaagttttatttataaattattttttatttataaatatactgtttcgattttttttcttcaatatgacaaacgtttttttttgagaggacaatatgacaaacattgaggctgttggtaaacactggaatttcccctgtgattacatacgtgtgctcgtaatgtttcttatcacggactgttgaatcggatggggagagaaaagtttagaagaaaaacaaaaaaaacggacatggggttagctagcgagctcatcgcaccttccagaagcgaacgtggcaaccttccctgggccccacccctcccctcccaccgggccatgtctcatcgccaccctacccacactcactgacgtccggccccacgcggctgtccccaccgcccccgccgtcaccgacgcgtgggcccggggtggctgtccccacatgtcatcgactccgtagtacggcctccctcccgtgcacgcaaggcacccatcccccgctttaaattgcctcgccccactgaccgccgccgcttgagctgacctgaccccgagccgagccgtacaccaccggaggaggaggaggaagccggcgaggtgacgctgcgagatcgggaggtagggttcggggggaggttttgggtttggtggatggtcacggcggcggcggagttcgtcga

SEQ ID NO: 8515 - DNA, 914 bp, Oryza sativa
accacttgcttcttctgtgggattgtgattttgtttgtaactagttatgtatccaataaaaacgtgcattccaaatcttttacgcatgcttatcataggaggccaacataaatctgctataaaccttgtgaaaaagtataatagttaaattaggagtccataagaaccaaaattaattttcaaagttttatttaaaattggatgtttatttaagcttgttttttaaccttgaggttttgtttggcaaatgggattgaaaaataatatcccaccctccaaagagcaacatagcatcttaaccatctattattcacactttatttaatcctagccattcatccatttccctttcccagtcccatctctcatatcccatttatcaaacacactctgagtttataaaactctaagaatagagataaaaagttttaactaaaaatattttttggttacttttgtttatttctcaagggcttatcaaatatatcaaaccccttgtcaaccactcggttatgtttctgcagtccctacaaccatcggatcttaaatctaaggctcagatcacctcagcacagtatcaatgccaatgccaatgcaggccaagggcagtttcaactgaggaagatttacaccgttagataacatctggacggtccagatctcgttctctgatcacttcgattccacgcaagattcctcatgcttcgctagccattccagtggccgccgaacacgtgactccagccaatgggagcctgccacgtcacaacacggccgcggctataaattttccccgacctcctcgacggcccggcccccctcgccggcgaccaaacccccgccaccgccgccgcaccagccgactcgccggagaagctctgccgaaaccctagcactcccctcctagtctccca

SEQ ID NO: 8516 - DNA, 1501 bp, Oryza sativa
aaccctagcccatttccctccctcccatctcacttcgccgccctctcctccgcgcccccgagcggcggcggcgacgacggcgcccctcccccaccaccgatggcggcggcggcggcacccccaccacccacggcagcgtcggcggcatcctcccccaccaccggtggcggatctagcgggaggggaggtgccccgcgagcggcggcgacggcgacggcgcccctcctcccgcgagcggcggcggcagcaccctcccccaccaccggcggcggatctagcgggtggggaggcgccccgcgagcggcggcgacggcgcccctcctccctcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacagcgacggcggcggttcggcaacgacggcgacggcaacggcggcagcggcggcgacccccttcgatctaattttttgtttttatttggatatatgtgtgctggcggcgacccccttggatctaattttttgtttttttgcaaagtgctataaggctgcatgtgattctttgttatgtgctatgatttttttatatgtatgtaaatatgcacttgttctcctagtgatgctaaccgaataggacttggtataattcaaaccaagtcctattcgcccaaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagagtagatataatccgtgtcaataaggggggtgtttggataaagggactaaactttggtacctgtcacatcggatatttggacactaatttagggtattaaacgtagactacttagaacactaattacataaataagagctaattcgtgtgataaattttttaagcctaattaatccataattagcacatgtttactgtagcatcacataggctaatcatggattaagtatgcttaataaattcgtctcgcgaattagtccaggattatgaaatatgttttatcaatagtctacgtttaatacttataattagtgttaaacatccgatgtgacgggtacttaaaaaaatttaaccccatccaaacattgcctaattcgagtgatgacttcactaacagtttgtcatcccaacagcacgaatctcaaagcaaagctggatatatatagcgcgcccatcacgcgcactcttccgccgaaccgagcaaacgcacaaaccaaaggcggaagctaagcaagcaagcagcagcagccgcagccatggaggcggagaaggagatgtcgatga

SEQ ID NO: 8517 - DNA, 1501 bp, Oryza sativa
ataatatcataaatttattagatcctaaaaacttcttttaacataaaatcagttgttgaaattttatagagtttgaagaaatatttatgaccaagagaagtataatgaaatgaatgaacatagaatccccacattaattaatttaataaaaagagaatttattacttcttacggcctaaaaatgttgctacctactagtttgtcaaaaaagacaaaccatgtccaggttcgtagctagaattgagttttttttttttaatggatggggtagttatatatttgtcgggggctaggtaatagcaacctttaaactcaaagtttgttatgttttggaatagaaatgcagtagtggtaacgggtgtatcgtttcaaccttgcggtctcgtgttcaatcctcaacacgcttgcaatttcttttttaaaaagtatttggaatctctttcttttattattttgggatagagagagaatgaatcaatttctttttaaaaatgtatttggaatctctttcttttattatttttggattgaagtagttaatgaatgaagaacagaacttaggtggtgtttggatcagggactaaactttagtctctgtgacatcagatgtttggacattaatttggagtattaaacatagactacttacaaaactaattacataaatgagagctaatttgcgtgacaaattttttaagtctaattaattcataattagcacatgtttactgtagcatcacataaattatttatagtttaattagtctcaatagattcgtctcgcaaattagttcagggttatgaaataggttttatcaatagtctatgtttaatatttttaattagtgtcaaacatctggttggactgaaaagtcccatccaaacagccccatcttatccgataactacaagcaaaccgtacacgatttacacattaaacacaccctctctctctctctctctctctctccataggagcacttcaatatctctatcgccaggaaacttccacccgaattattatatccctcgcccacagaaaatcccgcccaagcatcaccacactccccattggccccaccccccatgtgaaaaagggacccaaaccgaccagtcaccaactcaccatccacccccaccccaacccaccccacccacacgccaacccggccccacacgtcagccactcccactgacaacccggccccaccaccccacccgctcgtactcctcccctctcgcctattaaacgcgctccccctccaccaccgcgcagccaagccaaacaagaaacccaccgtttctctctcaaaaccgcgggaatcaatcaatcgccgttcgcgtcgcgccacgagatattttcccccaagaaaaggtagtagtaatcttcgacgatcttgatcgatcgccatgagctagctagctagcgaatttcttgttgtttcttttttgggttattgatggcgttgttgttcttgttcttgtttgttgcagttggagt

SEQ ID NO: 8518 - DNA, 1501 bp, Oryza sativa
caaccttaaaccctatgattttgatgtactaccggatgaattagatttgaacaatggggaaaactcaccgtctatgcagttccaatatccaaaacggaagccaacatctaaaaccaagaaatattgtttgctgggttagggcggaggaagctgcgatggagaatgaacaaagttcgactctgacgacaacggcaagatggcaaactgccctagttttcttgactccccgtaatgatgcaactaaccaattttagaggtgggttgttgggttaacttaatcaattcagcagcccaatacggcccagtagtttgttgggctactggttagatggaaacatattgctgtatatgagcatcttgttgcctaaataattaaatgtgattgttgcgtgctcacatttgtaattagtggtttgcacgtgcttagataaaaaaaatcagtatctctctagtagactagtgctagtagcaaaacctaccgaatatggaacacaatcggagtcgatttccagggccgtgaaacacaaacgctactggactcctttccgcctaataaaaaagctcaaagctcaccgcgacaagaagaagcccagcccacgacaaaccacacccaccaccacgcacgcacgcacggtatacatacaccttcacattgggggcgatgggcagcagcaaggccaaccacccggcggcttcctcgtccaaggtctcctccgtctcctcctccaaacccaaacccaaacccaccccgattagaaaccctacgcctccgcctcctcctcctcgccgccgcacgcccccgcctccgccgccggggtcgggcccggggccgcagcgaccttcctacctctcggtagcgctccgccgccgcgggcctcccgcgggcagcgcggccgggaccccggcgccgccgcgcgccgccgccgcctttgatgtcgcccccccggtcgccgagcacacggaccccgttgtcttccccgcttcattagccgagatgagcggcggcggcggcagcagcagcagcgacgatcaggtatataccccacccccatctgctccccgcgcatcgacactggctggctcgtggctgctacggggtaattgcgtttttgggtgcgagtgaattaatgttgtgttttttttttttggggggggggcggtattgtgatgcttcaaagtttgtctggatcatggtacatgtggcactagattaacgcaataagtatgctactcacttgttttaggggcttttgtggccgattactgcataagctgttgttgctttgaagttatatggagtaagagtagttcgtttgagttttgaaggtgctacttcaaaattttaagtggaaccaagcattcccttaagccaatgcagctccttctgtgttagcttgatatttagggctacagatatcgacgatatttcgattaatagttgttttggacgctccacaagttattatggtcctgtggttatgattttctcatcatatagttg

SEQ ID NO: 8519 - DNA, 1501 bp, Oryza sativa
atttactcttataccactactaatttcacatgaacgatgcaataaacaaaagagagcataggggtgcttgcttacagtggagggagggtgagtgacctggagatgaaatcgacggcgacctcgtcttcccgcgcgacgaggtgctcgatccttggagggtcatcttgcagagggcaaggcaagagcctgccataaactggatacctgcaagaacccatatataccaccaccagtcagttcatcgctcggagaagagcagcttggtctgagggtaagagggcagcttacgctgcggtcgctggggcttcgacggttgcggcggaggtggacaccgcagcggcggagaggggcgccgccggcgagtggagggcggcgcggtggcgtcggaggaggggagaggaggaggagagggcgcggtggaggaagggagggggctggacggggcggtgccatagctgcgggaggagggacgcgagggaggccgccgccttcggcatcgcggcggcggcggcggcggcggagggaggagtcgggattgggttcggcggttttgggtggggtttttcttctgccgcgctgttgctggtttggcgggttcagaagataacgcgatgaaattgggggaaattcatcaattatacttcaatttttttttaaaaaaaagcatatatgtcaatgttaattgttagagcatgaccatatgctaatatttttagtgcaaaatttaaccatatctgcctactgtaaaaagggcaatagactgtatacatcagtcctccaatgaacattgaacaaggaatcaagggggaccgtgtgagtgttgctgtttgaatctaaaagcaatgtgatataattactgagtttatgcaaatctgtcaattcagtgacttcctgatgcttaaggcccattattttctaattatagtcacggaattattgcgggcacactttctgaactactaaaccgtataacttttttaaaacaatcttcatttgcatttcttataattttttaaaatcaatttatcagctagtaatatttaattaagttgtttgtgctctcgaataattgtcataaactcagttttgtctatcatccatggaccctttcaaacaagcccttacgtgtttttaaatggaaaagtctatattctaaaattgttgaattaaaattgcatatgtttatagacttgttgtcttattattacaggagcaaattatcattgtctccagcaaaatctgcttattgtgtgctgggagccaaaagaaaatgagatatacgcagtactaaattgtccaatagagagccaggtgcccaggatcgaggacaaccagcacagtcccaaacttattacagtagtagcttaaatcctggacgaaattatcccaattataagattcaaaagagtggttctaagcaagcagtgatcttttggcgcgaacagcggcatggagtgcagctcagccgccgcgccggcgacgagacgatcacctcgtcagg

SEQ ID NO: 8520 - DNA, 1501 bp, Oryza sativa
cgggctccgggaggagatcgcccggggcgtgggcgtggtggtcaccgggtgggcgccgcagctggagatcctggcgcacggcgcgacggcggcgttcatgagccactgcgggtggaactccgtcgtggagagcatgagccacgggaagcccgtgctggcgtggccgatgcacagcgaccagccgtgggatgccgagctcgtgtgcaagtacctcggcgccggcgtcctcgtgcggccgtgggaggagcgccacgacgtcacgccggcggccgcgatacgcgaggcgatcgagagggcgatggcgtcgggggacggcgcggcgctgcgcgcgagggcggcggcgatcggggaggccgtccgcgccgccgtggccgagggcgggtcgttgcgccaggacatggacgacctcgtcgcctacctgacgaggtgatcgtctcgtcgccggcgcggcggctgagctgcactccatgccgctgttcgcgccaaaagatcactgcttgcttagaaccactcttttgaatcttataattgggataatttcgtccaggatttaagctactactgtaataagtttgggactgtgctggttgtcctcgatcctgggcacctggctctctattggacaatttagtactgcgtatatctcattttcttttggctcccagcacacaataagcagattttgctggagacaatgataatttgctcctgtaataataagacaacaagtctataaacatatgcaattttaattcaacaattttagaatatagacttttccatttaaaaacacgtaagggcttgtttgaaagggtccatggatgatagacaaaactgagtttatgacaattattcgagagcacaaacaacttaattaaatattactagctgataaattgattttaaaaaattataagaaatgcaaatgaagattgttttaaaaaagttatacggtttagtagttcagaaagtgtgcccgcaataattccgtgactataattagaaaataatgggccttaagcatcaggaagtcactgaattgacagatttgcataaactcagtaattatatcacattgcttttagattcaaacagcaacactcacacggtcccccttgattccttgttcaatgttcattggaggactgatgtatacagtctattgccctttttacagtaggcagatatggttaaattttgcactaaaaatattagcatatggtcatgctctaacaattaacattgacatatatgcttttttttaaaaaaaaattgaagtataattgatgaatttcccccaatttcatcgcgttatcttctgaacccgccaaaccagcaacagcgcggcagaagaaaaaccccacccaaaaccgccgaacccaatcccgactcctccctccgccgccgccgccgccgccgcgatgccgaaggcggcggcctccctcgcgtccctcctcccgcagctatggcaccgccccgtccagccccctcccttcctcca

SEQ ID NO: 8521 - DNA, 1501 bp, Oryza sativa
ggtggctcattttgtgtgttctggcagaggtcggatctccaaggttatttggccgccaaagagaaacataaaaaaaaatgccaaatatgaaaaccacagaatgcgtggtgccaccgatgaaaagcttacacgccaaaaatcttcccacatccttccaaaatatcttgctacagattattctacatctcagatgaaacttactgacagagttgagttgtacacttctagctgttatatctggggtggagtagctcatttgcattgccacacatgcaacattttacttctagagtgtaattttgtcagagttttgcccaaggtgctgtacatcttcgaaatttacatcttttgtcagtaacttgttctggtattttgtactgtcccgagatttgctttcctgcttcacatggcactgtttataaattgaattgaatttgaggtttcaccttttgttctgagctgtggtacacgggccaggcccaagctgaatgtcgacccagacttgaaagctatcctggtgtttttgtgggcctgtgctgaacagcggatgggttcgcgaatgctggcggcttctgctgccactttgtgacgagttgcgattcgtgcagggggcaatgacgtgattgctataggccaacgacacgagttatgacgtatctgaccagacaaatctaggctcccctggggccagtattggttgaggtaaggtttgtactgaacagttaggcgaggagataaagtgaagatgaaaagacgccacaaatccatccctaaaagggagatgattactatacttccgtttgttttgtttgatccgaatatgatacagccatacaggcatggtggggaacagggacagagctagaacgaaatggagggtggtaccactaatttactctattttagatcgagtttaagctcatacgggtgcctaagtttgtattaagggggtatatatatggtgaaaatagatgaggtatagctaaaaaattttcttaaccagtttctgggcacccccttaatatatactagcttcgcccctggagagaaagaacaatgaattacattcaacgtagacatgtaaaccttaaatatcaataagcaattattcacaccaaagttatcacataatttcgataatcctttctacattttcatacacttttcgtcaaaatttaatgattactaatagtaactatatcgaccctatttgtttatgattataagttgcctcgaatttaaaattctaggttggagaatttcttttttatgtgaagtccaccgttaaatttgaagcggaggaagtgtctatttatggattaaatcaaatatacaatatataaacctataaataaaaaatcggcttaaaagcttaaaccaataaagttaagcacaaacaaaaagggccataggctcgcccacacaaaacaccagatgaatggacaacgaaaagcatgcagctacaatagcctaacccagtgaaaaacgaactaccacaaga

SEQ ID NO: 8522 - DNA, 1501 bp, Oryza sativa
ttgctatttatgtaaacatgtacctccaacgatcatcattccttcctatacaaacacgagtggtttcatagaacttcaagcaagttaaacataaacccctcacaccgaaaaaaaatcaaccaacaagttcatctctataaaaagcaatcttttaaaacagtcctattctaccatccaattaaacacctacttaaaaaaaacctaatgacattccacattagccatgcatcatttcagcccaaaccaaaaagtggaccaatgctacaccagacaccccaaagaaaaacccacagtcactcacaaagcgaagcaaaggaaggaaacatcattctactgttccatcttttttttttttgcacctctctattccattccatttcaaatcaaaccttcgaaccaattctatccccccttggagccaatttttccttttccctcctccgtctcggctcgtcgtaggcgtcgcctctcgccctcgcacaccacgcgcccgaaacgcccatcccacgaggaggagacgcctcacgcctccttctcctcacccacaatataaccacgcctccatcttctcctcttccccttctcctcctcctcatcgccatcgccgcggaccaaattcccaaccctcgaagcggccaaaccccgcctcccccgccgccggggacctccgatccgggccctgatccgccgccgccaccccgatctgccgtctacgcgccttcccctgcccgcaaaccctaggaattcgggccttcccggggcggcggcggccgtgggccgtcgttcgtggctatggaggggttggtggggagggcggtgaggaaggagttcccggggttcggggtgttcgacggggtggtggagtcgtacgacgccgaggcggggtacttccgggtgatgtacgaggacggggactccgaggaggtggagcttggggaggtggtggggttgctggttggtgggtcgccggttggggtggagatggcgcatccgctgccgttgacgcccgggcggcgcccgaagaagcggcggcgcggggatgaggaggggggcgttggcgtgggcgcggtggtggcgatggaggtggattccgtggttctggctgtccccgccggtggcgcggagcccgcgtcgccggtggtggtggtggaggggagtagtagggatgaggtggatggggacgtggtgtcggagatggcggagaagaggcggagggtggtgagtccagggcctgagtcgtccgggaagccgcttcggcggagcgcgcggcaggcgaaggcggccgcgcgggtggccgaaatggaggccgccgccgctgtggcggccgccgctgaggctgaagcagctgctgccgcgatggccgaggccgaggcagaggctgctgttacgccaccgcagtctgggagtaagcgtaagcgtgcaagcggggctggcaggtatcggtctgtcgcgaaggatttggagaaggctgcggtggagaggctgcctccgaagccggagc

SEQ ID NO: 8523 - DNA, 1501 bp, Oryza sativa
cagggattcatatgactgcctcatatgtttttttgttacctttgtttgctgttcaatatgtgtcttaccaggaattagtaggcagggattccattcagattttgagtgctttgaatagactggtgattagcttcaattctctagtaagattccctgagcatgcgcaacttatggttcgtcacccatggaaccatgtgtaggccgatttttgtcttggcgaaagtgtacaagtttcctaggtaggacagctaattgaatctgtttcagtcgttcctatcaattgtatcatggtggttttttttttaccttgaatccttgttcttatttcaaataaccgtgcgttgcttatatagttattttgtacagttactattttactacctatggtttgtgctgacatcggaatgaacaaaatcaatatatgaatgggtaagtcaaaacatagaaatcctacacggcacttgcttgatggggtattaccaaagaattctgtttatgaaaacagaatacagtccagttgtccatattttgctgcttttgcttataaagagcaaggttgccagccagattttccctgcgaattcggaaattgaatagaagtagaatctttcacaggattgggaatttaggatgtactcccatataatttaatcattttaacttccgtacctgtggaagcatgaagatcggtactctgactattgtgtcatcttttatttcttatgaagaactacctatctctaataatgcaacaggaatgtggaagagttctagatggaaccattatacatgggtaacaggggattaataggcatcactcttcgtctgttttctgtagttcatatataccttcactttgcgctgcatattaggctctactcatggtcttaggaatggtatttccgagcatattttgttacatggttcaacaatctcacttaataagttcaatggacgaatttgaatatacatgatgatggagatttgttttctaatggagtacatctgaatgtgatctttgacttttgttgtcttttcgtgtgactaataatcaactactacttcgatccctactttcatattatttatcttaaatggtcatttgactgtctttttcttcttcatattataccatcctaccttcttttgtatgattgggtggttctcgcatgttttgcttaacattggagaacttatgctcatttatgactgggtggtacatttatgctcatgcaacatttgtgtggcagaacttgttcagcatcactccttaattggcttgacatccaccgtaatgtgaacattcattatgatgatatcaaaggtcatgcatttgttaccttttttttttttttgcttttttccgaggattcttcttattactgaccattatctcctaatctagttgttatgtagtgtatttttaggaactggatatttcttccatggttaatgtccagaaccatgataatagatatttactagttacatttcttttcgt

SEQ ID NO: 8524 - DNA, 187 bp, Oryza sativa
cagctatcaacatccttatatggtgaccatttcttctctccgacaagtaagcgttttatatacactccatcttcaaacagacacgcaagcaaagaggattcatgtgtatttatattggctaaggggcttctttttggtgactttgtgcagcgacaattttacacaaggacttgcttcagatgcaaca

SEQ ID NO: 8525 - DNA, 1501 bp, Oryza sativa
aatgacctttctataacccatttattcatgtctcatatatattgcccaaatttgctccttggtaactgcgatgaggttttctaaagcaatgggataacaattaggtaggagatcaatacatacatgacaactagagctagagggatccaagaggtgtgccgcccgactacttgagtagaggcataacctgtaggttagtattgaagactattgggaatctgagatgagagaaccctgatttagtagagatgggggaagaaaaaaaaatgaaaacttaaaattaggcggtccgataaatttttcaataatacttttgaccacaactacttattatgaactatatgagattgtaatataatcaatttttccactgtattgacaatgcacaacatgcccgatggtatggcctaccctttcacatcatagaattactctgcagcggcagcccggcaaaggtatcatccatgacaaacgagtttaccctaaagattttaccataaaaatttgaatactataaaacatcttaaatgaaaatttgaacaaacataacatagaatttatttaactagcgctatacattttgtgtaattttacatacaggcaacaacttaagttgccaaataaaactcattacaaaccaagttgttaccttctaatataagctaaaacgtaattgttgtgaaaaaaaacaaatacagttttatactccttctgtttcatattatttttttctactagtgaaacattttttaatttgaccatatttatagaaaaatatagtaacatttataaaaaaaaaaatattatcaaactgtatccaatgttacatttaatgaaactaatttagtattaacaagttaatttagaaaataatcaacatgattataaaacagatgaagtataatttattcaagcctcttcatttattaaaactgaaaaaagaaatgtaatttgagaacaaaaatcccttgctcatctcccttcccttccgttcgccatctaacgaactttcgcggaataggcggttcccacttccatccatgtccattcccctttttcctctccccttcgctactcgccaacagaagaaaaaccctcacctccactcccccctcgccggagccacggcgaccctctccaccccctgccttgccgccggcgagtgtccttgcgtgcgccgccggtgagcgggtgtggatcccagcggcggcgcgatcggccttcgaatcgaactgaaaggtattgggctcttctctctcgtaactggggatcgattagatcggtgttagattggcctatttgcgtccaattagccgatcctatttcgtcccgatttcatttatatgatccgtggtgcgtgctgcagtactaattgcaattttgtttttatttttttttgcaaaataattggggctcagctgaaccctcgttgccactgctgtgaacatgtcccaaattgagaagatcgtatgagctatggggaattattaggattcttgga

SEQ ID NO: 8526 - DNA, 1501 bp, Oryza sativa
gacactggacacaccatctgattaagggtgtttagttcgccaaaagaaaatttttggtgtcatataggatgtttgaccagatgttggaggggttttcggacacgaataaaaaaactaatttcataactcgtctgaaaaccacgagatgaatttattaagcctaattaatctgtcattagcatatgtgggttactgtagtacttatggctaatcatggactaattaggctcaaaagattcgtgtttaatgctctatgcatatgtccaaagattcgatgtgacgtttttaggaaaaaaaattcgttatatatatagctatttcattggttcaaaaataaatcaatcttatataggatatgacacattctaatatgatgaattcaaacacaaaaaaatattcagattcattatactaatatatgccatatttgttataaagattgatttattttaaaatcgtgatagtagatacttcctctgttccaaaatataagggattttagttggatgtaacgtatactgtactataaatctatacagggtatcataatactactattatgaatctagacatgtttcttatctatatttatattactagcatacgtcatattcaatcaaaatgctaaatatttagggagcgagggagtagggccataggagatggaggacgacatacttgtaaaatcaaaaggtgtttttgattattattctgtgatgaacaattgggcattggagattattggttttgttatttggaacttattcacgaagtggttttggagatgattggattttataggtgatcgcaggattcgtcattttatgtgaccggtcagaccgggatctggtagccggtcagaccggcgtgtaatgcgcggtcagaccggcgcagcccgcggtctgaccagccgacactgtgtcggtttcggtttcgggttgtttatttggatatccgagtttatttcatgattataacttctagatggatactatacgtatgtaatactattgtttgttgctaatgagtcaagttggagatagcttggtctcggaatatagtttctttgtttgttccatatgtaagtgactcgatgtcttgggagagtatttgtggtgatggaccgggagtcggcttggggataagacgacgtccgtggtggtcagagatcatgcaggatacttaggctagagttgatacacgtggttgatggagattctatatggcatacgatggagttattgtgtgcatatgggatgcggagtcgaatttggaaggagtccaaatttggtacgattggttatgtaaagtttctttcttgtactatagagttttctaaagtgtttaggactcctagtatgagtttggtttgtggctttaggctgcctacctcatatataaatagagggggagcgtgaggcttcccggtatcgctttagagaccaattgagttgagttttcagttagggtttcaagtttagtcgaaatttttgtaaggagt

SEQ ID NO: 8527 - DNA, 1070 bp, Oryza sativa
ataattataaactcaaatgttttggatggaaatttcactcattgtagctcaaagtatgttcatgggaatttcactccactacacagtcagtgttgtggtgtcacagtcaggttgggctgtagctagtaggcccaatcagtaagagaggatgttaggtaaaatgtgtggcatctctactatacttatcgaactggaaatacacaaataacccattcgtgggtccagtatttttttccgtttgcttcctgtcagagctccacggttgtctttcattagcaaatttaataattaagatgtaccaaaagtatgcagaattgcctaacagctagttgatggtttcttcagaacaaattgcagctgtctgaacctttgaattaagaagttgaaaataactttggtagatttacgcagttgatgatattatcatctagacttctctcatgatgcaatgccataaaagcaaatcacagcaggctgaaccataaatcagttgagaaaccaaaccctgtattggtataagtaagcatacaactgaaaatttcaattttaaccaaaaatgagagtaataaagcaatgaagtatatcctgaatgagtctaattttttttttgtcggtaattatgttttggtgctttcctttctaaatcgacatagaggtagcatgattctcagctctagtttattcagactctgttatacgcaatgttacgcggtaggaacatttcgctctaccacagatttcttttaggttgattgttattgcttttgctggatcttctaccttccatcctccatcttcatcggggcatttaactttttgccaaagtcagtacccctaattgtccaaatatctctccatcttctactgaaatgaactctgcttccccatgaatcctatcatgctggaacatcaatcaatcaattactagcaagcaaagcataacagcaaacaatgaggaatcgattggaggcttgaagtcgaaatgtacctccgtggaacggggcggcgtaatggcgaaggccgcgggtggaggagggaggggcttccggcgagggcacccgcgccgccga

SEQ ID NO: 8528 - DNA, 1501 bp, Oryza sativa
  unsure (1)..(1501): unsure at all n locations
ttattgcaacggcgcgttccactgcaacatttgatccgtacacagtgaaacatcataagtacactagctgaaacattgtaaaactattggttgaaacatcaaaagagaccacatgcaacattaaaaaaaatcaataaaaaaattaaaatattttttgtcgaaatataataatgtgtggtcttgttgtaaagatttaattgtaacgaatttaggggtgcaatcagatcgtagattagataaatagtttacgataaaaaatcttttgaagaaataagaaaagaaaagattatttnnatctgcagtggcagacagctgttaacagtgaaatttggtaagcccaaagttaccatcggtttagagtcagtatcggcttcaaagttctagaatcagccgatgggagtctaagtcgccacgatgtcgtgttcttagtggagtcggatcaatcaaaggaagcttatctagaagagttcgagttcaagaaggatgcaacatgacagttatctattaattaggcataatttgttagtttccttttatctttaggaaagtgtgtttagtgtccgataaggactttatcttttcctttttagtttctttcttgtccgacgaggactagtatctctctatgggtataaatatgtacacccggggtcattgtaatctatcaatctatcgatcaacaatacaattcagcgcatcgccaccctttttacttctacttttattttttacattccggcggaacttggcacccgacgcggggctgcatcgtcttcgatctccggcgaagggataagtccaatgttccgtcggcctaggcaattgtatcgtctacatcggcgtcgttcaaggttgcatcagtacattcgacctcttggattgctctggtttggatgatatatttgcctacctatttatcatatgtctctgataatccagtcttagcatatcaatttagctctatcggctgtctctcgctttagggtttctgccggtatcggctaaatcgccttgctagattagattagcataggcatctaccatcctaaaaatcagtcatcggcttgattgtctagatattatgtttcttttcatacttagtgctacatcagttaagtttgatctactaagtcgtgcttagaaccataatctctagcctgcttattgattgccaataagggtttcatcggggtttcagccggtaagttatctggacgttgcatcggctcatgaggattgcatatacatataagttggatttagccgatgacaacaaaggtttcactgtttaatctaattttgtggatttcatgacatcggacctccagccgatgtgtgctttaaacttcggatcgatgcttatttatcatatcattgctagctgattggtttatactggattatattattgctatattctatcatcatcagccgatcgcctttatatcattatctacattggatatatagccgattgcttaaaccctatcgctatcggctg

SEQ ID NO: 8529 - DNA, 193 bp, Oryza sativa
atgcagcgtttgttccttcttccttcttggcggcggcgtcctagctctgcaccgccgttaagcaacagccgttccggattccatggacagatcagatcaaattcgttattatctccatctcaagaaaaaaaaatcttgagagctatatatatatcgcatcgctcttgcagtacatttttccatccgtttgcaa

SEQ ID NO: 8530 - DNA, 768 bp, Oryza sativa
ttcgttccatgtcgctctcacgccgtgcgaatgtgccatgatcctgcatgcatcatcgccaagattatattcctcacattttttcttcctatcgctcctagtcgtctgtttgggagcttaaaattatgaaaagcagctgctgagaagctagctggtgagaatctgaagaatttgagttctagttcattctccagattctacaattacagattcttataatttaggtaaaaagctggactgtttgggagcttctgtcagccggagattctgtgagaagctgcagctgctagaagcttccccaaacagacccctagttgtactccagctgatcgattcactctattttatatgcaccttgctctctagcttatcaaacgtagccaagacttgaattttaaagcttaaattgattttgatgttcttttcatcgtaattcacttaccgaccttagtcggcatttgaatttttaaaaataatttttagagctgattttgatttttttttcagcggaatttattttcacgtatgtaaaagttttacctataaattattaattttcagcggagtaagcattagtgttatgggttataatcatctggtatgcttaaaatctctttacttggacttagttgggacaattgctaatgcattctcgtgcccatctctataaatacggcctgctagctttgctcttgtatctgcacacaagaactagctgcaaagtcctcaaggcgaacggcctccatcttctccttccagctcctccca

SEQ ID NO: 8531 - DNA, 1501 bp, Oryza sativa
agacgtcggatgccaccacaccctatgtactttttctacactgtacaaaacgacacagagatgttttttctccacacatgctccctatcatctctcacatgcatgcactagtgtctctcacaaactctttctttccaaactctcttaagcatgcatgtctggttctattaacaaatataaaatatttttctcataaattacatatttaatctatgatccgatggcaccattttattaattataattaaatatttataacaagatatcacttgattatatttatatcctgagaaaagaaaaatagaggcatttctctatcaagggtcaaaatggtgaaacaaaaatggaggcattaaatttcaaccgttaaaatttaatgtttctacttgatagagaaatgtctcaacaagtatttcatggtgtttcacaaattatttaattgtttcaatgactacttttttatgtttcaccaagtgcatcttgatgtttcataggtagtctactgaaacatttggctgcctcattttttcaatagatttttttaaatgttgtacattgtgttatttagatgtttcaataagtatttttccttatgtttgtaaaatgttgcatgttatattcttttaatgtttcaacagttaaaattcaatgtttcatatataatacaaacatgtttcaattcaaaatataattgtttgttattcataatataatcatgtaagatcttgcttgaatatttaattaattgtagtaaatataacaatgtaattatatctcaaattgaaaaggtaatttaggaaaaaagtttaaagattgttaactaagttacttagggaagagaagagaaataagtgagtgtgcaaagagagcgtgtatgtaaaagtgggggtatgtgggccctacatataacatgcatgtatagagctaaaggagaaagctagaggctacaaaagcacagaagtgggcgttcgatttttcgagtttcatcggacgtcttacacatgggtagcccataaaactacttataatcttatattaattgtcataatactttagagaatcgtccccttactcccctccaacaacaaaagaaccgttccctctagttaaagaaaaaaaatcacttcctcctttaaaaaacgctcaaaaaaaatccaaccaattataaaaaccgacatagaaagaaactaaatcatatttgtatcatctggtaccgttgcaatgcacaggtatgtaactagttaaatataaaaacttgaataattttatttagcttttctcttgtaaaattgatgtacagtgttgtctgaagttaatcacaaagctagcaaaactagtacaggattgttgaccatggaaaaaaatcgcacttgtcattattaagagaggacacaatggaaataagagacagttcgctcaccacgactcggcacctccctgcccccgctctcccattatacatactcggtataccatgtaagaggcatcaaatgcaatacac

SEQ ID NO: 8532 - DNA, 1501 bp, Oryza sativa
aagtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccaccggcccggcccggcgaggcgaggcgagcgagcgcgcgcgtgtgtttcccctcttctctccactacacatgcttcaagtggctaggagggcatcctcccttttaaggaggtccccctctcctagaataagcaaggtggtactaaactccacatgcataccatcccatgaggtgggcttttgtgattttccaaagaattaatcttcgagtgggctaaggcccattcattaattccaacaacaccggcatcggctctagcggctctgtattgccaagccgagggcagcctcccggctccttggcatcccggtcagaccgccaatggccaacaaatgatcaaagaaaattttgttgaaacaagtgttgatgcaaatgacctaatgtggcatttttatcatcattttaccaaggtcattacccttcttgaaagtacggcaaagctagaaataaacctagcaaaagttcgatcgcacaactcatcaatcgattgaaaataaaatgctagatataccgtctttgttccatttctttgcgccatcaattttaatccgcagtgatcgtccatggcatgtacaacgtgtggttctaactaaaaaatatcgctcaattaaaatagttagttcataattattgcttgtcattaataaccaaaattaacaacaggggcctagatggttcacatagacccacccacccaaacctcgccacgcatgtgaataattcatgagtcggtctattttcatcgacatgaacctgcaaaagattatatcaataggccatacttggtttcaggtgcatcctattcgagcccagccatcggtatagttgttgatgcaaaaatctgcaccaacacacgaaggcctaggagatctgcttagcttcagtgcaggttctaaatccagcaactaacaacataggtagacagattgtataagatcaaagagccgatcaaccaataagccgatgtgatgtattgaggtcagccgatgtcgttaaggtttttatcaaatggctttagatccaatgtaaattcaactaatcagataactaataattgtcgataggatttaacttataactgatgactgaaactgatagctgatagttgattattgatggttaaagcatacatcggctgaaaacctgatgcaggtagatttcgaatatatatcggctaactaaccgatacatcttatagctgaagcccacaataatgataactcatcggctagaactccgatga

SEQ ID NO: 8533 - DNA, 1501 bp, Oryza sativa
aaaatagaccgactcatgaattattcacatgcgtggcgaggtttgggtgggtgggtctatgtgaaccatctaggcccctgttgttaattttggttattaatgacaagcaataattatgaactaactattttaattgagcgatattttttagttagaaccacacgttgtacatgccatggacgatcactgcggattaaaattgatggcgcaaagaaatggaacaaagacggtatatctagcattttattttcaatcgattgatgagttgtgcgatcgaacttttgctaggtttatttctagctttgccgtactttcaagaagggtaatgaccttggtaaaatgatgataaaaatgccacattaggtcatttgcatcaacacttgtttcaacaaaattttctttgatcatttgttggccattggcggtctgaccgggatgccaaggagccgggaggctgccctcggcttggcaatacagagccgctagagccgatgccggtgttgttggaattaatgaatgggccttagcccactcgaagattaattctttggaaaatcacaaaagcccacctcatgggatggtatgcatgtggagtttagtaccaccttgcttattctaggagagggggacctccttaaaagggaggatgccctcctagccacttgaagcatgtgtagtggagagaagaggggaaacacacgcgcgcgctcgctcgcctcgcctcgccgggccgggccggtggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgtcgtcttcacgcaacacttgcgaaatcaatctagggtttatctcctactttgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaaccggtctttccgtcacctcggtacgtgttcaatacgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttacta

SEQ ID NO: 8534 - DNA, 339 bp, Oryza sativa
ggctgccattggaccaggcatgctcgagctctccgtcccgccctcgaacgacgagtggtggtgagtgcacctgacactggccgcactggcgggatcctcccgcagcgacgagactcgactggcatacgccacaatggcccaatcagagcatcttgagtggtgtgagcgggcaccctgaacgatttgtaccatgctctgatatgcagcgacaagtgaggaagaacaacaagcaaacatccaacaccaattaactggccatccattaccagggagaaaatgtataaggaggaagaaatcacaccagacatgcagattcggcactgagatagaaagagcatc

SEQ ID NO: 8535 - DNA, 1501 bp, Oryza sativa
tttactgttcaagttcaacaatcttcagagaattctctgctgttctctaccgaaagtccaaaaaccgagtgagctagagaacgatttgttaatattgatccacccgtctgctcaactgttcttcttcatcagatatactccacttcaatctggctagagctcccaaattaatacccttgctgtagcagtgttgttggtgtctcttcatctgtgttcgttgaaaatttgaagggggctgctagaacacgtcatacactcgtaccatcaataagggcaccctcaatggttatctatatgctatctacaagagatccatgtcagcatattttcctacttggaagagattaaatgaagagagagagcaaagttatctactaacttagagatagtctatagagaaaaacgaggcaatgaattagagagctatagatacccatgtagacataccattgaagtgatttactattaatctagtctattgctgagatgtacatgttttatagatagcacattactttaccattgcgggtgctctaatcaacggtataatgaggggcctcatcggttatccagaacttattataacccgtaacggcttattagcgacaaaaagtaatttgtgtgtacaatttttatatatgatcttagcaacttaaaaacatatgtccacaacgtaagcatatgttcttaaaaaaaaaagtaagcatatccaaccatcaccccttagccctcacattatgtccacaatatatcaatatatatatttatcatttttataattcttgatatatattcatctatatattccgcataaaagagtaggatatcatttaatttgttcatcattcaggattagtattaataaaccttaactttttatcattttttcctaccttagattcttgcgatgcaaatattagccaacaacccaatatttcatctacaattttctacacagcctactaaattttatttttctccaattgcttggctaaccagttttatctattgttaataactaatattctttttactcctagctccattgttgaaaaaaaaaacatgttgaagatgagtatttagtaattcttgtagtgtgggaaatcatcacctagatagtaacaccagtgacgatttcgatttcgaagatctacaaaaattcttaatttaattatcgtttttgtcaactctcaaaggtcaactcctcctcttggctttctttgctcttggagaagaattgctccaccaccaacctctgaaaatcatattctgcttttacatctatgtaataaaagaattagtagaatgtttttttctaaacaacaagataccatgtagggacagcatattccatcttgaaccagactcaaacttttaaaaaaatgaaaaataaaaagcccactaattctgagaaaaaaaaaatacagctagctatcaccgttcacattggaattggatattacacatgcgtgtgcatgtcgggctccaaaacccattctgc

SEQ ID NO: 8536 - DNA, 1501 bp, Oryza sativa
tagtcggattcttagtagattcgattaaggaaattaatttattaaaagaagtcaccgagttcaatgatgatgcggcataacagcttatctattaattaggaagactttgtttgtttctttttatctttaggaaagtgtgcttagtgtccgataagtactttatgttttccttttatctttaagcaaatttcattcttatccaagaagaactagtatctacccaagagtataaatatgtacacacagagtcattgtaaattatctctcgatcaatacacgcatcggcttcttttacctttctactttttcgatgagttcttgcttcaagttagggcatcgttcgatcttctgacaacaactatgacttgtctcagcggtttgcgttggcagattagggcgtcactttagatgttctaatctatcttctacagccgctggttatcatatatcttagttaatctagtatagtatcttaatttgatcatatcggctgagattcgttttagagtttatactggtaccgactaaattatcttgctagattagattaactaaggtatctaccactctgaaaatcagttaaatgcataattgtctagatattatgtttctttcatacttagtgttgcatcagttaagtttgatctactaggttgtgcaagaaccataatctctagcctatttctaattagggtttcatcgagatttcagccgatgagttatctgcgtgttacatcggcttataaggattacatgcaaattggatttagccgatcgcaacaaagattttactgtttacctaatcgtttggattttatgccatcaatcctctagccaatatatactttaaacttcggatcaacacttgctctatcatatcatattattggtcgattggtttctaattgtttatattactgttttattacaattttttaaggtccatgtggctcgcttgacctaataattattattaaggagctagctaattatttatttctcgatgatcaactcaacttagctaacttgttatatagcacgatcggtctgatctgaaatcagggtccgctctggagcgatggcctagggcctaattataattagggcccctgcccaggtatataccttgtataggtatgtagcccaattatttggcaggaataagttcacttagtgacccttaaaagtgatcaaaatctaatctgtgaccctaaaccacaaaaccggatatctcgacccctaaactcttaaaaccggtacaatttgactcccttagcagttttggaggacggttttgctgacgtggcgcctacgtggcggtattaaccaggtctcctttacacgtggcgttgaggtggcatttaaaatttaaaaatatatgtgggacccatttgtcaatgacacataaaaaaatttgtgggatccacgtgtcacttctctctcccctccctccagttccttctctctccacgccactccctctctcccgcggcaatgcggc

SEQ ID NO: 8537 - DNA, 1501 bp, Oryza sativa
tagcatccggaaaagggcaagtcaaaggataattaggatatgctgatgccatggtaaatgtcaaaatattttaaagcttgctaggttatcacttaagagtctctccaccgagaattgctgcaagaaaaaggccatcaggcttcaacgacaacctacactgccatcaagtataaccagttcattcaactgagaatagttgtatattgcaaactatgctagcaagaatcaaactaaaaaaaaattcacctgtatcattgctccaggtagatcatttgtccaatgaagcccaagacaacttattatcgtatcctgcgagcttcagagaccataaccacattaataatgacatgagcaatatgcagataggaagatcgggaaacattgtttgacttaaactaaataattgtgagaactgcatgatattacctttattaagtagaaatgtggaaagataaagagctggtttgcgtatccaatttacgaatgtcatattttcaactaaaggtggataacattactaccgaatggttgattgccagaatcaacaaatcaagaacataataatgccctcaataatatttacatggaaccaactaacatactgaagactaaccattgctcccattgatctttacctttctttgattggaaggtattcttcatctccgacgacaaactgcgtctcgaggacgtcatcggtagcattatccatctctcgccactttctcaccatgtcggccgacatgtccatcatgatcagcttctcaattccacctgttacacaagaaaaccccaattcctcccatcaccacattacaacatactccctatcaagttaaaagctggaaaaattcagcgattctactggtgcatatgtagaggggttgtcacgcaagaacaacaagaggagatagatttgaggagctcactcaccgcggccgcggagcgagcggcggacggcgccggcggagccgccgaggcagagcgcggaggggaacgccttcctgcagtcctcgaggcggtcgaggaggttgtcggcgacggcgtcggcgagcgcgtcggtctcccccatggcccacgccgcccggtcccggtgccgccgcttcaggtcgcggtcgaagatcttgacgcggccgccgccaccgctcccgtccccgccgtccagccctcccgcgggagcagcggaggaggagaggtgggcccagcggtggcgaggaaggtggaggaggcggcggcgggccgccgccgcggcgagccccgtggccatcgcgagcgccggcggtggtggagagagagagggagagcgagcgtgttatgggcctcgtggacatagccacatgggcggatgggcctttgtggctgtgatttgcttttttttttttagggatgggctgtgatttgctgaaaatggagcttaagtacggatacgtaaaatatggttaattgatttttaattattacttcctccgcgttttataaggtaagattttctacccacact

SEQ ID NO: 8538 - DNA, 1501 bp, Oryza sativa
ggagtaagcttcaactacctccatcccaattttatttttttttcataaatatttgggtttttaatactattttcccacatgattatcctatttaatttttaccaaaacttaccctattcctaactatcctctcacttagtcttgtatggtataggcagcaaaaaaaaatcataagacaaaaaaaaagatcataagacaaaaattgattgtaaaataagaccattcacaagtcacaacaccacatcacataggagctatgtttttaactcagtttgtatgggtggcttgagcaagacatgtgtgtcttttgtaaggtgtgagtgctttagccagccctcgaacctagcaagcgaagccatggcttaaggagccgcgatggacacgttcgtgtgtttgccgcacgctttttggctagccagtgcgtgaacttcctcccaatcatcgactacgtttgatgtcacgactacggtatttatacagtatggggatcgttggtactaggatatatgcgagattgtaataaaagatatggggacgaggatttttatacaggttcgggcccctgaattgttaggtaataaccctactcctgttggccgaagccggtcattgctcttattcaccataatcacaccagtacaatatttggggtagccaatctaactgttgtcgacttggcggtctgaagtgttgactcgtagtcgacaacatggtagccttcctcctcgaatccgcatccggcaagatcaaagacagcgctatgtctctcctgacagtatccgtagacaccataggggactagccatgcttatctctgaagtcgatatccggcgtcttgtcttagcgcatgttggcttgtatattgatcttgtgtcttgatctattgtatttatacccataggtatccccttgtccaagtagaactaggaaaaccaatattgatacaatccgagtagtccttgtcgtttccatgtagaactctattcatccttccttatgcggaactcctcctatatccgaaggttgtttccgtataagacatggtatgtagtgggtcctgccgagatttagtcaactactattaggtatgtggtatccataaccctgacagttactctctacctactatcgttctccgttatcctcgcaacctcaatgctatcatccatccaagttcagccccaatctctcatcccaatgactcaatacaaaattagtgtatacaatatactcataggtaaggatagacacgtggcctcttacggtttaggttgtttgggcagagaacacatttttctttcatcaaaatggatgctactaagggagcattagctgactttatagctagggagtttttctttgtcataatttaaaatgttattcgtaaaaatgcacaagaaattcaaaaacaaactctctagaaaatgcaaagaaattgaaaaagtaaactaataaaaatctctttagtctgtcgtcaacaaccaccatccttcccaaccgt

SEQ ID NO: 8539 - DNA, 1501 bp, Oryza sativa
gttggaaaaaaaaaagaaaaaatcgcaacgagaaatgaagggaatgtttaaaaaatgggtttgggatatgatttcccaccccctaaagggtaagttttaatcctagccatccattcatatcactccattttatcctattcctccattcatttccatttcccaatcccacctctcctaacccattttccaaacacacccgaagagataatgcaaggcacacattccgagtcatggtggatcccggaggacgctagggaaggggagagatggtggtcgcctttggcatgacccgctttgggaggtgaagctggtggtcgactctgtgcctgtcggtggcatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccgcttctgcctcgcccccgagggccgaggcgccccgacccctcgcgggttctactccgcgtgaatgggttaggtgagcacagcggggctcacctaaccgcatttattgcggctcggctaaacgtgtcacgccgcacgaaatacagtgcactccactcgtttatccggtctgtgaccagtcacagaccggtcagatcgcgggttaggtggcgacaggcggtctgacgcacgcttcgccccatcccgtcaagacgagagcttctaggcactcgtccccggctggagctagcgtattacatcccagagatggcacgttagccccggtcgatatatgccaggcttcatcctaaccattacaagcaagatgttgtgtgaagaagggcaaacatgcacgttgctaggctgacgcgtggtgggcaagaatgatcgatttgtgaccggtctgacactggtcatgtcgtcggcagacagccactttcccacgacgcgcctgcccccggcagaagtggaggtaggtatgggccgtcccgtcagaaggatgttcggagggcaaccgtgcaaatctccgtccatttatgaaaagaagaaaagtccagtttggaaagagaggggtgcatgtggtatccccttgaaatataaaaggaggacctggcccattaaaaagggggttggattctttccagattgggtagctagaacaaaggggaggttggctcacactttgtagctccttgatacacagatccaccaaaacacaggagtagggtattacgcttctcagcggcccgaacctgtatacatcgcttgcgtttcgtgctctttcgataggtcgcgatctttccacatacagtgagagcttgggatctcaccctgagcccccggccgaaccggcaaaggggggcctgtgcggtctcccggtgaggagccccgcgctccgtcatctggcgcgccaggtaggggcctctgcgagtgattttcggagctcttgcgctctttcgtgagcaccaagcttttcctgttcagcctca

SEQ ID NO: 8540 - DNA, 1501 bp, Oryza sativa
gaaatacaaacgacaaggcaaccaatgaaaagggaacgagaaaaacctccccaaaacccagaaaataagaggaaaaatatagccaggcgcgaacctaacgtggattgccggggttcaactgaacccctaatttttttttcgattcgaaccgagacggaggcagatggaaggaggttggccgcgtcgatcgatcccccaccaaacctcctcgccggccgtgcgcacgccggcgccaggccgcacaggccacggaggaggagggtacgggcggaatcgggaaggggaggacgccgtgcacaccgccgcctgcgccttctcgcagaggcgacgcctacctgcagctcgcactgaccatgggaaaggggaagagagagtggaggatcaaggatgaagacacggatgcgagaagagagaaatatcagatggaggtaagacgggttctcgtctttcgccattttctagctgatagaactagaagatgttacctgcgaaccgcgccatgcagtctagggatgaaagcggatcggatatatacatcgattgaaccgttaagttttaaaattttagtgacaccaaaccaatcaaatatatttttttaaaaaaaaagactgctatataccgaaataccgttgcaacggtatagcatgtcatccgcacaccgaccgtgctttatctggacgtgcatgctatgtaaaatactctactactctctctgtcccaaaatatattaatttttggctataaatctagaaacacagttgtttagattcatagctaaaaatgcttatatattttagaaaggatgtagtagaaggaaagcagagcacgtggctcactcgtatacttccagccaaaagccaagcaaatgagcagagcagtggagaggtagctacgtactgtcctagtgtccttagtaggccttggttattggttggcccatgattccatgactccatatacctactccataagttcattttgtatcccttaactcatatccctaatgtaattgtatccctcagccacaaaaccaggtataatctgtctcccaactcttaaaaccgttacaaatcaacttttcggacagttttgtcctacatgacatgtttgaccctgttgactgttgagtcaacttgtggggctcacttgtcagccgaccgcgtgtggaacgaggtaaccaataaaactgctcacacggctaggcggtggtctcgggtcgcaccaatgaaatcaacagcgaggacatgctcctgctaatcggttggtctgcagctccatcctctccacgaaggccgtcatccatgccatctgtttccacaacggccctggccctatgcagccgaggcgaccgccgggggcccatgatggtggaggggccaacacctaatactagtagtctagtacctcatccgatgttgagatcaatgatttttattcagaattaaaggtgtgattcttcgatgttcgcgcctgaaattctgaagttcgttatggatgcaga

SEQ ID NO: 8541 - DNA, 1025 bp, Oryza sativa
gcgcaggccgctggcagtcgccgatcgccgcttgtccgccgctggatgggaggggaagagggggaggagaggggagaggaggataatgaaggggaggaggggagagaaggagaggggagtgtaagaggaagagataagatcggatctgagggaaggagaagaggagatgttccgatcttatctaaatatttcgtctgggacttaactgattaaagatgggagaaaatatttactcccggttggtagtaccaaccaggactaaagatctaaatgatctttagttccggttgatagtaccaaccgggactaaagttgttatctttagtcccggttagttgtatcaaccgggactaaatatcctcggccccctggcaggcttttgacagggggatgaaccaggattaaagatcatctttagtacaccaaccgggactaaagatcaaaaattatttaaccgggactaaagattatctttagtcccggttctttttggaaccgggactattgtggaaatcgcccgaccctccaaagatcatttctccagtagtgtaattggcacatcttaaaagtgacaaataattaaatgtcccctttaattactgcctgatatatttcaaatctatacttctccgcagagggtgatacaatataagtggcaaaagcgtgatgattgttggcttagtgccaatcggacatgaaagaatttgctcgaattttttttttaaaaaaaaacagtaaacaggtatactccatcatgcaagtggaaatctcacataaaagaattcgtttatggcaaaaatgagatgtgtaaaaggagaattcttttaaacttcagtgcttcattttacttcaattcaattgtaaaaggagatgtgtcgataagtatgctgcagcagaaggtacattttcccttttgtgaggtgccataaatttctggtgtatgttgaaggacaaaaattataaatacactattgtgctctccagtgccaccctcttaggtaggtaaaaggaatttatacatgatt

SEQ ID NO: 8542 - DNA, 1501 bp, Oryza sativa
acataattttaaaattttgtattacctttacgaaactactaatgtataatattcatattgtattttatatacatgttagttattaattatttttaatatcaaattttagttatttgtaaattatattcctatatggactctagactcgtcttttaatatttatttgtttttaatttcgaattttcgttatctataaattgtatttctatatagactctaggcacttcttctaatattatttatttttaattctgactttttcttttttctaattgtatttctatgtggaatctaaactcatctttcaatattctttaatttttaatttcgaatttcagttacttctaaattgtattcttatatttactttagattcttcttccaataattttttaatttctaattttagttatttgtaaattgtacttttatacgaactctaaactctacttttaattttattatgtttattccgaattttagttagttttaaattcttatatggactctatactctacatcgaatattccttatttttaattctaaatttctattatttcttaattgtatttctatataaactatatactctacttctaatattccttatttttaattccgaatttctattatttcttaattgtatttctatatggactctatactctacttctaatatttcttatttttaattacaaatttttattgtttctcaattgtatttctatatggactctagtgtcctcttccaatattccttattttttaattccgaattttctattttttttctcaattgtatttctatatggactatagtgtcatcttccaatattccttattttttaattctgaattttaactatttctaaattgtatttctatatggactcagtttttctttttctccaattaatatgagaatttctaggctatgagagcgaacgtggaggctcttttttctatttctttaataagttaatagatttatctctaattaagttaaaagtgtcatctagcaaattcctaattttttagaatatcttttagtcgtgacatgttttttctatgcttatcagcaaattacacaagttttgggtgtgctgtagcaaaatttaccgatgatctatggtgggctgtggccgcccaaatttattttcacgtttgtaagcccatactgtcacgccggaaataacaattcgtttaatcctaaattgggcttttagcccatgtagaacaggagtactagtacaccacaaagagtcctttatggtaacgatttcgtagaattttgtgatttaggcgaccagaaatcagttaatactcggtttgagatggcgatgaggcgatgagatcattgccttttcggtcgaatctagcagagcggcgagcaacccccacccactttgactccgatcctccccgcccccagcgcgatagcccatccgatcccaaattccggcgagatggcggtcagcctgtggcgcgcggtgatgggcg

SEQ ID NO: 8543 - DNA, 1501 bp, Oryza sativa
tgcgatttgccaagttgtttgatattgtttgcagctgatcgaaattcgctcctgagcagctgctttggtatttacaataccatttgaaattcggaaacttttctgaatatctgaattatgttcgtttttttttctctttttgaaacttggatggttttgcttaatggtttgttgatgcgaactggagtgaatatcatttgtactcctgattcagcgttgtctgccattcagttttgacagcaagcacagcacaaacctgaagaatgaaaatcttcaatgcttggactaaaagtatgtgggtgttctttcctttcgcaatcttattatgcaattgcttagtatgttggttgttttaattggattgggagtatgccaatccagatggtcgttattaggggctgtgtagcaggacaaaatttgctctcaaatcaaaccacgactctgccaaagtttttgtcacctaggaccatatgtcgttggagttttttatttgacaataattgtagctacataataatctagcactctaataacgtgtcgtgttcttcatgctgaaatgtctcacatatttagggtttatctctctttgatcatccttgctgggttattgccttgcaatttgcaatttgtatcggtgttgagcgcagggtttgcagcaaaccttgtgaaaaccgtttgaaatatggaaactatgctgaaattcgaatccagtttgatctttttttttctttttggaacttgggcggttttgataggaaggtgcaggtaatgtgccccagatcttctggtacattgacagtgaattacacgttctatttatagtcaaatttattatttttgtttatacttgtataagtcaaatttaaatttgcatgtttgtgaaatgacatatcacatattgatctatcgtaatatttttttttcaatttttttgatgatttttttaagtaacatgcaaaaatgaggatatccccttaatttatgaattgagttttcaatgtataggactagactactacagagcataggactgttccttttcatttacctgtcccgtttcagttatccgtatagagggtattaggacaatttataaacaaattttttggcatgagcatgagcatggccatacatgtactattattaattcagcataagcatggcaccgtatttttgtttgaaattatatttttcagagctttagtttcggactttcggttcactaccctttccagtgtgtgtgcactccaaatgaattttcagaattccgtgtcggactgccgtggccatacgcaatcggaatcgccagtatcactgacgccgctgacgagtcggagtcggatctcctttgtatcatcacccgccgctataaaagcataaccatgccccataatttctctcaacttctcacggatcgagggagtttgagacctcgccgtagacagcgggaaacgcgggcgcgcgcgcgcagcgcaggtaatggccgccgccgtcgtcgcga

SEQ ID NO: 8544 - DNA, 1501 bp, Oryza sativa
aacataataactaggcctgtccccattttagaaactgcggtcgtacccgttcgttcgacataagtacctagtaaaacttatatcgatcgagacagtagtagccacccgaaaatcaaccaaatcttacgtactgtcccaatctaagtataaggtattttaaccagattgtaagcaaaataagcgatactaaattatctgggtttctatggttgaattatgcatataaaatagaatattgaatagaaggctataaataaataatttgtaaaatataggattaaatgatcaaaaggtatatggtaacttgccttgctcgatgtcctgagattgattgatattatctattgagtcagaagaatcctcaagacctagggttagacatataaaattcaaatccaaaaggaattcaaattaaatccaaaaaataagaaaaatagagaaaataaaataaaatgcaaaaatagcaaaaaggggcttaaaagatagagaatgattttagaagaatattggtccaagtttcactggaattggatctatattttaaaagatatgggcttctaaagtttgaaaatcaaataaaagtgaaatggcactgtgtgcgggtcccacttgtcagtctctctctctctctctctctcttctcttcttctacctccggccgttccccaaaagcggccagcggcgctagggttggcgattgcggcagcgatggagggaaaaaggggttgcggccaaggaggggagggagctagggttctccggcgacagcgagcggcggcggaggggttaatttgatatgtggacggcctagcggctagggcggcggtgacatagttaagccatgaaggcgattgggatggtgtgagttagacatggctcggagagggattctagagaatctacggagtgcctagatggattccgacagcttgccgacctttggcaaggcgcggagaatacttgccgacgagcacctcccttggcggcggccgtgctcacgtcggcagcccaaagggtgtcatggtagtgcaaagggattgctaaaatggaatctagggagtacgtagatggttgaaacggaagaactcaccgagatatgccgagatgaaggattgcggccggaaaaacttctcggcggcgaagaacagagcaacgcgggggcggcggtgctcagcttggtgcggcgaggtaaaactcgatgcaggacttcggttagggtctaatatactagaacatagttgatataaggtgttctaaggggtatttagggtggaggatggatggaggggtgtggagtcgatcgcgcacaaggtgttcgaccgacgggtgatggtggttgatgagatggattggtgaagcagagctttggggttgtggggctattggtgttgatgatcgatgatggacaaggaagggattggggtcctatttatagggctaggaggagcggatgagctcggacaccgtcatcgccatggatgagctcgatctttggatatgg

SEQ ID NO: 8545 - DNA, 1501 bp, Oryza sativa
ccgctgcataatgtaagctaaggctaacactgctaagctctgtgttgcttatgtgttcttccggttgacaaactaaactgaactctgtttttcttctgttaaacgtaaactgaacttttttagagagaggtacaaaaactcttttttttttctggtgcgcaaacatcaggcactgggccaagcgccgaaggcatgtaaattggcaagtctaaaggataaggcctactatagtccagtccaggaggtcttgctggcccataaacaagcggggactttggtattgggctgttattggaattttttggcccaatggacttggacaattctatctgtaattgggccataaagtgagttcatttaacgttttgatccatgttttatgcctgatttccactttgttttgttgtttctcatgcaagttttgattccgcaccgatattcagttttgctgagacatatggcatttaataaaatgcaactaccaactcccatcctacacatgcgtcatgcgtttccaacgtgccttggggcattccctcgggacaacattgttcacaaactacaattctttaccctgtcaccgatgaaaaatatttcagctacataaaaaaaaagtcgcactccagtaaactatgaaaatagcctcactagcatcgtcacacactattgttataaaaaaaaagagtagcatctttcgcaacgcggataattttatatagatagaaaaatatcacatcacatgtactaaattttatgaaagaaatatatttagtacaacaattttgtccgtatcatgtttgacaaaacggtttctctcgacagggatgacaaccacaacaaaccacccacttgaacacttgctcaagctatattagaagtagactcaacagcataaccgttaaaaagagttgtttgatcagtgtctcgatcggacgatccagatcaagactcaagagccacagtgcatattccactggtatatattcgcatatatatatatatatatatatatatatatatatatatataaaacacaaattctgacccctcaaaatcccgaagacatgtttactcaaaaaggaaagcgtaggaggaagcttccctgtagcgcacgcctagaaccttctccccgcgccccgcccccacaccgacctggactcactggccgcgtcggtccacgcgtggccccaccgctcagtgacacactccacccacacccgcacgcaacgcatctccgccgtccatcgcatccaccccgcgtcgctccccgccgttaaaaagtctccgcctcgcagccgattccttccttctccttcctcctcttcttcccctctcccgaagaaagaaaaaaaaggaaaaaagaaaagaaaaagaaaaaaaaaactcgagctcacgcgcacacgcacgcgacgcgacgcgaccccgaatcggaggcgaggccgccgactccgagcggatcgggccgaggtcgacggcatgggcggcggaggaggcgaggccg

SEQ ID NO: 8546 - DNA, 1501 bp, Oryza sativa
ctaaaaaatacttgagagagctcttgatcttctttttgaggtgtgtgtgggaatgaatgagagaagggatatttatagcccatgaggtgccttgggagagtggagatgctccaagaatcctaggagcatctttgctctcctcatgacaagtgacatggtcaagcatccaaagagcatatttcatctcctcttgccatgtgtccatggcagtttcttcaggtagaattagctcgaaccgtcataggatgccggtagtaactgcctggccgaaaatgggctggattgggcaagttgggggttcagccgaaccctggctggctcccctggcccacaaccttcttcaggatgttgtcatgtgggccccactttatggtacacaatgttttgggtcagaatgatagctcatttctgagttcttggcccatccatccataagtctgattctcgataacgtctgtttgattgatcgattattgtactgtcgattctcctccattttgatagcttctcctgcatggttagttttccaagcatatagtggaatagaatattttatttatggaataatgcattgcaagcatagttagtcctcattaattgggtaatattgacagccgaaactggtcgataacgaccgtcaacaatgtgttagaactacgacccgacaaagatgactttaaatcaatgacgaggtatggttgtgacccattataggtcatccgtgacgtgctagaactttcacccgacaaagatgactttaaatcggtgaaggggtatggttgtgacccgttataggttacctgtgatgtgttagaacgatgacctgacaaagatgatttatatcagtgacggatcatccctgatagtcatgtattaaatgggatactttttgaaccgttagagatgcgtcatccaaaataggtcatataagctcgacacatatgactcgtcaaggatggccgaatctgtactagtgtttacaacattagctttcatttctccaggtggaccataaaattcccacttataaaccgattggaaaaatagcaggagctgctatagttatagccccacttgtaaaaatcaatacttcgtacgtgaaaatttcatgccccagcataaaaaaaatctaagccccatctccttatcctctcctttaccactcatttctctcccctccccctgccacttatctctctctctctcatgctaaacccaccacttggttgcagtggcggcgactttgacgaggaggagcaacgacggctctaacaaggaggtgaaaaggtggcggctccgaggaggagcgatggcgaaaatgtctcagtcatgatgaggaggagcatcgatggcatctcagcgacgaggaggaggagaggcggggcctaggaggcggatcaggcaacagagcaagggttgtggtggcttggcctgtgaacggtggatctggcagagaggatgatgactgtgtcgacgcaacctcctttctctctccctcatg

SEQ ID NO: 8547 - DNA, 1501 bp, Oryza sativa
caaagctgaacatgcagagtgactctttggacatgttgaacgaggcatcacagctagaagagaagaggcaaaagagcataaaaggtccatgaagaacttgtttaggctcagagaagcggcgttccagaagctggcacttatctgtagtatattgcggggttaggagttagaagacctatttggagaagatgtttaccggcgtgtcgtatgattaaaaaggaaaacccatttggtttggcttcctacgataggagatgcatttttttggacccatgtatataacatctgttgaatagttagagcatgggagttcatttgtggtggctaaagagtgttgctggttgttcacaagggtccttgtaggtaaagttaataaaacatgtcctatgtacagaaatatttgtttggaagtacaccaatcccatataaatacatatttgtgtgcatcgcagtgccgttcttcgacacgccgtaagggcttgtttgtatatgttctttttctaaaattttgcttgtttgtacatggttatttagttttttcaaagatgattatattcctaacatctgtatcatgcatgaaaatggtgttcaatgacatttgaagctgcggcagagagttgtgcatgacaagaagtcatacagttactataagcagttgtgcgtatgatagtactccctccgtttcataacgtttttcataacgttttataatgtaaaactttctagcattgctcatattcatatagatgttaatggatctagacacatatatatttagattcatttaacatctatatgaacgtggacaatgttagaaagatttacatatgaaacggatgaagtagtatcttctaaaacctgaaatcaaatggctgcaatggaccaggtctctgtctactaagaattaaaaggccgaagaccatagtacttagtaggctggaggcccaattaaataatgccaattgggtttgatctaatgctggttttcaatgtggttgtgtctgaacgaacgggtctcaccgtcgctgtgcaaatctgacccaatttaccacaaccggctgccaatgccatctcccctgcttggctggagcggcgcattcctctgccttcctggaaattccatgcctcgcttactaccatccacagaaacgatggaaattttgaaaactcatgtgcaaacgccaaaacgccacggaaacaaatcaacaatttcctctcctgtcaatgaacttgtgtgcacgacaactcatctgacagtgatccatcgtcctttttctttgactcgatgactttgtgagagatgttttatgccgattttatctactaaagtacttactaatcctgcggttgatccatcgccgcgcggttcacgcgccaaatgacgagtcgaaatgtatgcgtagtttgaccacatgcatagctcactggagaagctattagctatatataccgctgcaatgctcgctagcttagctaagcaactgcaagtgaagcggcgaca

SEQ ID NO: 8548 - DNA, 1501 bp, Oryza sativa
atgtacttattttaaaaaaatattgattatcaagctttatcttcagccaaataagccatggtctttaaaaataagctttacaaaatggattgttttttatgtaagtctacattatttaaaatgtacttattttaaaaatattaattatcaagctttatctttagctaaataagccatggtctttgaaaataagctttacaaaatggacatttttaaataacgaccgtactcgttttttacataaaaaaagaccaaatcgaatttatgataaaaaaaacaccttttcctcgttcaaaatataagcattcaaagtttatatcagaatatagcaagagtatccgtcccttatctcaaccaatcataatatttcttatttaatttttccacttactcacctagtttatatttggtcttcagctaagaactatgtaataatggctatagcttctattgaagtaaactggattttatccattttctaaaaaactcacctagtttattaatacttatacccaattccaaacatttttttagacctacaatgacggggcatttctcaccaaagtagaactaacaaaaaaaaatctactccaaccccgaaaactttatttctagcaattcttcattttgccaaagttatataaatatcgtaaaatattttacatgttaaatataactatatcttttggatccatcaaaacatgacaatttaaaagctgattccggctatcggttggcaaaagtgaagcatttattaactctctttattattttatttgtcgatacttatcaactgcattagtgcaaagagacaggtagagtaatgagttttctagagattctgatgtgcaagggacatcacaagagcttattctgattgacacgtggcaaaattttggtgatgtttagctaatttttcagtctgccacgtggcccaataacaagctagaatcatgaccctgaaatcggtattaaagaaagatttatcgggaagacattcaccttgggagattgcaaaggtcaggctccctgttttatagcgatatatgggagattgggaggtctcgggggcatatgttccaataatgaaagcgggagtgtggatgatcctgtcgcatgtcattagaaacaagggcatattgattggagtcggcatggactgtgtcccacacgacttagtcttttttgtaagtaaagattgactaatttgcatgggtatcccatattaacttgtaatctaaacaaaacttgcaaactgatatgaagaaatgaagctagataaataacatgtctgtgattcaggagtcgggaacattacactttacttcctctgtttttttaactaactaatgtcatgtaatgtaaataaaaatggagtgagtatctagctaggttcgatcatcatagaccaatttatccctgcaggggcgaaagaatgtcatcaagatgctgaaagaaatactcgatgagaggaagaacacacaagagccccatgaaagcg

SEQ ID NO: 8549 - DNA, 1452 bp, Oryza sativa
  unsure (1)..(1452): unsure at all n locations
ctgtggactgattgcacctacgagatggcacagnagttcatcattttagacgcaacgtcttttcccaagctttctcctcaatatcaagagatgttgttaactccttaacgaagtactctgtctattgcttttaactacattacccgaacttctatatgaagaaggtagctttacaataaaacgcacatccacaaataattcacttgtagttcaacgagacaattttaaattgatggtaaaacaacagatgtatatactacttagctagctatagcgataagtacttggaagagagaattccttatatactattggaatttggcctgatccctgatatgccacacaaaattggctcttcccttatatgccattgggtcaaatttgagcaccctcttatgtcacttccatgagttgaccgtgttgactgttaacttgatagtaaaaagacgtatttacccctgagttgttagacatgcagtaccaatatatgacatttttttttaatttggttgacatgtacatgtatatacaacatttcagcatgcattacattgaatatatgaataaatttcagcattatattgattatatgaataattttcagcattatattcattatatgaatactgtatatacaagatttcctgtgttgccacaatctagggttttctatcattgatgaggagaaatattgggcttggccatttgggccatattctcaagtttgggccagaggttattttggtcatttatgcaaaaaaaaaaaaactgacagatcaataggtgctaacatcagtcaacacacggtcaactcacgagagtggcaagaaggtgctcaaatttgactcaattgcatataagggaagagccaattttgtatggcatattagggatcataccaaattccaatggcatataagggattctctctacttgaaaatagatttgaaatagatagagtagttcatttttgccatggaaatattgaccgtcactcgcctattgacctctttcttaaatcatcaactccctgcagcaaagagagcaggatcatatatatcaatatttgacgtatcattggatatatatagatgagaacatatcatatacacctaatcttctagtgcatactctgtacacatcaattagcaaatgtcatgtaaaatgccgtcatctcctgcacccgggctgttaattgccttgcgtgaggccctcagatcccgctgggttctttcctgatgaaagggtgttagtgcattacggtccggattggttgctgttaattctagacagaatgaatgacgacgagcggctccagtttctcctgctcatttggcgtgcatcatggcacctgaggaatgatagtctgttcggctcaggtaagagtccaatccaagcttcggtggtctttctgcagggtctgtgggagtctgttgttcagatcagaagcaa

SEQ ID NO: 8550 - DNA, 816 bp, Oryza sativa
tttcccgttttaatatgccatgaacagttgatggctgtactttcactactttcccgtttcaataagggcatgtacaaaggtagagtcaaatagaagctctatatcatgtagacactagtatcctacaatagttagagataatatggtctctaatcattaatgtatctaaatattttttcttactcttctttcctttctttcaccaccatgcaacaaaatttgttctaataaatgctaagagtcgactctgagctgttgtcatgcataacaaccatactcctttatctttcttttatatcatcaaatttacttatatggtaatagagagaccactaataaagattgttgtacctgtgctaaggcatgaatagtttgagcctgaattagggattgccgcgttccaacaggcagaaatcttcgtcaaacattgtgacccggatcacgtggatcacatcgctcgcccctgaaaaatactgttatcgtcatcgacgccctgcgtgcacggtgcacccgctctaatcgctaatcctcgcggtccatctgtactgtacgcttatcttgtcataacactgacatctctctcacgaatcgcctaaactaatgatcaatcagttatcacacaatgtcaccatgtgaatgtgcagtacaacacgtacgtccctcttcattccttgacttcttctcgtaagttaagatatgccgcttctttgcgttcacaaggacaaggtgactatgcttgcacgactttccatgccacggcaacaaggatcaaacagtagtcagcaaaaatacgggtctataaatacacgacgtctc

SEQ ID NO: 8551 - DNA, 208 bp, Oryza sativa
ctgcagcccctcggcaggcggcggcggcccatcgtatcgggaaaccggagccccccagccagccaccaaatcgacaagactcgtagtcccccccctcgtgcgctccccgtcccggcattgccgccgctgtctccgaggagtggaggtagacgcgccgccgtttgtcgatcggatccttgcttttgcttgcggttgcgggcgggggttt

SEQ ID NO: 8552 - DNA, 456 bp, Oryza sativa
aattcctatatggactctatactctacttctaatattccttatttttaattccaaatttctattatttcttaattgtatttctatatggactctatactctgtgttatatatcctttattttgaatttcgaattccagttatttataaattgtatttctatatggactctagtctcctcttccaatattctttatatttttaattctgaatttcaactatttctaaattgtatttcaatatggattctgtttttttctccgattaatatgagaatttctaggtcgtgagagcgaacacagaggctcctttttctattcttttaataagttaatagatagtttgaaaaggttaatgaaaattggtccttggttttgggccgcctattctttccttctttttagtctcaacccagtctgttgcctccctctgttcaaactgtctctcttcgatccagc

SEQ ID NO: 8553 - DNA, 1501 bp, Oryza sativa
tcttgctttcctgtcctggctttcttgagcaccactcgagccagaatatggcaaatgtcatttactgcttgtttgatgataatgtgccggtctaatttaatgcattatgctagtactttggattctgcctatccgtatattgaagacctttttgtgcaaattaaagtatcataaacacgttagtagtttcaaatcaagcaccaaaactaagtatggaggttctttattagggatatactccaaaggattaaaaaaacaaagatcacatgatctctatttaagatggcctaatgaaatgtagatatggtgctgatcgaactcaaactgtacaagaattgttggcttaatttaataaaaatggaactggggctgatgcccttatgccttttcctcagcctttaaaacgtactccctgcttttataagtagtattttgatttcagaaagtcaaatgtgaaagattttgactaataattagttaacataaaagtacatttagtgtataaaacttgtacaattagattcatacttcaaaatactttgatttgttatcatacttaatgattaaacacaaagattttttaggattgcccacattcatatagatgttaatgaatctagacatgtacatgacataacttttgcccttctttaaaaaatagttaaacagtaagatatatgtatacctctccatactttctaaggaccataaaagagtcactatctaaaacctatactagaaacctcaaggtcagcgtaacacagcagaaaaaaaaaacaaaaacaaaaacaaaaacacaacatcaatacactaacctccataatgattctctgcctctgtatggagcaagcaaaatcaatgtgaagtaaacagtccccatctactaataatatgccaatgagcaaatatgaagtagtaatctccagtagtaacctgccaatgagaaaaaaaaggcatctcagcatgtggaacacaatgatgtcaagtactccctccatatacgccgttgacttttcaaacaacgtttaaccattcgttttattcaaaatttttatgcaaatatgaaaatatttatgtcatgcttaaagaacatttgatgatgaatcaagtcataataaaataaatgataattatataaattttttgaataagacgaatggtcaaacgttggataaaaaatcaatgacgtcatacattaaaatatggaggtagtatttattaatcacactagctatcagctataatatgctgatcacctgaaatcaattgttaaaatttttggctacactagagaacacatattgtgttctttaaagtaaactaccatagtcattactccatattggcgatgaatgctacatttgcaaatgtcagtacaaagtgcagagcttaactctaagagaatataacactgcattataattgttgagtttgattatgtgtttgtgagttgctcacaagccaccaagttctattagaacaaatttaatatatatagcat

SEQ ID NO: 8554 - DNA, 1501 bp, Oryza sativa
tcattagccaccatttacgccgtcccctcgttccctcgcgttcaaagtgctcgatcatgagagcggacgggacaatccccccataagagagcaggtagcaggctattagccagctataaacatattttaataagataaacgataagagagaagagcagcgggctacatatttttagcgggctgcgggctacagatttgtagccagctgcagcacggattttaagaggcaatgtgtatatgacaggtgagatcatatattaaaatattgtaaacaactattgtatgaattggctattaaattggctatagatgaattagagctagtagtgggctatactattgaacttgctctaactcgtacgtgcaacgcccaattcttaggtggcccgcgcgtcagcgagggggaaagagcttcgtatccaccaacgaacggcgacgagccggacggacgggaagggaggcttttctgcgcctataaataagccccaccacagaaacgagctagcaagcacagcacgcacaggaaggcaggaggagaagcacgcacataccagcaggaggtgcaggactgcgtgctccttctcgttgttccttactcaccttttgcctctcgctgccttgccccacagcgaccggtctcgtagcttaggtagtagtagcccagcctctcgcatcacttcacactcgctgcccaccctgcctcctctggtgtcgccgctcgacctctctcgcctctcgtctccaactccccagcagcgagcagcatcttcatcacagctctcagctccctgcagagaggaggtgatgttctattagtcccgtcacttttgctttttttctttctttctttcttttctctcttcctttcatggtgatttgctcttcttgtttgcatgcatgcacaatcatgcgcgggggtgtcaaaatggggccttctcctccactttctctcggcgtaacgcctttgcgcttggcacgctttttgtttgtttctgctttgcatgcaatctgcttcctccaatatggagtaccacctttggtttgttcaagctgttttctttttccattagtagttggaagagcatgttaaatatgtattattaagtgtgaccctacttggctaattcactttcttgattacgtagaagcttcagtgtctattctgttttggcctcacaatgtgaaaataataagaaagtaatatagcagcagcttcttacagtacctctgaggatgtagccaaagcagggacaccctgagtatgcaggataatatttatcggatctcgagcacaatagtccactgtttcagcttcgatgtcgtctttcttcccccctctctgcagccatagcagagtacatataatatgagactcgagcatgcgaaaaagcaattaaaaaaaaacgtaccgcaacataagtccaaaacaggggtccacacagtgacgccacatggctgctaaacttcgttatcctgttgttgttggtagcagggcacaaga

SEQ ID NO: 8555 - DNA, 1501 bp, Oryza sativa
atgaacatccaacttatgtgaacttgattgtttatttctatactctggtttttgttgcttaatgaggttgtactagtatatagttcagagtatcataaaggcctcttgtaagcccagaatttttcctgtgctacaatcacaattcacaggtcacagcgcagaccaaaggtttgagtggagggctataccactatagtacttagttgtatgtttcgtggtgaaactgtagtagaagatagcagctgagcagaggatgatgtgttgatgtgatcgaggaatggtgataatgtatgttctgtcaatagctcctggattcttggatatgtgggacaaaagcaaagtcatgataagaaatgtacagtggttcttgtgcagctcaggaatgttgagctaatggattttatactatatgctatatatattaaatttgttctaatagaacttggtggcttgtgagcaactcacaaacacataatcaaactcaacaattataatgcagtgttatattctcttagagttaagctctgcactttgtactgacatttgcaaatgtagcattcatcgccaatatggagtaatgactatggtagtttactttaaagaacacaatatgtgttctctagtgtagccaaaaattttaacaattgatttcaggtgatcagcatattatagctgatagctagtgtgattaataaatactacctccatattttaatgtatgacgtcattgattttttatccaacgtttgaccattcgtcttattcaaaaaatttatataattatcatttattttattatgacttgattcatcatcaaatgttctttaagcatgacataaatattttcatatttgcataaaaattttgaataaaacgaatggttaaacgttgtttgaaaagtcaacggcgtatatggagggagtacttgacatcattgtgttccacatgctgagatgccttttttttctcattggcaggttactactggagattactacttcatatttgctcattggcatattattagtagatggggactgtttacttcacattgattttgcttgctccatacagaggcagagaatcattatggaggttagtgtattgatgttgtgtttttgtttttgtttttgttttttttttctgctgtgttacgctgaccttgaggtttctagtataggttttagatagtgactcttttatggtccttagaaagtatggagaggtatacatatatcttactgtttaactattttttaaagaagggcaaaagttatgtcatgtacatgtctagattcattaacatctatatgaatgtgggcaatcctaaaaaatctttgtgtttaatcattaagtatgataacaaatcaaagtattttgaagtatgaatctaattgtacaagttttatacactaaatgtacttttatgttaactaattattagtcaaaatctttcacatttgactttctgaaatcaaaatactacttataaaagcaggga

SEQ ID NO: 8556 - DNA, 1501 bp, Oryza sativa
gttccattttacattgtttttttttgcaggaaaaggttggaagcgctgaacagtggaatcgtaaaaagagggagccaaagttctccagtgcaagagacaactcctgcagtcaggaagaggtggttcctttggtaggttagttttcgttttctgatttgcaaaccagtgtagcatatggtatattattggccatgggcatgcactcgttcctttccacagtatgctgtctccaaaccaacaatcgcacctgctaaccagtacaatttgcatttatacataggctccacccccaacttccaactttccatcacatcacatcacatccaaaactttcctacacacataaactcctaacttttttttttccaaactaccaactttccccaaactttcaacttttttcagtaactaaacacagtcatagctgcgagtctaatgtgagatccaggaagtcaaaaccgtggagccattgctcctaatacactcatacatcttgctgtgccttgtgaacttaccatagccaaccaaatgatctgtaatttttccactattgcctggattgttttcgttgtcagtagagtaattactaattagctggtacactcaatccagtacggtattgttgaagtacattgatccagatatccggaatagcctattagatttcttggagcaacatcctgaagcaagatagcaacttgagatctagtgtgttttcatggacaataacacgtgcgtcccaggtcatgctttacgcctcacgatgaagattacaccgtactcgtgtcttcatcagttattccactcaaaaccgcattcctgaagattcgttgaacctttgtggccatgctcacttgggttaggacatattctcggcgtttaagtctagtgtggaaagattgttcaggtacccccccccccccaacccaacccccccccaaaaaaaaaaatggatgtgagtattggaagaatgggagtattggatttacgtttttgcgttagaatcaagatggacaagcagataaacactttatttttcgttagggaggaaaggaaaatataaataactatggaacaggctgataagggtgagttagggagaaaaggaaaatataaataactttggaacaggctgataagggtggatcctgcggttgccataacgtagagaagattgtactcgaaaccaagatcaagaacaagcaaccgcattccgttggccgggatgtcaagcgtggaatcgtttcatgtggagctcgccgcgcgagtgagagagaagttgacttccccagacttgattggcgaaaaagccatgcttaattccaacgacacacgcttggtcagagctcaatatgccaccaatagaccccgcctataaaaaagcgcgcgagcctgttccatcgtatcacaaccactaacgtgcgttcacccccctaacaactatctcacccccctaacaactatctcaccggctcgatcaatctctcaccggagatggtgc

SEQ ID NO: 8557 - DNA, 1501 bp, Oryza sativa
ttctgcgatataccacatttttttctttccttctgattatttaagtgagtggttatgcaattggagtgcagtgaggttgatatgatagctagcaaaaaaatatttcttatattatggctactctttacaatatgaaaaaaagtgcttatcaatatcgagtaccaaaaaaaataacaaagtactgcaattgactcataataatacatgacaaaaaagtaaatattttttgtggtttcaaagtttagtatccatgtcagtggatttagagcaacaaataattatatcatgttagcgtcttatttgcactagaaagattcgattcgactataaagaccccaatgaacctggtgggttttatactcccacacactaattactatttttttcttcccccaatgcaacgcatgggcattttgctagtaaaggaaaacaggtagcacggtatatttataaacgaaaaatattttttgataaatcttttatatatgtgttcttatcaatttaaaagtaaaggctgaaaaatgaactttgataaaaaaaacacctcaatatcaactacaaatttaagcttgaaattcaaattttgggtaataaaaataagcgaaaagatgaggctctaaatatagctatacatgtgtactccattcaaaaatctcaggtgtactttttatcaagattaatgagaaattaacttaccacgtatgtaatgaaaaccaatgattttatggatctacataaccaacgcagatatataaggtgtcataaatgctcgagtggattgataagccttataccgattttaattttgaaccaacaaatatgaggcgttacatattttgtgttctgtactagtgaggacctacggctcaatctgtaattttggtgcaaaataatgaaccatgagatacaatggagtcaccctatccgaaataatccatttttatcccttttatgctagggaaaaatcgttgttccatctattaagggcatcaccaatgtatatggcaaagtgtagtttttacctatggcaatcttcacaatgtatatggatacaaggtatcattaggagaagagagaagagtagagatatataatataatttatttcatatgggtagtccatatccatatggataccttttgttattttttctatatggactagttgcacaatggcaataggtggctgaatggaatattctattgcttatggactacttttacaacacattgtggatacccttagtacgttttatgtcagtaactgactcgatacatcccaaactataaatttttaacatttctataagtgattaagaataaagtgaaaaccaatatgagaaaattaaatgaggggtgtttatattttggtaatgttggattaatttaaatgaaggtgtggtgggagatggatggagtagcttaaattaatgtgggaatttctaaatattttttggaatttatagatttttattttaaaattgggatatgagagcctacta

SEQ ID NO: 8558 - DNA, 752 bp, Oryza sativa
tgagtcttggcatgtcttgctcacgacagctttgctacgtaattgaccagctaataatcctaaacatggctgagacttttcatccaaacctgcttagaaatgctacgttacttgcccttcaggtcaatatgttaggttagtgagaaccagctcaagtattcggctatttatggtcttcaattttttccttttgatgatttgtagagtcgccaattaccattagcagacgaatggaaatgcagaattttggtggataaactcttcaaatgcaaccgcaaaagaataccttcgcaggataaagctgtaactcatctttgcgatatccaaataatcacagaatgcacagaaactaactaatagaaatgcctaacattgtgcttcagttggtgatcaacaaacatactagtaataattctttggaggaaattgttgatataatccctccaaaaagttctatcttcagaattagcccttgcacccattaatggtacgtgtgtcctaggtatttatattagtgatacatgcaggaataaattctaaagttgcaaccttagtgaggacaatgacgatgttgggtctcgtaagccaaacagatagaacaaaaatagatggtacggtgcagtacgtgcagcaaatccaggagattaagtactgagaaataagtaaatcaggatcgcacgactgattaggtacagtgcagtacacgcgacacattcgggagaaaagtaccgagagataagtagtaatcagga

SEQ ID NO: 8559 - DNA, 1501 bp, Oryza sativa
ctcaatatcaaaatccgcctcggatttgagcccatcggctcatcgccgcctttcggcgtccgcatctaggccccaaagtgaaaaaaagaaaataccacagtatatggcaaacaacaagaagattcaaacaacacaactatgtcgagatcaacccaaaatcagaacagcgccgctcagatttatatctcttctagctccaaaccctcccctcgccggcggtggggacgacgaggaggaggaggagaaaaggcagctgcaccgtatgggccatagacgatgggccgtcacaccagttttgctaggtcggcctggcccacatgcctgctcacccttccattttgcagcaagagaagggaacaaacctcccggctcaatcgggcagatccaacttgtcgcaatgttactactgtcttttcttcgttgccaaagacaaaactcgtattcttttctgtgctcaaatccagtaaaacactgtccgtacaatcatatgggaatctgactaacttaacacgttgttggtttaccaattacgaacaaggttgttgtgctcataggtataaaacaactagtattcctggatcaaatgcttggatgctgccaatcactgggtaaataggaaggttcttcaataaatttttggatctctgcttgtactttggagtactttcttacaaaaatagagtatcatcctctgtttttttttcccatctctttctgaacgattcctgaatcctgatcggcaagcacatgcggcgcgtcaggtgctgagatcattagtgatataataagatcttaaatggagaaaccggagcaaaggacaattcagtactccagctaataagacaggcttagtataagtacttgccccactagttgaagtgttgaaccaatcaagcaagtttatactcgtacatttatttgttttcctatataaaaacgggagcaatgcggcggcttactggtaggcctgctaatggtgcaagacccgccccgcctccagttcaaaccacaacagtgaaattcaatagtccaaaccaccccaatccacttaccttctttcatgatccaaaccaacccaacccatttctcagctcaatccaaaccaaaccaaaccaaaccatttccccgttgtggattcaatccacttcttcaaaccattcgagtccattccaaatccactgctgcagcgtcgtcagctcgtcgcctcgtggtcgccattggcggcggcaactgcagccgctgcaacgcggtgttggcgcccactggcctcggacgccgcggcggagtagtcatcgagccggccggcggccgctcatcgtccgcgcgcttgagtccgtcaacgtcgacggcatcggcgagaccttgtggtgcagctcgggtttcgccggcggtgccgagcagcacgtgctgcccctcgccccgtcgcggcgccgccacgcgcatcacctccgccgcctgaatcctgaccgccgcaaccaactcctccttggcgacgccagcg

SEQ ID NO: 8560 - DNA, 1501 bp, Oryza sativa
gtatctcttaattaggaagcttgacaggcaataggctggtgctcacaaggtaggtataaaaatctcacctttttctctattcctctccatctcatcacatcccagaacttcctgattcttcaaataatcaaatattattatctaaattcaaataattaattataatttctcttccccctctaacagaaccgtttctgtaaataaccctatttcttcaatgaaaatttacgctaggagcatctccactgtttcctataaaaaagatatgtagttgtaaaatttagaatataaactaaaagtgtaaaaccgattctcgcgaattagctactcctacagtgtacttaccggctacttctcagctctttaaattccttaaaagagagcctcagtatctcacctctcaactaagctttgcacttaacgctgtagtcacacctttatagtactatgcttatattccctactacacaatccaagatttaattctccatcaccagtggagcacaaattccattccgttggcgtctccaaagcggatggatggtgcttgcatcatgcctcctattatttttgtttttggttcccaatggcgaaaggaagaatgagagaggggggggggggggggggggaagccaactttgtctcctcctgtaactgccgaggcataaacgcacaagaggaaggaaaaaaaaacagcatctttcctttactgctttcctaaatgcacactgaaacttcccaaacgaaaacggccggcacctgtggcagcaaaaaagtagctggatgtgtgaagggcgcgatggaccgcccgtcaatgagtgaagggaaaaaattaagaaaaaaaacgcagtactagtagtactgtgcagtgaaggcattggatatttggattagaaagtgacatgtgaggatgcacattcagtgaccttgtataactgtaaggttaaatgcaagtctgtttcattacccaattttgttttggcacgactggtatatggactagagcacgtgtatatatagtagtaaaaataacactgcttcttgcccattttcgccgagaattgagttgttagactttactgaattaggaagcctaacagagtagaataactaattaggactttaggagtagtattagtagtacgatgtacggtcgcaaaacatgaaattataaacgtaaataagttacacttttatatttgtttgagcattaagcatctttttaaatatctaaagtttcataaagataaatttgtttgaaaagcattcaagtaatattctaactttaatttacctgatttttacaaacgtgtttaatgggatagaaattcacaaccgaagtttcagctgcattttttttcaaagattgtgtgccatccaaaaacaacatcttttcaaattgaagggggtgctatttcttttaaagaaaacatttactcggtacctaacattcttaaattctaaccccctgaaataacttttaaattacgaatagtgttca

SEQ ID NO: 8561 - DNA, 477 bp, Oryza sativa
agagagtatatttatgaagagtgccatttatagattgatttattcggttggtatggtttgtttgcacatatgtggattaatttagctttgaatatttgtaaagtagtatatttgatttcataatatatactaagatttttagaaatttctaaggttgtttggatagcatgcaaatgatatggatatttgaactattgagataagtgtaagtgcttattattttacatgtaagaatatatagttggatccataccactacaaatataacattttagataaataccactactattcacaatatcggctatgtaccactggaatttggggaaattggaccagtgccactctatcacgttttcctaaaaaaaatctctgttatccccaactgcatgtgggacctaactgtcagttccgtcttcacctccctcccctctgttctctctccccaccaccatcgttgacaaccaccgttgcagc

SEQ ID NO: 8562 - DNA, 1501 bp, Oryza sativa
gggcatttactcttataaagcaagacatgcaagaaaccacatcatcaacaattttaagtcattagatcatattagtacaaagataataaccgttggatcaagaagctacttattcatccaattcaatcatttattaattatccattcacctctctttactccacctcacaatcacacatagcactgttacatattttgtgcataacaccatgttttccgaatacaactcaaattattgtttaatatgtgtcttttgttttattgtgcatgataagataacatataactatttggtatcgttacctgaatctattttcagaaaagaaattaaacttgagtgaaatagagagatgcaaattgtcttactataacaatacccatattgcgcatgaaaataatattcatatattataacaatacgcaattactcttggaaaaataaagcatgaattatatttcaataacataagacatatataaatctacattatcatatattttgtataaacatagagttgcacctaaccatttaaaactttgacaataaaactataaaacccatggcaaagacgtggggagccaactagtgggtgcatggattattcgtaccatgctttttgaagtgtaatattttctaagatatctttttctaatatatttgttagtttatgatattcaattcatccatatgagttatttttctctatcaatattatctattcaatcatgcagttagaaacacgtctttagtcatgtagctacctatatgcagccccttcgaatatgtcctgagattatttgtaccaaagtaatcaggtccggagaagtaaccgacaataaagtaaacattcctcgatcgtaaggagaaaaacttttcttcaagcacccaagttggtaatgtccccgtttgcatagttgccagggagatggagaccaaaggagctactacctctgtcttatagcaagtttagttttagttattatgcatctagatgcatatttaaaattttttattatatttgatgatggatggagtagtgatttccagcgggtgatcgatcgagaaattaaagtggtaaagggccggggcctcgctgcctaaattttacatcactaataactatcctgtcggttttcggcagatgatacagtagtacagtacagcactatgatgcttgttaagagtagctactagctaagcagctagccaccacactgtgctcacgacggtgcggcaccaagaaagccagtgacgtcccgacacactggagagtagcgtacgtagagtgcggcgagtgtgtggccgatctccgcgcgatcgacgcgaaccgcctcattcttcaatgccccaaccacattttgcgcctcagttactccactccctctgccctccccaccaccatataacgcctcgccaatgcttctccaaatctccaaccaacccacaaacgatccatccatcactcgatcgtaacaactttgtagtcacgcgccatgcagc

SEQ ID NO: 8563 - DNA, 152 bp, Oryza sativa
ctcgcgccgcgcgccgtcgccatctcccctcgagccccgcccgcgctgcgcgccgtcgtccgtcgcccgtcgccgccgttgccttgagccccgtccacgcgccgtcaccccgcaccgcctcgcctcctccgccgccgcgctcgcctcctagt

SEQ ID NO: 8564 - DNA, 1501 bp, Oryza sativa
ttggacactcccttcttatatgcccccactcatcacatctgaagcacttcaccatcttcttctttttgttcttctttaccttatgcccagcatgatcttctttgactagcaaaccctctgcttgagatgtttcaccctctttgttctttctcatctaatcacgagccaacaacgcagaagtgatatctttagttttgatggtctccttgccgtacgtcaaagtagtcaccacatgctcatacgattcaggtaatgaacacaaaagaactatggccttgtcttcatcgtcaacttccacatccatcttcacaagatcagtgactagttgattgaaaacgttcacatgtgctgtcagatccgccccttcctgcatctttagcccatacaacttctgcttcagataccgtttattggtcagagtcttggacataaactgagcttccaacttttcccaaattatctttggtgaggtctcctccatcacatggtacatgatctgatctgaaagacatcgccttattgtcgcagccgcctgcaactgcatctcctcacaatcgtcatcctccatcttggccggtttgacacccttcaaagcctttgaaacttcttgttgagctaacaaatctttgaccctagtttgccacaagccaaaatttccgaagccgtcaaacttcaccaaatcaaatttcatacatgtcggcgccaacttgccaacccgcgacctgactggtctatcgccaccagaatactcgcctttctcagtaccgtctgtattcgtcttcacaatctcgtcttgtgatccgatctcagacattcaacagcaaaccgactgtttgctgcaccgattagaccagatcttctgcccttggtttagccgcctgctagctgcctaaccgtgtcagcctggcttggtccacccgcacccgtgcgccttcttcccaagaactcgtgcaatttgcgtcgtcgcctgccaaatagtccaccaaacgatgtgtcaaacctctgtgtgcctacgctgttgtgagttacttagccaatcctgtcctgacgccttcttttaaagagcgtcattagtcaccgagtcggacaggaacctgagtcctggacaaactcgatgaatccttcccatagaatgctgcctagtccaagtcgggcccgtgtcaagctccaataagaatcggctccaatatatctcatttagcgtcacgtgccaccaccaaatttgcacacaccacttcttgctcgaataggatttctctggccttctgacgcacacgactccacgttgagatccatggatgtcctgccacatgctctcctcatgcatgaccggcttgcatgcatatttgttatgctattgcatgcaattaactgcagccccgcatgcacgtacatgcatcaagccctgtcgtatgattttacatataattacaccatgcaaacactaattaaattagtgcatgctgcccgtagctccattggactctttgtgtgctgcact

SEQ ID NO: 8565 - DNA, 1501 bp, Oryza sativa
tgaaaattgatattcgcgcttgtgctactttttcgcgctttcgatctccttgcgagatactcctatatcgttgcatagtcttttggaggaatttcatattgttgcacattccaacattcgctgcattttatatgcatcttttcttaaacattcgtttttgtttaatgggccaaggagaagtacggccgaatttgttactcaaccaaagcctaacccggcctcaccttacttccaaatacagcccaatatagcgtattgatccaaatcttttcaaattactttcgactaaccgctcttagttttcctgccaaaaaaactggagtaaaaaagtactccctccatcctaaaataaaacaatttttagccaattaaaatttatcctaaaatataacaatttttctcgatcaacattttctttctcaaccaatcacaacccttcaccaaatttcaaaaaaaaaaaaaaatcacaaccctttaccatttaatttcctcacctagctccacttctcaaccaatcacaatattccactatttaatctacatattttttttagtaaccgtgtcaaactctaaaactccttatatttgggacgaaagtagtaaaaaaataggcaacttttgctataggacatccaaaatttttgcaatttattgatagacgtaaaaaaacgtgtcacggcaaaaagacatcctagaaaatggtaatttgatagaggatactttcgattcaattggattgataaattcttaagaaagatgagatgccctgaccaaatgctttaaacatgatgttagagtaaaaatttagaaattatgcaagtttaaatttgccatcacctcaaatacatcactcaaatacatcactagtacacactatatttcattttgctacagtctccgctcaaaagcttttgaccctaaggggcattccagtctttttaaagaatttctctccaaatgaaccgaaagtgttttccagcaaattactagtttttttaagtatatttcaaccatgacatgtttttattatgtctaccagcaaatcatacaaattttgagtgttctgtagcaatttttacccaaaaaaaatatatgttactgcagatttgcagctgaaagaaatcaacactgtccatgggccatgggcaagagccaagctggatttttcacaatttggttcttttgaaaaactcatttcacaaatagacctttgaaaaaacttattccgaaaatagtcctttttaggcggcaccaattatattagcgtgctccccctgccaccttagcgccgacccgccacggtggcaggaggacggcgccaatgactctagcacctaaaaaattgactctttttgtgataagttttttatgggtctatttgcaaaataagttttttaaaaagatcaaattgtgatttctatttgcaaaataagtttttcaaaaagatcaaattgtgaaaaatcaagagagccaagagccacgacgcacaaatcagcactgc

SEQ ID NO: 8566 - DNA, 1216 bp, Oryza sativa
ggggaggggtggggcccccgcggtgtcgccttctcccgtggctccgggtgcagagctggcagcggggtggggccagctgggccaggtgacgtacggcgttggggggtaggggagatcgcgaaccgacggtggagagcgcatcgcagagcggcagaggccatccgttgtgttgtgggctcctttctctctttttcctttcttctttttttttacttttgttttctgagaaaaatgaaccgtaaaataattttgtactttacagaggcctgtttagcacatatcagaatcctctgcaatcgaagccatataactttttcactgatatataggtccgatgatccttgagtccatatattagtgacaaaggcacttgcagagaatctcaatccatttagcacaagtttagctttagctttacctctcttgaaaccgaaactcagccaaacagtttcagctctacttaaaatagaaacggaactgggtgaaacgctttaacaaaatgaactaaagagatgaatatgggtttatgctgctctacaacttcactccagactcaactcttatagttaaatttagaagttagagttataagaaagaggtccagagtagctactcctttttcacatgactagtgataatgataataacggatcgcccctggttgcatcatggaggtcatgtgtgtcacgcgcccactggtactggtgcctcgctctcgaaaccgtccatttggtttccaagagagtgactggccatgggtgatcggtggcaatggcaactggcaagcaagttggtcacagcttcatggaagaagacaaacgaaaatctcgagacagagagttgaggtggaatatgctgggcgtgcttattcgctgtattgctggatgatccgataatcccccaccaagctaggttaacacttaacagcgtagttttttgcagcatcaccatacttcaatcttttgttgttactttttcaagattcgctcaccttgtttgagcgagtgttctgacttcggagcatcgactgagaaacaaacaggagcacccagatctcactagccagtgtcatcacgcaggcatcttcaattaattagtgattactacgtagttagtaattagcccaacacctggaaacgtgcaacaacagcataatttaacccctctcgatgatcctagatacgggagaaattattattatttatttaaacaacaa

SEQ ID NO: 8567 - DNA, 1225 bp, Oryza sativa
tgtaaaactacaccccaaatatttaaaataaggtcctatgcacttatacaatagaatatttatttctcatgaacgataatgtttagaaaaggagatcgagcactgctagttctatctcaaaaaataaatgtgcaaatagactacattcagctgtggcttgaccggatttccacagaagaaaggatgatccaatgagcaattattactgaggctactgtaactgaggttctatgcatgaattctacagcgagagtaattgctttgtgccatagagatgttactcaatttcttttagtgtgttcattataccttctgaatggcaaatgacaacaattgagttgaccatatctctccatgtccaacaacaaaatctaagaaagactcggttgcatgcccagctgcaaaaagggaaatgtatcataactcagctaagactatatttctgcaatcaaaccacaccgttgctacataatagtaaataagtcagcatatctaaaatgagggacagatatactatcacagaattctatgtggttgatttatatgttgtctcatatcattatgggtattaacatgctattttaacagagcctaacagattgattgttaaatcttaaatgtgtaaaaaacgaagatggacatcatggaagaattgttttgattgagtcaagagatacatgagttcaccactataatgccaatgatttcctctagtactacagtagtatataacttcactttattaggctatctgttagtactctctcagaccacaaacttttcaaaccatagcttcctttgtaagttagtatgcatgattttgttaatagtgaccagtaattagacattcctgaggttgtaggccaaatgcaagattaaaaaagcacagtgagaaacctctcaattaagcgtttatggctactgttacagacctattcgaaaataacatgacaacaaagcgaacagagtatttgacgtttttttttcagaaatattcttatccagtgctttgaaaatgaacttgtttttttttccgaaaacgcaagagccatgtgtttcatttcaagaagaagaagaaagagcatgtaagctatagtcataagctactctatgtcattaaaaagcagcataagtagtgtacagaataatgcaatttatttttgtgtttttcctgactgacgtcctagtattaataatttctccatgagccttttattttgacaga

SEQ ID NO: 8568 - DNA, 1501 bp, Oryza sativa
tgtgatcttcttgcaaccttatcatcaagcttttagggcccatacctggattagtctttaagatcttcacagcctttgaagcaacccatttggtagttggtgtagtggtcctccttctgctgctagatgtacaggtatgaaaatctgttaacacagtcacctgccaattaattgaacaaatacattataaaccaaaccataaaagtaatataaataacaaaattcaaattaaccttaattgtcttcaagtcagcctgcctacttccaacaatatgccaaacacaaccatccactttacaacctcctatatatcttgttgggtcagtcttcaccacatccaattcaaattcgttgttaatagcaaactgtctcattgccaatctaaactcctccatgctggggtatgcagttccaagatccatgcaagggttgtcagggtcatatgccatcacattttcaccaggaattgaatcatccactggaagtgcagcatccatgtcatctgggcctcctactccagcaacattgacatcagggtctcctccttcaacattttgagctgcatttggggctgcttctccaccagcagcctgcctattcctatcagcttgctcatcctcagccctcaatcccaacaactcataaaacttgtcatcatccactatttctagcctcccttcttcctcattctgggccaaaacctctaggctatcccaatccacagcaggaggtgcatcaacagctggcccatgaggtggcgctggttcgacaactccatcagatgcgacatagaaaatggtttcaactcctgcatcagcatctaccgctcccgcatcaccaactacaacatctaaactacgttcaggctcctcctcgagcctggtaagatagaaaaaaatacgcaagttaaatgatgcgcaaactacaacgaactcgcccacactcgcaacatcaacaacattcaaatcgccaaaggtttgagaatggattcacttatccggcgacgagttcatgccaagtacactccatattcgccaccctcaccaccccgggatgcagtgcgacggcggcgcctacatgcggtgtgtcgacggtgagctccttccgcgacgagccgtcttcatgaccagatcgatttcttcgccgacgagcagacaggatggagcggcggaggaagagagagacggccaagaacccacctctggatctcaatcccctttctacccgaccgcaggggcaatttcgtcaggtcaactcgcatagaagggaaaatcatttcgaaaatgagcaaaaggaggaaaatggcaaagtggcgagtgcggcgcgcttcatcctggcattttagcgaatcccgttttcgggatggcattctggcgaagcccagttttgaacgtggcttaatgtccattttctcatttacccgccaaacagctcaaagaaacccaaccattcgcgcgctttctgaaacaccccgcgaggccgcgacctttcgtcttcccct

SEQ ID NO: 8569 - DNA, 1501 bp, Oryza sativa
ccccgagcgagcgaggcacgaaaccccaccagatcccgcattccctgatccacaccaaaccccaccccacccaacccaacccaaccccacgacaaacacgcgcggagattacggtggcacgcacctcgatcggcctcgtggcggcgggggcgcgggcgggttcaaggggtggagcaaaccctagctctcgcttcagcttcggctggcggcccctcgctggctggactgcggcttcgcgggtttctccgccgcgtcggtcgcgtcgtggtggaagggaggagaggagacggagaggatggggagaggccgggttggccgggagtggcgttttaaaaaggaagggtgcgaaagcgcgtgcacccgtgtttctctttcttctttcttcgccgctctcttggggattggacttctcctccctatatttattttttcttcattattattattattattattattattattattattattgtttgatatattatttcgtaaaatatttctttagctgattttttagggtgaatagatctaattccttaagtttcaccaaaagttcaatttagtcgtttcagttttattttatccacgtaggttctataagtatttgttttggtttaaaattatcctgagttcacttataccatattgacatagggctattcctattaagtgagatcaccactctcggggcaattggagttctccctatttcctttttctctcgatatatattacataaaacatttatttagctatgatgtgattctttttggcaaactatggctgtgttcatttgtagtagttagtagagttgtgtagaggtggccaaatgggccgggccaaacgggccgcccggggcacggccgaacctgtagcaggcacggcccggcacggcctgctacagtaacgggccgtgccggcacggcccgagtagccgtgccgtgcctgggccgctggccgagcccgcgggccggcacggcacggcacggctactgtagcgggccagcacggcacggcccgcggcacgacacgccggcggcccgagcggcgcactgacagggcgggcagcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 8570 - DNA, 504 bp, Oryza sativa
attgaagtatgaagctttgccgctataggtactcacataagatgtagatgtggagggatagtcataaggaaacctagctcccttatcaccatcattgccatcccccgttcaatccgacatgatctctccaagcgattaagcctaattaggagattaggctctgataccaattgaaatggtcaattaggtctagagggggggtgtgaataggctaatttaaaaaccaaatccgaattaaacccgagtggagagatgaatcgagaaagaggctcaaaaacttagagagagatgcaagccaagggcacacaaatttgcaatgaaatcagcagccatcacaagtgaggggaggtgggtatttatacccacagcacaaatttgcccgttggagcgcaataaaagtaatttttggaacttccaaaaattccagatctaggataatcgaagtcaacgcccattttcggaacttccaaaaattcttttcggatatttctgaaaatttccaga

SEQ ID NO: 8571 - DNA, 1501 bp, Oryza sativa
ggctttatttgttaagcgaacgggtgacccaatctatagcactaacttttggtaccgacttgttatacggttataccggtttattaactttctcaaatagatgaagaaaatgcctcctgcttattcatttgcattttcatttcatggagttggtcaacacttaggctgtgttcgccaatccatgttcccaaccgaaatagtacgcgcggaaaatagaacagtctattagcgcgtgattaattaagtattagctattttttttcaaaaatagattaatttgatttttaagtaactttcgtatagaaaatttttgcaaaaacacactgtttagcagtttaaaaggcatgagtacgatagacgagggagatggatcgggaaaaggggtgccgaacacagctttattgtgctcccatctcatgcaacaatccaaattatgaagtctctttgttctactttataaacttttatatttctcaatagggtaacaatagattataatatattctcttatttaatatagagtaacactaaataaatttggccattttaagaaaaataaacactaagggcatgcacaatggttgtcaatagtggtttcttagtgtagctaattaggaatacttgttgacatagaggaaagagaaaaataagagacaaaacatcattgttatgtataacaacggcttaacaacgactcttaatcactataatatggaaaaatggttgcacgaaggtgaaaaaagggaaagaatattaataaaaaaaatatttttcgagttaataattagagcctttgttatctcaactattataaaaacatggtctctaaataatcatataaaatattatttaagagaccatactctagtattgaacctgcccaaagagcaatatttctgtccttattttgtttagagagagcaagagatattttctgttcctctcctgtccccacacaccaggggtctccctctctcctctcctcttccttccactctcctcgctgggtcgcgcgcttccctgctctctacaccgcgtccataccccagttaaggccatcccgaatctcgaggcagattggacggctcccattcacccccaccgtacaccgggtccacccacccacccccacagtcgccgccccttcccccgccgcgagagtcagcgccctataaatacccgacctcaccggaaccctagatttttgagagctccccttctccgccaccgcaagctctcccctgtacccacccaccgccaccgcggctactaccccgccgccgctatcgccgccgccatcacgagctactagtagctaccgggctatcgccgccgcttgccctgatgccgcagcaggaggtcgccgaccagatcgccgccgcggcggcggagcggggcctgcagaggagcggctcggccagccgcctcaacgcgggggcgccggagttcgtgccgcgggtcgccgcccccgtggtgccgccgccgccgccggtgatccgcg

SEQ ID NO: 8572 - DNA, 1501 bp, Oryza sativa
ttgagggcccacctcggaatgagctaatccatctgttctaaaatataagagattttggataaatgtgacatattctaatactacgaatctggacaagatattatatggctagataggcctgctagggagcaagcgagaaacaaaaaaaaaagacagccctaggcgaacacgtcgcttctctcgcaactcgtggtaatcgcgtgcgtgcgtcgaggctaagacgtcacgactcctcgcaagtccaattcagcaattcccgactattgcacgcttgtgcctgcgtgcgtctagagagagcgaagagacgacgacgatgatgacatgacgccgagctacgaggtcgggagcagctagcgagcggcggtgggacgagccgagtgcctaagccctagcggctgggggatggctgtggctgcctttgccttcttgttttcctcttctcctcgtcctagactcctcaatcctcatcagccctgaattggtatttgaattaaattagtaatttgaccaaaagtatgccatatttatattagacatatgaatttctcaaaactcttttagagtgaaaaaccctctcacgtcgcactccccaggggcggctcgggaggcgacgaccccgccgcccctctcccccacccccacccccttctccgcctcgccgtcgcccgagcggccgccggcgaagccacgcagccacaaggacggcggcggcggggcgctcctcgtctcctcgcgctcgggcagcctggggagccgcccggagtggcgacggcggtgtccgccagatccgcgccgttccggccggatctggcaggatgggctggcggtggggaagccgtcggcggcggggacgggcgacggtggcggtcgaggcgagttgcaccgggtggtgttgtgggtgatggcggcggggatggcgacggcattggggtggcgatggtggaggcctgtcacaccccgaagttctttcccaagcctaaattgaagctataaatggtcttaagaaaatacctgtgtaaagcaagagtaaaccttaataaattaatgcaaataataatcggaattggcaggtggaatttttgttgagttctacatgccgaaatacgctaacaagatttttagtggaattttcagagctctagaaataattttaatcaattaaaattgagcacagacaatatttaaatccttggaaattcatttcttcctttttctttttctttttccttttcccttagtgggccgccggcccattcccctcctctctccccgcgccttgctgggccggccggaggccacggcccagctcagcccgcaccccctcctctctctcagggtcaccgacaggtggggcccacctgtcgggtcctcccccaacctctagccgctcgccgccgcgcctcgcgtccgcgcctcccgggccacgtcgtccacgtcgccctcgcacccgcgcctcccgcgcccacttccccctctctcccgctcgcccgcgctcccgaga

SEQ ID NO: 8573 - DNA, 433 bp, Oryza sativa
ctatcaactagcatcacttaaactattgacgtgttgctaaaaagttacaaattgaaggaactatcggccaaaagacaactttattacgcagatggacacatcaaaagtcgcacttttgtttttctttttgtctttgcagtgcgataggtgctgctcttgtgattggaggcctctatcttctcctctggggtaagagcaaggaagcatcagctactgctttattggcaaaagcagtggaacaagacggggagaaaaaggaaaatttggaagcataaaatgggcaattgtagtagttagtctttgtggtgtaaaagatcatcctaaataactcattgtagtttttttttcttttttggcagtgctctcgtatgcacatgtgcagtgatttgcaccaagcacttctcttctagattttgtacaacctaaaccgaaa

SEQ ID NO: 8574 - DNA, 1501 bp, Oryza sativa
acgatagaattatgtacatggctagtctaaaaaagaactaagcccgcaaaaggtgatgattaagtgatatctctcaagattccgaactcttgaagcttagaggctcctactttaactcatgcctgaccttcctcttttatcttggtgaggatggatgccggtggcgatgcagtgtttcaaaaaatttattcatttcgctcacaccatatttcctaggataccaagatcaccagagtacgcaggggaatgcggaggttgttagcgagaattgtgattcatgtgtgacatttgcggcggaaattatgatgaatttgttgtgacttagtttcatctttgcatttgttgtgcaaaactaggatgttcaaggtattttacacttaggctgtgtttgatacttggggttgggaacccaactccaccgtacggaaaacagagcagtccattagcgcgcgattaattaagtagtagctatttttttttgaaaaatggattaatttgattttttaaaacaattttcatatagaaactttttataaaaatatactatttagcagtttaaaaagcatgcacacggaaaatgaaggagatgggttgggaacctttaggaacgaacgtagccttagtcatacacgtggcgggcagggcgcgacatggggcgcccgattttactccccacgtgggcgcccgattctaggcatcatttgcatttatgtatgcatgtgcaggcttgctgcaaagatattagttctgcatatatcatcatgcagtaagtatgcattgattaatggatcatcgatcgtacacactacacagacatgcatgcatgatagtactagctagtgatatttggatatcgaattaattggtagtagtagctggtagcaatatggctagagcaaggagatgatggcgagggagatgacgccgtgctggaagaggggcttggtcctggccttgatggccggcggcgtggccatgccctgccccttgaactcgtcctcgcaggtcaccggcgcgtcggtggtggcgctcatcgccgtcttggcgtcgccgtacctccacgactcgatcgccgccacggcgttgccgaggttgtaggcggcgtcgcggaacacctccaggcacgagtcgaggcaggacctcggcggcgaccccggcggcgccctgtcgcggagcaccctggcctcggaggcgatggtggccagggcggagcggagcggcatggtggagaagagggcgaggccatggaggtcggcgcctgggtaccccgacagggacgacacgcacagggtgtagttcacgttggggttgctcctgctgcattgcccgcacgtctcctccactatatcctcgcccgccgccgccactgccgccggcgacgacgcaatgaccattattacaaacaagaagcagacgctgccgcagagagtggccatgtcgatcgaccgaccgaccttatggttagcaacgtcgacgtactaccactgcgtacaagctagct

SEQ ID NO: 8575 - DNA, 1501 bp, Oryza sativa
acgaacggcttgagtagtgtatactaatagtcttagaattaacacatgtgctcatatttacgataaataattttttaatgttaggtgatgtacgcgtcaaaagtgatgcgttaattttttagataatgatcagtgatgcgtcaatgatgattttagcaatatcaagatatatcagtgataggtgacgtccacatcgacagtgatgtgacaatgataactttgtcaatatcaaggtaacatatatatgctcattgacagtgagatatttataatgacttcgtctcaggatatatatatataccggttcaatctatcagagatacttatataataggtgtacatgtgtgttgataagaataagtgtagcatgtgtacggcgtcgctctccccaggagcggctcgggaggcgacgacccggccgcccctctcccccacccccacccccttctccgcctcgccgtcgcccgagcgaccgccggcgaagccgcgcggccgcaaggacggcggcagcggggcgctcctcgtctcctcgcgctcgggcggcctggggagccgcccggaatggcgacggcggtgtccgccagatccgcgccgttccggccggatctggcgggatgggctggcggcggggacgacgacggcagcggggacgggcgacggtggcggtcgaggtgagttgcgccgggtggtgttgtgggtgacggcggcggggatggcgacggcgttggggtggcgatggtggaggctgcggatccggcggtggcgcacccggatccggcggcggcgcggcagccggcggaggcaagagcacgcaggcaccccgcggctgccactggcgtcggccggcattggtggagaggaagacggccggatctggctccttgcccagatccaacgcgtcctcgggtgggaacagggtggttggagtccgatcgtcgtgcaggtggtgtgaatatcgcaggtatcctcggtgtgcaggtgacatttggtggctcccgtcgtggatgctatggttgatgggtgctccaaggcgaaagtcttgctccgctctcggtgctagcaacggcgacgcccttgggcgccgtttaccttcttgaaggcgttgctactggagccctcgttcaactccacttcaagagttttctccgggtgaaaacctagattcgttaggatcggacgatgtcgccgttctgtcggcgtaaccttcttgaaggcttcgttttaggagtttatctcttgttggacggctgtacttaggttcagtttgtcgatgtcgggggttttgccggttttcctttaattaaccgtgctgttgtaaggtttttaggtctgatttcccttataaactggatcaactctcttcttctacggtgaatcgcaggagctccctgcctgtcccctcgaaaaaaaaaagtgtagcatgtgtactattcgtactgtgtactatctagaagacgttgattagtaactaatcccacaagcatgcatatatacactagct

SEQ ID NO: 8576 - DNA, 1501 bp, Oryza sativa
gtgcaggtgacatttggtggctcccgtcgtggatgctatggttgatgggtgctccaaggcgaaagtcttgctccgctctcggtgctagcaacggcgacgcccttgggcgccgtttaccttcttgaaggcgttgctactggagccctcgttcaactccacttcaagagttttctccgggtgaaaacctagattcgttaggatcggacgatgtcgccgttctgtcggcgtaaccttcttgaaggcttcgttttaggagtttatctcttgttggacggctgtacttaggttcagtttgtcgatgtcgggggttttgccggttttcctttaattaaccgtgctgttgtaaggtttttaggtctgatttcccttataaactggatcaactctcttcttctacggtgaatcgcaggagctccctgcctgtcccctcgaaaaaaaaaagtgtagcatgtgtactattcgtactgtgtactatctagaagacgttgattagtaactaatcccacaagcatgcatatatacactagctagcttgtacgcagtggtagtacgtcgacgttgctaaccataaggtcggtcggtcgatcgacatggccactctctgcggcagcgtctgcttcttgtttgtaataatggtcattgcgtcgtcgccggcggcagtggcggcggcgggcgaggatatagtggaggagacgtgcgggcaatgcagcaggagcaaccccaacgtgaactacaccctgtgcgtgtcgtccctgtcggggtacccaggcgccgacctccatggcctcgccctcttctccaccatgccgctccgctccgccctggccaccatcgcctccgaggccagggtgctccgcgacagggcgccgccggggtcgccgccgaggtcctgcctcgactcgtgcctggaggtgttccgcgacgccgcctacaacctcggcaacgccgtggcggcgatcgagtcgtggaggtacggcgacgccaagacggcgatgagcgccaccaccgacgcgccggtgacctgcgaggacgagttcaaggggcagggcatggccacgccgccggccatcaaggccaggaccaagcccctcttccagcacggcgtcatctccctcgccatcatctccttgctctagccatattgctaccagctactactaccaattaattcgatatccaaatatcactagctagtactatcatgcatgcatgtctgtgtagtgtgtacgatcgatgatccattaatcaatgcatacttactgcatgatgatatatgcagaactaatatctttgcagcaagcctgcacatgcatacataaatgcaaatgatgcctagaatcgggcgcccacgtggggagtaaaatcgggcgccccatgtcgcgccctgcccgccacgtgtatgactaaggctacgttcgttcctaaaggttcccaacccatctccttcattttccgtgtgcatgctttttaaactgctaaatagtatatttttataaaaagt

SEQ ID NO: 8577 - DNA, 165 bp, Oryza sativa
aggaggaggcagcggaggagcggcgggtgcgcttgggagcagaggctgaggaggaggaggaggcggctgctgctgcggctgcggcggcggcgcgcttgcggctgcgcgtttccatacaagcggtgacgggcgggggggagggggtggctcgcagccgtgcctagg

SEQ ID NO: 8578 - DNA, 685 bp, Oryza sativa
gaggaagcagagtgtcttggtctattttgcgtacatgtacattcaatagtattacacttagggataaaatcttaaccactaatttattatattttagccgtaaaaaaaaatctgatagttttaagattgtaattatgtcagaattttatcttctttttactctatgtataatgaattttaaaatgcaactttgcacgtaaatgtaatactattggaagtacatgtgtgatttttttaagaattttttatgataatttttagttggtgtacacggtgggtacacacgagggtctgtgtgcataggatacgctcccgtaaactgcggacatcacttatgtgtgtgtgtgtttgtgtgacctggcctttgtatgaatggaagtgatatccgcagtttataatttgtatgtatatatagcactggtattatggctgaagatcgagtagagaagaagaaaaaaaagctagtagaggttaatactagtagtagtatatagttaaaaggaggacatgcaaaggccattttggtgttaaataatggagtgtaagtaaataaaaaggaagggggggcggcaggcttcacacaaagctggcgcgcacacagacgcatagcatatataggatgatgcgtgtgttgtattccatcatcatcaggtagcgcgcgcggatagatcatatctagcgtgga

SEQ ID NO: 8579 - DNA, 1501 bp, Oryza sativa
tcatacggtttcaaaaattcacaagtgttaaatgtctggtgttaatgtagtagttgaggagtaaatcatgcttttttaggatcacaattaactgtacatgtacaatcttccctactactgcaaatgttctatatatcctccctccgtttctaaatatttgatgctttcaaaattttaaaatatgtttgaccgttcgtcttattcaaaaaattaagtaattattaattcttctcatatcatttgatttaagtaattattaattcttctcctatcatttgatttaagtaattattaattcttctcctatcatttcattcattgttaaatatacttatatgtatacatatagttttatatatttcacaaaagtttttgaataagacgaacgatcaaacatgtgctaaaaagtaaatggtgtcaaatatttagaaacggagggagtatatatgaccgcaaaaatgtatatgtgtgtttgtattatttgtaagatttttttaaaaaaataactactgcatagagtatatgcatatacatggtgaatggttagatatgtaagtggtaagttcaataattacatcctcaaaatattttatgtttttactgtaagatttggttaaaaattatccttaaccgtcaataaattatcaaatgtctaatttaaaaataaacaagataaacttgtgttaaatttgtataatagtaatatacaaatttgttagttggaattaattataaatttttgacagaatcttgtgttagacgttaaatatttataaaccagccaaatgaggtaatagcgaataattatatctaaggcatatatgagatatttagttgagtccattacaaagaatttaaggaacatagtgagaaaaagtaaaaacggtactatatatataatattgtgtttatatttgggacggagggagcaagtagctagcctcttaaataagtatcatcctagtgggggagtaccatctatctatcgatcttcttccacacgcgcgtacgtgtgtgttggtcgtctcaaggttagttattgaaacgtatgtcttatattactaatttgtttcatccccgttgtatatgctatatatgtttttcttatcttatgtagtatatgtaattaaaataaataggagaagaattaagctggttaattattttttctggctggtatatgcataatagtaatatatagaagagattgtgttgcagggtatatatagcaaattaataatagatagatcgatcgatcgagtggagacgatgttgccgagaagccgaacgctcccgccaaggattcatgatggcgtcgtggtggtaagcaagcacagatgttgcagtgttggtaatggagcatattgatagatgctagctgcatgcgcgcgcgcgcggggtgatcgatatatgatatgatggatgctgcaggtagaacgcgatgtgaggaggtaccagcagctgccgcagcaggtggagatggagatgacgacgaccaaga

SEQ ID NO: 8580 - DNA, 1501 bp, Oryza sativa
agaaatagatgaaggattatgattaaatgaaagagagaatgaatggttaggatttaaaatgtcttttggtgggtgggaaatcattttaccatcccattagccaaacaagtctagagtgtaaataagccactcgttcttttcgcgaagcccttacaatgtacagtcctcctcctctatctctactgtattcaccagaggtgagcagaaaggggacccgtttctcattggtttacattaggtatttaaagggcttttctaaaaaagtctttagaagtttagattgttgtatagggttttgtctttccataacaattaaggagttagatttgtctagagtcttttgctttttctatttcgttatgggtggcttcttggttcgagaagttctcgacgaagaattgtgaagttacagttgtcgggttatcaattatcatatcggcagtacctactttagagtgcaagtgacaggcttgttcacagtttattgttgtatatgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctgggcagggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacaatccaaaaaccttattataggcactgtgattttacta

SEQ ID NO: 8581 - DNA, 1501 bp, Oryza sativa
ttttaaacatgtggatatattgatgttcaattcatttaggcaatgtggttaagtgatccttctgtcattaattgtctacttgtctgttgtgacagcttagtgcttttttagaaaccaacaattaactgtgactagtgggctaacgttacctaataattggttccatacttgttactttcctcttacctcctaattacctgtattttctctagggatagtgcacatgtatccatgtttaattggaggatttgctgctctttaaaaggacaatagatgtttgatagtatttaactaccaagtcccttgacatgttagtggcttcctgtattagtctgtctcaatggattttccacatatatacataataaatagtggaaaaatatgttgcccttgaagaagcaaagagctgtttggtatgtaattgtgaagcatgtgttgataaaatgtttagttttattgttgttaacctgagatatatagatctgacttgtgaagtacttgcctaacacacggatgaattggtccacctgatttgctctttggaaacataatgtatgcctgcttacctgcctttgttattctgttccagttttaactcaagtgtgcctagatgtgttgattattttctgtatgtagaaaggaagaaagaaattgattgtccacctcttgcaggctgcaaactatctcaacatcaagggatgggattgctggatctgagttgcgcagaccgttgcagacatgatcaagggcaagactccggaggaaatccgcaagaccttcaacatcaagaaggacttggcccctgaggaggaagaggagatccgcagggagaaccagtgggcgtttgagtagagatgcagcagctgctacatgtggccggtcggttgcaatggttgtaattattttggagtgagaatgaatggtggggtggggggggggggtgtggttagtgaaggaaggatgaaatgaaatgggggttaggttaactagctggtttatgaagtatgggtatggaagggaaaacaaaaactgaagattgttactataaggatgttatgtgcggctgcctagactgcagttgatatcgtctggtggatggatgatttattactgggattataaagtcatctgattgtcgtccattgtctcagtgtctgtctgtctatctatctaatctgtgccgcagtagtgttggaggaagtgccaggtggtgaggcagcagcgagtccaggccaagccttggcctggaggaaagaaagaaagaaagatgataaggcggctgggtgtgtctggtctctcctggtgttggttgccacacgtatatttgggccccttatccatccatgattttgttttgttttgcgaataattttggcgcctcaagttagccgataaagttgggagtagtacactagtagtatactagtagtagagtgagctcaagacaagaagcagtagcgagtccaaggcaaggcaaggcaggcgaaagcaaaacaagaaa

SEQ ID NO: 8582 - DNA, 1326 bp, Oryza sativa
actccgtctccgcgctgcggaagaacttccccatcctctcgctgctgtcgtcgtccccgtcgtcgccctcgttcctccactccgactccggcggctcttcctccgacggctccgacgacgacgacgacgacttcttcggccggcccagccgccgatcctccgccgcgggggcgggggcgggggcggcggcgccgtcgctgcagcccgcgggctgcgcctcgttcgacctcgcctcgcatccggacctcaagctcgcccgccgcatcgggagcgggccgccgggccccgcggggcaggaggtgtggtccggcacgctgtctcgtggtggtgggggaggtggggccaagaggtgtaagcatccggtggcggtgaagagggtgcccgtgaccgcgggggatgtgcttgagggcgttcaggaggaggtggagcggctgaggcgcgccgcgacgtggtgccggaatgttaccacgttccatggtgctgtgagggtcggcgggcacctctgcttcgtgatggatcggtacgcggggtctgtgcagacagaaatgcggcagaatggcggtcgcctaacgttggagcagatcctcaggtgtggcattgcatctaaacatggatactaagttttatttgcgtggttatatttgctgcagtcatgtatggttatagttgctgctatcaaactatcgatcgccgaaaatgataaccctaaaaatacagttgagctggggcgctatacgacagtttgtccgctaactgtatgtgttcaaatgcatggggtttcaatggtggttcgctaagctgcatgtctagctagaaggatcataaaaggtggaaaatgttgtagtttgagtactgacgtggaaagcggtttttgcgattagtagtgccaaatttgatctcaatgagtttgtagtatttgtacgtgttcggcaatgtttgggtgattgtcggcagctttgttattccatctgtcctgcatcttttgttgtgttgtgacatagtgcttaggtctattattaacaattatcacacttagtgcttggaggaatgaaagatcactctttgtactacgattaaaattcaagccaggctgctcaggaagttcagtgtccagtgaataacatagttttgttttgcaattggtttgttgatttaacacacatcaatcattctacatgtggagcttgagttctctttaatttgtgaacaaaatgatcacttgtatgtgctatgaatttgtactatacaatgtgcaatcgtttattcccaaaattataattcctagaatattgtgaggttcgtgacggcgacgaatgaaatgccaac

SEQ ID NO: 8583 - DNA, 1501 bp, Oryza sativa
ttaacactattactccctcaattccaacagtcactatgtttattattattataacacatctctctcgactaaattattgttattattttaaatctttcatgctcaagatctctgattctattgggtatatgcattatattttttgattgatccacataagaagaaagtgataataattgtttcgaaagtgataataattgtttcgatctttatggattaagggtgtaccttataatttgtaacagatggagtatgatatgatagttagttctctccccgtccttatatttttttatatggtctttagtggcatacagggtggatctagcatgagggcgacggggtctcgagcctccactactgacgtgagaactatagaagcccccacgaatcctccactaaaattttttactataaatagatggggagagggctatagcttcgtttagtttattcagtccctcatgttatttctttatccatcacgtgtggtctactttgaccattaatatatttcatattatgtgcccaatggatatgtaattagcataactcgaaagtacttcaaaatataaaacgagtgttataacgtgcataatatttagtataatttggttagtatgattattagtcaaaaggtaccaagtttaattttccttaaaacgataatttgggacggagggagtatcattatactctttatattatataaatataaataaataacatcactattgctttctaaataagctacgatgagagcataaaaacgctttcgacagtatcaattcctaccaaaaatgaaccgcaaaaaaattccataaaaaagagagccattccttatcggaatcagaacccccactacaggattcgcgctccgcacgggcgggcagcagcaggcaggctcgctcgagaccgatcgacacgataacgacacacggccacagtgcaccaccgcccggccgcacccgatccctcccctcctcggactccgcccccggccccggccccggccgccgtctctcgggctttactctctcccgtgccgtccacccagggccccaccccgccccctgaccccacccaccacccgggcccactcgtcattgcccccaccacttcgtcataaaccctccactgctataactgcgactgcgacgcactcgtcatattctcatatactagtagtatcaactacccaccccccacctcctacgcctccgccgttgcagctaaacccctctccctactcctcatccttcccatccgcatggatcgcgccgcgcgcctcgcccgccgcggcggcggcgtgaccgtggctgaataccgcatggtgcggggccgccgccgcggaggcgacgcggggccggtggtggtcatcgatgtcgaagacgacggggaggacgctgctgatgactccgccggcggtgggggtggagcggcggcggcggtgaagaggagggtggtggttccgggggccgtggcgacgcggacgcgatcg

SEQ ID NO: 8584 - DNA, 1501 bp, Oryza sativa
aatggcctaaatttgccacatatgattaaatgatgaggtggaggagagaagtaggagagagaaaatgagccacccctcatgcaaggggcaacctctacacaatctccaagaaaaatgcaagataatgtgtgaaagtgcattaatccccttagtgggtattggtgattaatgacaaatgtggttaaaggactaatgagttcattgagtgactttcaggtgcattagtccaaggtgtggaagatggaagcttggagacccccaaaaaaaaagtacaaaatcaaagcggaccggaactcgagaagtgcataggatagtttatcttttgaaatcgagtttttaggaaaaaccgtactattaagaggggttccaggtgatgctctaagatatatcaagtgctcttagtgtgaaccaagtgtcaagtttccctaggagtcatttttgcaaatactccatctgtccaaaaatgcaagtctggaacttcctgtcttccaagtccggaagttccggtcttgtgaaaaagattttcccaagtgtagtctggaagttccggtcttctaggtccggaacttcctgtcaagtttccagttcaaatttgtgagtaacggctagatgacgtcacctagccgttatacatatacagctcgtttccagctcgtcctgggctattccactttcacttttcaaacctagagctattgctagcctttcccaagtgtttcttgccttctccactgaatctagagcctaattcttgtgagaaagagagattgagagggagagaagaagatttggagatgtgtgaagactaggatcttgggtgagcacttggaatatctcgtgggctgtcatctcggtgcttattactcttagagatgatctcctagacggttaggtgtcgcccgcgagaatccgttgcatattgtggatgtcccgggtaagtttgtgaaggatttcctctcctccgaaaggaaacgaggtaagttagtgaagttcttgtgctgagattctaaaggctttccaagtagagcaacccacatttgtagtggatttatagaagtaggttgagttggatcttggtggtcactcaattctagaaatttgcctaggggtgtttggggttgaaggctgtggatttcctcaggggtttttgcacaagtgaggcaaggggttaatcgagacccagctctttggagctcctcaacggagagtaggatcgcaagatccgaacttcgggaaaaaatcgctcttgtctctttctgtgatgtttctgtgaatgattctgtgatatatcctctgcttagaatacctgtgcaccattttgtgaagattggcttagtctcctgtttcaaaatttgaatttcatctctgttttgttactcggaagttcctgtcttagaacaccggaagttccgggcttggcaggccggaagttccggagttccttaccaggaagttccgggtctgtttgaattttaccgctgcgatttgtttttaagatttc

SEQ ID NO: 8585 - DNA, 764 bp, Oryza sativa
tcctgcaccccggcgcgaatggccgacgcgaacagtcatgtaaaagagagaaagagatgagggttttaccgtagaaggggagccgacgcgtgcgctgcgctcccattttgcgtcgacgccgtctccaggtcccgtcgctgcgttgagccttgtcgccaggcaccccccctagccttcttgcccatcaccctgccacctgccgacgctggctagcctccttgccttgccactggccagcctcttgtccctagggtttgaagggagaggggaagtggtgacggtcagtggtggatccatgcacaatctatgggtcagctgaccccacaactttttgaaaaacgcgcttaaaatccttcatttttatgtataaatttaaaaagttagagaaataatctcacttaaaacttaaatataagctaatagttgacctcgcatgattaaatttttggctccgcctgtagtggagattggtggtgtggtgttcacttgtgcagtgggctgcgggcgcgtccgtttactccgctcgatagaattctctctgcttcgcccttcgcggtttatccgctacaccgaaaaaaaaatacccacaaaaccccgtgaggccgtgacaacgcgccatggccgccgcggcgcccgcgctgccggcgttcgcctcgcttctcctcccctcatccagctcgcctccccgccgcatcccgtggccccgccctctgccttctcgccggggcgctctccgccccgtcaagctgctccccgccatctca

SEQ ID NO: 8586 - DNA, 1501 bp, Oryza sativa
atttggacctagtcaaagccgttagcaacggtagtgaatagtagaactgattgtacagtttgttgtaggttacattgtcaatatattcaggaggaagggttgtgatacccaagaagtgtttgatgatctttcgggacattgcccttgaaactagaaccggatactgtactgtgaggctgtgaaaggggacacaatatatatggtctacgtctttttttttctttttggtgcttcaaattatgccatttgtcattttgccgacaacgacaacaagttctgaacagatggtgcttccagcatgaattgatcttagaaaaagcttcaagcaaaggcactaatctcccctctctttgtccaaacacgcaaaaatctgaattcattagaaaaaaaggattaaatttaagtgggatatcaaaatgatgcgaggatggatcaacatctgtagttggtggaacgaaatagtattgtcgttggcctgaaagagtttttagatgaaaccacgatttgtcaaaatgcatccaaaactttgggatgtctggatacaacaaatagcaaaagttttagagcatttgaaaattttatcaaagacatcttttcgtctcgctgagttctaatgagaagtggaactattccatcctttttcataagcacgcgtcttaaactattagggcacctgtaatggttatctataggctctctacaagagatccatgtcagcatatttttctacttagaagagattaaatgaagagagagagcaaaactatctatctactaacctgaaaatagtctatagagaaaaacgaggcaatggattagagatctataaatacccatgtagacataccattgaaatggtttactattaatctagtctattgctgagatgtacatgttttatagataacactttactttaccattgcggatgctcttacatgtatgttaattgtagccaacgagacactgtacctgcaaccacagtttagcacattctaattcgaaatcaagaaaatgacgtctaataagaatatttttactttaaattagatagtttttaattaaaataacacactgagcttctcgagtaaacaaaacaaacaaaaaaaaatcaccctgagcaagtcaatttgcgcacacacaccccatctgattcatcaataacaaaagacattgttccaatccagacgaaactgatctactgatccaccaccaacaccacccgacccaatcacaaactgtgtgttccaaattaagccattaattaataaaacaatatcattaggattaatctctcgattagaaaaatgaaaagggaaaggcaaagtccgaaacgtccaaaaccccaactcgccgcaagggagaaagccatttacaaggcaagcaaggaatcggatcccgattaatcatccgcccaagtgagtccacccgattaatccaccgccccccggcgccggccgcgtcatgctccggccattcccctcctccaaccgcaccgccg

SEQ ID NO: 8587 - DNA, 1501 bp, Oryza sativa
aggaaaacttaatctactggaaacggaatgtacaattggtcaaaaacaaaaaaaaagaaaagaaaaacctaatcatactatacactggaaacggaaaatattttaggaatacgcgtgtttacatcacttttagaaacattgaaatacaaaacaatcctaatcaaactctgccgtttccgaattgtattagtattgtcatgccaataaatacataaccaagccaaaaattagcaagccaaaaatacataaccacgttcgttgtggaggctagaaattcccacattaatcggagaaaaagaaaagaagagtctaaatagaaatacaatcaaaaatagctgaaattcggaattaaaaatatgcaatattgaaagagaagtccatataggaacccaatacatgattaattaaaattcggaataaaaataaaataaatttcgaaattagaaaaagaaaaaaaaagaggagttcgagtaggaatacaatttaaaaataactaaaattcaaaattaaaaagaaataagagtccatataagaatccaatacaagattaattaaaattcagaatgaaaatttaaaaaaaaatcaaaattataaaaaaagaaaataatagttcaaggaggaatacaatttaaaattaacttaaattcgaaattaaatataagcagtattgaaaataagagtacatataacaacctaatagtatattaattaaaattcgaaataagaaataaaataaaatccgaaattaggcaaattaaaaagagagttaaagtaggaatacaattttcaaacaactgaaattgaaaataagaaataaaaatatcaaaagaacacaatacgaaaaaataaaataaattctgaaattagaaaaagaaaaatactaggaataccatttataaataagtaaaattggtggtaaaaaatcaagactattgaaagaaaatatcatctaaaacacatggcgagattaattaaataacatgcctataaaggagtagagtggtggcggttgatatgacatataaaaactgttaataaaacaccaaatagaatcctaataacgattgaaatgaaggacgacgggtaggccgtgaagcaatcgatcaaggcggttgccgggacttctagaaagtaaaaaaaaaaaccaatgctaatcatattcatttttaaaatctcaatgagaataaaaaggagaagtagtgggcggggtgtataggagaaccgccgacggttggcgagacttctagaaaataaaaaatgaattccaacgatagttatgttcgatttttagaatcccaatgacaataaagagtaggcggcggatgggccatagaggagtatagtgacatcgtttaacgggacttctaaaaaattataaaaaaaatgaaaccaacaaagactataaagtctaaaaactacgaggtccaatttttataggtttggaacttctaaaaagttaaaaaaaacacaatgataatcatgttcgattttaaaatcttaa

SEQ ID NO: 8588 - DNA, 1501 bp, Oryza sativa
cttaactacattagtacttgtgtttatgtgtatttgggcatccggctacctagaagggaattgctactgggcgagcgatcgcccagggcgattggatccgaatcccacttcctccacctggtttccttttttggtaccgtaatactttcctattttagtaaatttatgcatctaaagtttatacacctcaaatttacatatctaaagtttagagatccaaagtttataagtcaaaagtttatatatccgattcaaatttaaatttgaattcaaatattttttatatataatatttctatacatctaaagtttatacacctaaagtttatagacccaaagtttataagtcaaaagtttacatacccgtttcaaatttgaatttgaattcaaatattagtttatagacccaaagtttataagtcaaaagtttacatacccattcaaatttgaatttgaattcaaatattagtttatagacccaaagtttataagtcaaaagtttacacccgttcaaatttgaatttgaattcaaatattagtttatagatctaaagtttataaatcaaaagtttacatacccattttaaatttgaatttgaattcaatttttttatgtatagtatttgtatttctatacataaatttttccaactttgttttattattttttaaaattatatggtgtactgtagtaagaagagaagaaggggaggagaaagggagagagaaggtagcatatagggggaggggtgggccggtgatcgctaggcgtccattagccgtcccctacctagaatgcatattactactaattgtgaatttgtgatccattgattactgattactgactggactagtaacacctcatgccatcttttcattctttctgagttgccgttcaacattggcagccttgtgcaccccgggtgatacgggggcccgctcacccgccgggtcccctacgaggctagggccggcgaacgattttcacccggatgtccctgcggggccgagggcagggggcaaatgcagggagtggcggcgggggagttcttatccaacccgtccccgccccgccctgttgccatccctagggacggagcggtggcagcccgcctcaaggcggagcgacggcgcgccggctgggtgactgtaacgccccgattttcgttcgggtttaaaaatcattaaataatgcattttctagaaattaaataaaagataaatcaatttaatcaagtgaaataatgggagaatttgaaattttcctttaaaaatcattggccgggaatattttgtaatattctttgtgccctaatgtactctccggaattttccgtgaattttcggagctcgagaaatagttttaatagcacaaagatcattgcatcaattagaataaaaagaaaacaaataaaatttcccctctttgtctttgggccgctttcggcccaagatcttctccccctccatcctcttgggcccggccgccctccttttc

SEQ ID NO: 8589 - DNA, 1437 bp, Oryza sativa
ccgatgaggacgcggtccggggagaagaggtcctggatggcggtgccctcggcgaggaactccgggttggagaggatctggtacctgatgttgccgcccttgctgttgtgggcgaggatcttctcgatggcctcggcggtcttgacggggacggtggacttctcgacgacgatcttgtcggagcgggagacgtcggcgatgatgcgggcggcgctctcccagtaggtgaggtcggcggccttcccggcgccgaggccgcgggtcttggtgggggtgttgacggagacgaagacgatgccggcgtcggcgacgtggcgctcgacgtcggtgctgaagaagaggttgcggccgcggcactgcctgacgacatcgtccaggccgggctcgtagatggggaggcgctcgctgttccacccctcgatccgcggcgccgagatgtccaccaccaccacctccacgtcggggcacttgagcgcgatcaccgccatcgtcgggccgcccacgtaccccgccccgatgcagcagatcttcaccattcttcttcacctacctacctagcttattagctcctcctctgatcccgcacggacagatcgatgcagagctaggcctaggaggaggtggattaattaatggtgaggatcggaagaagtataaatcgtacgtggaaatgaaatgggtttcggtgggctgagagtgaatgtagctagtgagcgatcaaccgccacttttaccgcgcaagcactgtgaccactccaccacagctccagagtcggccacttgctgtctttcgcgcgcgcggcatttgtaaccatcctcgcggaggttgatgacggccgggtccaccgccagcggcaggttcgtcacctcgagggggagcacgcggcggctgggtggtggccccgacgccggcccggtctcatggtggagcaacggtgcagtctcgaggggagcagcgacggcccccctacgggggcgcggggggggggggggagtgcaaatttcaccccgcgggtccatcggggcggggccccggaatgccatgaagtctacttctactccttcaacagttgaggtccagttgaagcgcaccgcaaggcagcccaagcccaaaacgagatatatgggtggagtgtgggtccagtagctatcggctgggcctagagtcagtgagagagacctaatagtgttgtgctataaaggtcggcagtggagagagagagatggcttgtaatagaaaaatatctcaactcaattcaaatcttctctcttcctgctattaaattcttccctgaactcgtcttcttcctttgttcctacttccaatctctgtctgaatcatgaatctcgctgactaatcgtgacattctggtatcagagcctcaaatcctggagaagccacgctacacatctcggctgcagctgcaggtggaggcg

SEQ ID NO: 8590 - DNA, 1501 bp, Oryza sativa
atacaaatactatacataaaaaaattgaattcaaattcaaatttaaaatgggtatgtaaacttttgatttataaactttagatctataaactaatatttgaattcaaattcaaatttgaacgggtgtaaacttttgacttataaactttgggtctataaactaatatttgaattcaaattcaaatttgaatgggtatgtaaacttttgacttataaactttgggtctataaactaatatttgaattcaaattcaaatttgaaacgggtatgtaaacttttgacttataaactttgggtctataaactttaggtgtataaactttagatgtatagaaatattatatataaaaaatatttgaattcaaatttaaatttgaatcggatatataaacttttgacttataaactttggatctctaaactttagatatgtaaatttgaggtgtataaactttagatgcataaatttactaaaataggaaagtattacggtaccaaaaaaggaaaccaggtggaggaagtgggattcggatccaatcgccctgggcgatcgctcgcccagtagcaattcccttctaggtagccggatgcccaaatacacataaacacaagtactaatgtagttaagtggtatgtatgataaatacacaactaccaactcacaagcaaagcagcagccagccaattagcagtatactagtagctttgctcgaggttgaggagctggtcgcaggagtcaagcttagctcgaggttgaggagctggccacaggagtcaagcacttggacagtcggatggcagacctgcaacgcgcggcgatggcgctccactccggctcgatgttgcgggctccggcgctctggtcgccagcatcgcgctccgcttcaccgccacgccgccgtcgccgccgcacgcaatgggcgcctgggagctaccaaactgatttagggttatcgattcttcagattttcttttaggaataagttcactttaggtccctctatttgtcgtccagtccgattttcgtcccttgaccgtaaaaccgggtatgacccatccccaacttacgaaaaccggttaaacgtggtccctcggcggttttgaaggcggttttggctgacgtggcgcctacgtggcttgtttgactaggtcttcatcccaagtggcattgacgtggcgcttacgtggcaattatatctcggaaaaataataaaaaatgtggccccacatgtcatctgtaaaaaaataattttaaaatagtggggtccatgtgggccccacatgtcagccacactcctctcttcttccctctcccttctctctcttcttcccttttccctctctctctccccttcccgggcagcggacggcgtgggtgggaggcggagcaggcgagctccggcggtggcggagggcgtggtcggcaccgccccctgaccggagcaccaccggtccgcgtgaaggcagatctggggaggtccggcagccagcgctacggca

SEQ ID NO: 8591 - DNA, 1501 bp, Oryza sativa
ataatgctcgcatttcatacgccaatcctgtgggtccgaaccatcaaaaatcggaaaatccaacttaggcattcgatgattgaaggacttttcccaaaattgcgtcccaaaatttccctcaccactctcccaattcccagcaaaattaagatgagagggggtggcatcgtacgtactcttgatcggagtcaggaccagggatgtgaccacccccgatgcccttccccggaaattttgtggtgcgcggtggccattggcccacttctctgctcctcccgctgcagtcgtctccttcgtcggcgaagcgggcgtgggaagcagcgacgccttcctttcctcatccgtcaacggaactcgaggggaagatgccgccgtagaagtttgcaccgccttgccgaggagatcaacttgctgacgaagttcgccgacctcctctcgcagctcctgcacggcctcctccacttgtggcctccagttgttcatgcctagatccagcttgacgatggcagcttgtgtctcaacctgagcccgattcaacactacgagcgactcctggatccggacaagcaccttgccgaaatcgatggtttgctttccatcgcctccacctgcagctgcagccgagatgtgtagcgtggcttctccaggatttgaggctctgataccagaatgtcacgattagtcagcgagattcatgattcagacagagattggaagtaggaacaaaggaagaagacgagttcagggaagaatttaatagcaggaagagagaagatttgaattgagttgagatatttttctattacaagccatctctctctctccactgccgacctttatagcacaacactattaggtctctctcactgactctaggcccagccgatagctactggacccacactccacccatatatctcgttttgggcttgggctgccttgcggtgcgcttcaactggacctcaactgttgaaggagtagaagtagacttcatggcattccggggccccgccccgatggacccgcggggtgaaatttgcactccccccccccccccgcgcccccgtaggggggccgtcgctgctcccctcgagactgcaccgttgctccaccatgagaccgggccggcgtcggggccaccacccagccgccgcgtgctccccctcgaggtgacgaacctgccgctggcggtggacccggccgtcatcaacctccgcgaggatggttacaaatgccgcgcgcgcgaaagacagcaagtggccgactctggagctgtggtggagtggtcacagtgcttgcgcggtaaaagtggcggttgatcgctcactagctacattcactctcagcccaccgaaacccatttcatttccacgtacgatttatacttcttccgatcctcaccattaattaatccacctcctcctaggcctagctctgcatcgatctgtccgtgcgggatcagaggaggagctaataagctaggtaggtaggtgaagaagaa

SEQ ID NO: 8592 - DNA, 1501 bp, Oryza sativa
tttcatattataagattttctaacattgtccacattcatatatatatatatatatatataaatgaatcttgacatatatatgtgtatatctatattcattgatatctatatgaatgtggacaatgctagaatgtcttgtaatatgaaactgagggagtataaaatatcaacaaatggaagaataaatctatctattatattattaaaacagctttgaaagaaggcaccacgttcgcggtggggctagaaattttcacattaatcgaagaaaaagaaaagaagagttaaagtagaaaaacaatttaaaaatagctgaaattcggaattaaaagtgagcaatattgaatgaagagtccatatagaaacccaatacgagattaattaaaatttgaaataaaaataaaatagaatccaaaattagcaaaaaaaaaggagaagagtccaagtagtaggaatacaattttaaaataactgaaattcggaattaaaaataagaaaaattgaaagaagagtccatacaagaatccaatatgagattaaaatttggaataaaaatgaaaaaaatcgaaagtaggaaaaagaaaaaaaagaagagaggagttcaagtagaaatacaatttaaaattaactaaaattcagaattaaatataaacaatattgaaataagagtacatataagagcatagtagattaattaaaattcagaataaaaataaaataaaatccgaaattaggcaaattaataagagagttaaggtaggaatataattttgaaacaactaaaattaaaaaaaaaaatatcaaaagaacataatacaaaaaataaaataaattctgtaattagaaaaataaaaataagatattaactaggaatacaatttataaataactaaaattggtgaaaaaaaataaaggctactgaaagaaaagaccatctgaaacacatgacgagattaattaagtaataggtctatataggagtagagtggtggcggttgatgggacatctaaaaactattaataaaacatcaaatagaatcaaaatgacaattgaaaggaagggcaacgtacaggtcgtgaagcaatcagtcaaggcggttggcgggacttctagaaagtaagaaaataaacttcaatgataatcacatttgatttttaaaatctcgattacaataaaaatgagaggccacaggcgggtcgcataggagtacaatggcagagccgccaatggttggtgggtcttcaagaaagtaaaaaatgaattccaacgatagttatatttgatttttacaatcctaatgacaataaagagtatgcggcggacaggtcgtacaggagtatagtggcagcgtttgacgggatttctaaaaattataaaaaaatgaaactcaacgagacaataaactctaaaaactataaggtccaatttttaaagattcgggcttctaaaaagtaaaaagataaaccccaatgataattatgtttgattttaaaatatcaa

SEQ ID NO: 8593 - DNA, 1501 bp, Oryza sativa
attcattggcctttctggcacgtctatatatacaccggttgaccgttgacactgaaaagcgaccggggatgggcgctgcgtgatacggtgatagccgatcaagatggatgcagtgcagctagcactcgattggtagcacgaaacaaacactgcaacaagccaacaatgcaagtaagtcgacgtcggtcgacgcagattaattcgagcgatcgatgaatgtacccatgccaattttatttgcactgattggatgtcagcgcagacaactaagggcctctttgattcggagaaaaaacatacaaattttagagaattttagtcttataggaaaatttcctaagaaatcctttaaaacaaaggattgaatcctatctaatcctttgaaattcttgtagaatggataattctatagagattttggaggaaatttagtaagagcttcaacctcttgataactttcctttgagtccatctctcccatccaattcctgcgtttttcttaaggttcaatcaaacggttattcctatgattttcctgtatttttacaattatttgttttacacttagatttctatcaaaatcctatgtttttcctattcctacgtttttctaatcctgcgattaaagggacgcttgtctacgaaacgctcaaaaaaaaaaaaactctccgagaatcaagctcaatcgatcgctagctcgcgcacatggactcgcatatcgatcggccggccagctagctgaacagcacgcacactggaagctagcagcaaccaagcaggcaagaaacacgcatggttagttgtattccatggttattggttggagcagagtcgtcagagaggtaagcagtaagctcgatatccagtgagacgaggagcccacactttggcgcgagttgcatgctttggaggtattagctgccccgtttggaggtttgcgtgcacgaggccggcagccgggcaccactcgcagaagcaatccaagcaacaggccgtgactgacgtgtggactccaacacacatacaggcaatcacattctatggccctgctatgagatgaacacacgcgcacaccagcacactctaccctttacaagcaattccgaaagactgacactactacaaaacatcaaataggtgtcgacactaaagataccggaagtgctaaaaccaacacctatagaccttttcccacctccgtagtctaaaaacacaaaaaaccggcacctttaagtgattataggtgtcgctctataaaaaaccgacacctttaattcattataggtgtcgatttttttaaaaaaccgacacttttaataaattaaaggtggggcccaccggtcaaccgagccgagcctaaactggaggtgtcaacttttaaaaaccagccgagccggtcaactgagcaggtgggacccaccggcgctcttttatctctacctctctctcgttattatctcttcctctcgaactctctcggttcttctctctttctcttcct

SEQ ID NO: 8594 - DNA, 1501 bp, Oryza sativa
tggaaactatatatctagtgttttgggttgggactagcctgataggggtttttattggacggagtagtacatgccgaaaagcccgggaaaggaacgattgcagaaaatagactattgtcctgtttaggagagcttaagatttcgagaagcagctggttggtaaccagcttctgagaatctggaaaagctgggtttccagcttctggcttctagttcattttctggattttataactacagcttctcaaaatctggaccaaaagctagactatttagggagcttctggttctgggagaagttgtagcagttagaagctcccccaaacagaccctatgacgtcttttcttctccttcttggttttgctgccatgaacaaatgcgatgatcaaacatgaacggggagcgtaataggtaatatacttaattaatcatttgataatgacatgtctcattttacgtgaaataaattagcctaactcgaatgcaccctaacacacaacagagaagaggtgtaaatttcttcatctgttttacggagtattactttctgatacggaggtgcaatggtcgggatcatccgtttatttaggggttgtttggcaaaaggacaaaaaaaaaaccttcagatcagtccgtttgatccattatttaattttcatcgcattctaaatggattgcaggtaagtcttcttatccaaacaagggcgtggctcacaaacatgtggagtactattgttcacaacacgattacatttgtgatccgttttccttgttgtcgtgaactcgtgatcaatgtggcgaaattcctaacccgtcaaaaagcaactgtgaatttaaaaaaagcaactgcgaaaggaacctaattctccttttctaccgtccaaatggtccaatgatacttgtacttcttccgtcttaaaaaaaacaacttctatcgtttaaaatttatctgagaatacaccaactactcattcatccgttttccttctttatcaaaaaaaaaaaatcatctcaaccaatgatctctttaatttttttcaccttctttctcacaaacatcccacctatcctagctgtttaatttcactaattcccaataatcctaggctcctagcgaaaaaaattataactaatgtactgtaattagtataagatgatagattgatcctcaagatttgtcttacaattggtttcttcttctggttaaatgtacgggcgtagtagcatggtcacaaagagatgattgggacgtagcacttgctagttgcagctgcagagaccgcagcagtccagcatcaccagaggaaaaggaaaggtgacatgaatatgatgcgtatgtgcttctaaaatgtggtcctctaattttcgtcacgggacgctgacgatcagcgataaggtacatggggtgtgtactgtgaactgtgaagaggagtggaccaagaagaggagtggaccaagcagatatttttgctctaaaaattgatcaacagtaatttcaga

SEQ ID NO: 8595 - DNA, 1501 bp, Oryza sativa
ccatatcttgatgaaatgtgatggtagtcacttgtcgccgcagctgaggtgttaaggatgccaaattggtgctgccactactgctgaaggccttgtgttggccgtgcctcctaccggcgccgttcatctgctccgattccaatgagacgatgtctctatatcaaaaaactggaaaccaagagctcatgtaaacagattgagatatcgatcaatcgaaatatttaaggcaaatttcctgtgtaggatgccatgttggagatttactagggcacgagatattgaagggaaatatggaagagaaattgacttgtgggagcgttaattatatactccctccgtcccgtaatgttgcaatctagaatgggatgagacccattctagaactacgaatctggacatacctcattatgggacggagggagtacaaagttaagttgtaaggaaaagcgtgacaacaaatgatttataggggtatttaatgtttatataattacttagtgtttatatttagtagtacaatatattatcagaccttttaaaactttgatagtcaattttgtattagaataatattataaaatctaatagatttaggatactatgattgtactcttcagggcaaatccatgcatatattcatgattcttggccaaaatatgaaaaaaaatatgcagtacagataagtataaaaaaaatacatgtatataggagtacacaaacacatgtatgacatgctttttatattatgcaagcatacgtcatgggtcgtacaagctcaaataaataacagccaagaaaacatcgtggacgcgacaaacagcaaagagtttctagtgcgattacgcacagcatggatcctgtttcaatccacttgagttgaaattcgtcacaaaagcttcgccccaaaggcaccattacatcgtgctgtccactgcattacatcattgatgtatttgatgtagatgtgtagtaattttgctgagagtaactagcagcccataagaaaaaaacaatcatcacacaagcaaaatcaccttttaacactccaggaaatgccattgaacaaagaataatttaggtgaaacattttgctgggaacttgttgaggacatttatgttttagccccccccccccccccccaacaagtttcctcttgttacagtgaaagtgtgtagctgcccttgcaaaagttgcaatctggtccagccctgccctggccccaatcttagctagccaagagccccaagattccaacctaactctaataatttgattccaagaaagcaacatccatccaacccatcacccaagacctcccatcaacattcactctcaaaaatcaccatctaaactttaagattaatagcattatgaacacttcgaaataccaccaaatttttaaaccccctcccaaatccacccaaatattttttttacactccagccctttaaccgtggtagtgtgcgtgtgtgtgtggtgaccactctgacttggcggcg

SEQ ID NO: 8596 - DNA, 1409 bp, Oryza sativa
gaggagcgcgcacccggagtggagccccgccgccgtgcggtcggcgctcatgaccaccgcctactccacctacgccggcgccggcgacgccaacccgctcctcgacgcggcgaccggcgcgcccgccacgccgttcgactacggcgccggccacgtcgacccggccagcgccgtcgacccgggactcgtctacgacctcggcaccgccgactacgtcgacttcctctgcgcgctcaactacacgtccaccatgatcgccgccgtggcgcggagcaagagctacggctgcacggagggcaaggcctactccgtgtacaacctcaactacccgtccttcgccgtggcgtactcgacggcgagcagccaggcggcggagagctccggcgcggcggcgacgacggtgacgcacaggcgcacgctcaccaacgtcggcgcggcggggacgtacaaggtgagcgcggccgccatgcctggcgtggccgtggccgtggagccgaccgagctggcgttcacgtcggccggcgagaagaagagctacacggtgagcttcacggcgaagtcgcagccgtcgggcaccgccggattcggccgcctcgtctggtcggacggcaagcacagcgtggcgagcccgatggcatttacgtggacatgatgagcgccgccaagtcagagtggtcaccacacacacacgcacactaccacggttaaagggctggagtgtaaaaaaaatatttgggtggatttgggagggggtttaaaaatttggtggtatttcgaagtgttcataatgctattaatcttaaagtttagatggtgatttttgagagtgaatgttgatgggaggtcttgggtgatgggttggatggatgttgctttcttggaatcaaattattagagttaggttggaatcttggggctcttggctagctaagattggggccagggcagggctggaccagattgcaacttttgcaagggcagctacacactttcactgtaacaagaggaaacttgttggggggggggggggggggctaaaacataaatgtcctcaacaagttcccagcaaaatgtttcacctaaattattctttgttcaatggcatttcctggagtgttaaaaggtgattttgcttgtgtgatgattgtttttttcttatgggctgctagttactctcagcaaaattactacacatctacatcaaatacatcaatgatgtaatgcagtggacagcacgatgtaatggtgcctttggggcgaagcttttgtgacgaatttcaactcaagtggattgaaacaggatccatgctgtgcgtaatcgcactagaaactctttgctgtttgtcgcgtccacgatgttttcttggctgttatttatttgagcttgtacgacccatgacgtatgcttg

SEQ ID NO: 8597 - DNA, 1501 bp, Oryza sativa
aaattactacacatctacatcaaatacatcaatgatgtaatgcagtggacagcacgatgtaatggtgcctttggggcgaagcttttgtgacgaatttcaactcaagtggattgaaacaggatccatgctgtgcgtaatcgcactagaaactctttgctgtttgtcgcgtccacgatgttttcttggctgttatttatttgagcttgtacgacccatgacgtatgcttgcataatataaaaagcatgtcatacatgtgtttgtgtactcctatatacatgtattttttttatacttatctgtactgcatattttttttcatattttggccaagaatcatgaatatatgcatggatttgccctgaagagtacaatcatagtatcctaaatctattagattttataatattattctaatacaaaattgactatcaaagttttaaaaggtctgataatatattgtactactaaatataaacactaagtaattatataaacattaaatacccctataaatcatttgttgtcacgcttttccttacaacttaactttgtactccctccgtcccataatgaggtatgtccagattcgtagttctagaatgggtctcatcccattctagattgcaacattacgggacggagggagtatataattaacgctcccacaagtcaatttctcttccatatttcccttcaatatctcgtgccctagtaaatctccaacatggcatcctacacaggaaatttgccttaaatatttcgattgatcgatatctcaatctgtttacatgagctcttggtttccagttttttgatatagagacatcgtctcattggaatcggagcagatgaacggcgccggtaggaggcacggccaacacaaggccttcagcagtagtggcagcaccaatttggcatccttaacacctcagctgcggcgacaagtgactaccatcacatttcatcaagatatggattaggaagatactcgtagatgtggtgtgtttctctgatcttagccttttgtattgacgcacttccagcgatcaacgttgaacgcttactagctactctctccgtcccacaatataagggattttgagttttcacttaaaacgtttgaccactcgtcttattcatttttttttgcaaatataaaaaatgaaaagttatgcttaaagtacggtagataataaagtaagtcacaaataaaataaataataattttaaaattttttgaataagacgagtttcaaacgttacgtaaaaacttaaaatctcttatattataggacggagggagtagtaggtatgagaagtttgagtcagccataagaaatcaaaagaaacaaagagggaagtggggtgatggaagagaaattgacttgtgatgagtgttttgtatatatagagttaagttgcagggggaaagtggagaaaacaagtcacttgcagggatactgggatcgattgcttattattttatagcctatctctaga

SEQ ID NO: 8598 - DNA, 1047 bp, Oryza sativa
ggtcacttgttcacttggacttcggagaggcatgcagttattgtacctcacatatttagcgtcagacggtgccattcatcacagctgcatttcacttgggacaaaacggaaacatgttgatgcaacgattgttgctctcttgtcagattaatttggaacatcatatatagtgtgcttttgacctcaaaacggctaaagattgccaacatctttttgggacttggctttctgctttctcaaataaaaccaaaaatctgattgtcattggtattgctgctgtaatctggactgtttagaagaccaggaataaagtctgctttgataaaaatttgcctaatgatcccactgatgtagttttcttggtttgccactggatggaatcatgggctcttttgtagaagctggaggcagatcaaagaaggctgctcttggggccaagctcataagacaaattgcaagtgaagtgtacaactccagatttggatggaggccggtggggaggctgcagtgctgatcttttgctgttgggttttcggtccttgttagtccctgaagtcttgttagagcaggtacaatagcaggctataagccagctataaacatattttaaagagataaatgaagagagagaagagcagcgggctacagatcagtagccagctgcagcacggactccaagacgtaatgtgtgtatgacaggtgggaccaggtattaatagtatagtaaataactattgtatgaattggctattacattggctatagatgatttggtgctagtagtgggatatactattaagggcttatttggtacagctccaactcctcaatttaactccaggagttgggtctgagtggaattgtggagctgtctaaacccagctccacaactttagttcattttgtgagagagctccacccaacttcactcccagttttggtggagctgaaactgtttgctgagctccagctccaggaggggtggagcttgtcagggttacggataaggtataccctctacccttggatatatgtcgtgtattgata

SEQ ID NO: 8599 - DNA, 260 bp, Oryza sativa
acaagagatgagggaggttaaatggacttattcctataaagtataccgccatttcgatgtctggtccctgaaggccctggacggctgcacgcgccgatgctgctgcccaatagccgctcgcccgtggcccagtggcccgtcttgctgctgcagtgtcagaccagcccacattttcctcccccatacaatgggcccaaccacccccgcccacagggtggctttgccttgctctcacgcactcacgctggcctccccgtagc

SEQ ID NO: 8600 - DNA, 1501 bp, Oryza sativa
ttacattgtttttttttgcaggaaaaggttggaagcgctgaacagtggaatcgtaaaaagagggagccaaagttctccagtgcaagagacaactcctgcagtcaggaagaggtggttcctttggtaggttagttttcgttttctgatttgcaaaccagtgtagcatatggtatattattggccatgggcatgcactcgttcctttccacagtatgctgtctccaaaccaacaatcgcacctgctaaccagtacaatttgcatttatacataggctccacccccaacttccaactttccatcacatcacatcacatccaaaactttcctacacacataaactcctaacttttttttttccaaactaccaactttccccaaactttcaacttttttcagtaactaaacacagtcatagctgcgagtctaatgtgagatccaggaagtcaaaaccgtggagccattgctcctaatacactcatacatcttgctgtgccttgtgaacttaccatagccaaccaaatgatctgtaatttttccactattgcctggattgttttcgttgtcagtagagtaattactaattagctggtacactcaatccagtacggtattgttgaagtacattgatccagatatccggaatagcctattagatttcttggagcaacatcctgaagcaagatagcaacttgagatctagtgtgttttcatggacaataacacgtgcgtcccaggtcatgctttacgcctcacgatgaagattacaccgtactcgtgtcttcatcagttattccactcaaaaccgcattcctgaagattcgttgaacctttgtggccatgctcacttgggttaggacatattctcggcgtttaagtctagtgtggaaagattgttcaggtacccccccccccccaacccaacccccccccaaaaaaaaaaatggatgtgagtattggaagaatgggagtattggatttacgtttttgcgttagaatcaagatggacaagcagataaacactttatttttcgttagggaggaaaggaaaatataaataactatggaacaggctgataagggtgagttagggagaaaaggaaaatataaataactttggaacaggctgataagggtggatcctgcggttgccataacgtagagaagattgtactcgaaaccaagatcaagaacaagcaaccgcattccgttggccgggatgtcaagcgtggaatcgtttcatgtggagctcgccgcgcgagtgagagagaagttgacttccccagacttgattggcgaaaaagccatgcttaattccaacgacacacgcttggtcagagctcaatatgccaccaatagaccccgcctataaaaaagcgcgcgagcctgttccatcgtatcacaaccactaacgtgcgttcacccccctaacaactatctcacccccctaacaactatctcaccggctcgatcaatctctcaccggagatggtgcccgtccgg

SEQ ID NO: 8601 - DNA, 1501 bp, Oryza sativa
tgacttatctcgttttatatgtgctaaaaaaaagctcaatcccaacatctctttcaaactcactcttgctagtatattgactcagatgacacctactcctatgtataagtgtgagggtccactaactcatctggatttgcatttgcgtcgcacgagtcatcgacgtgttgtgtgttgaccagcaaaacgtctaataaatctcatctcatgtcttcaggtaggtcgtactatatgaaaaggcatctacgtttatcatgttcatcttccataagaagtcagagccctatcgtcgtgcgaacacatggaagtcaccaggtatattatccacgtaacctttgcttgcacgaagtgagttctctaagtctaagctaagtggcatgcttgtcatagaagcaaatcatgaccattgacaacctctcaaacgataagatcgccacatgtagaattactatatgtctaggactattattatataatgaaattaaaaaaagcaaagacctttctcgctaaaaaaatctgaattattgcggtagtgagcccaaatgctgtttaattgctcacgtaaggatcagtgaagcaaagatcatgcagcaactgggagcgatgcggcaatttcaaatgtggttttagcaggatcttcttgtcgtcgctaccaggcgagcaactcgctgccgtccagggtttcccaaaccgccgaggtcggggttaccgtgtcccgacggtaagcacggttaccgcgcggtaaccacggtaaccgtaaaaaaccatacaaaatcgtgtaaaatttatcaaaaatttaaattattttttaaatttatttgaatttaagaaggttaccgtggtatttatattaccgtaccccggcggtaagcccgataaccgcggtaaccgcacggttaccggcggtaagggaaaccctgctgccgtcctctattgccttttttgttctttgatagatggtggatcgagaattagaatccggtgtaagggtgtgttgtcctgaaaaaagctgaaagtttgaagaaagttgagagtttgaaaaaatagttgaaagtttatgtgtgtagaaaagtttttgatgtgatgaaaagttgagaataggaggaaactaaacacggcctaagcaacttgcaataagagctctcaactcgtggctactgtactgtctgaacatgaacaaataatttgcggcgaaatttacagtttgctttgtaatgtgctctctcaacttgtggctattgtactgtccgaacataaacaaaaaataaaatgaggcgaaatttatggctcttttgaatcatagaagtgagaaagcgttgcaatagaaaacaatataggattttcacaggaatccgatgtaaaatatatgaaaaacacattgatgatcatttgaatagatcatagaaaagacataaaaatcaaattagaaagatccacccaaaggaaatttaacaagagattagaactcttactaatttttctacaaaatctttatgcacta

SEQ ID NO: 8602 - DNA, 1501 bp, Oryza sativa
tcccggtcgtcgtgctgttcgtcgccctctgctcgatccctggtgagatctgagctctcgcctcacctaaggcgggtctgtttaccatttttttatgttgctaatttgatcgcgcggacaacttgaccgtattaatcgcatgtgttttttctattgcttcgatgggaagtgctagcaatttttttaagtttgtgtaattgcaatggatttgtagatggccagaaaattggctgcaaggtaaggtattggatgtgattggcctctcaagttcaatcggcgttgccggaagggaaagtagaaatgatgatttatggagccctgtgtgcaaagcaattgaatttaatcagattggtcatagcaccgcattgattttaatagcaaataggatcagcaatttgaatagcatataaggtatgtttggaaaggaaaacttagccagagtagtacacattcctgattaaatatttccaaaaaaaaaggagatatggacaagagggaaggtctttagttatatgcctgtgatgcagacatctctctcctggtccgagttgaatcaagcaatgccgaactctggacagtctgttttatggcgtatttattggttcagctgaaggaattttttttctcagacttcataaggtagtttaagtgttgggatgttctttgacaaataatagcggaggacagattgtctttcctactcttgttcctgccatattgtcctaataaaggatgggcaaattttggatccctcacctaatattattacacggaaaatgatttgtgtactaatttctagggtcacgtgagaggaacccgattcccgatttgaggagtagggcataacactataaattgatttctgcatatataatatgctgcatttcacaagttatattcaaacagacttgctgtgatgagtccaggggactcaaccagcgatgctaggtaaatgtttagttaaaatgtaacgatatggcctatttctctagaacctagataatgatcggtactgtgtttatcctgctttgttgttttcttaaaataaggctggctactgcctatgttccaaaacagaaccgtgctctccctctgtaaaacattgtctggtttggttattagagcaatagattgaatgctccgcacctcaagtcattgatgattttatcaattccagttagtaaattatatattgcatgcccatgttttatgtcattgacggatagcctcaaagaaagaaaagccaaccgatacttctcctttgttaaaatagatcccagtgtgacacgagtttgaaatacgttattctttttgtggggttggggactatatggaaggtaaactggtaaagtgcccatttcaaagccgtaaaggcttaataatccttaatgtctcttatctctgacgagatggagatgggtaaaactgaaagtcatggatatttatagtagtatcatttttaactgctattttttgcgttgtcttttctgatacttggaga

SEQ ID NO: 8603 - DNA, 198 bp, Oryza sativa
agggcaagcaagggatctcgcagtgtagacgagcctggtgggagggaggagggagagggagagtgacagttgagacttgagagagagagagaagagaggcagattgggagcagttggcgcgtcgccgtcgcgcgccaccatccccaccctgcgccgcgtgctgcagcgctcgcctttattacgcccccgccccgcaga

SEQ ID NO: 8604 - DNA, 1501 bp, Oryza sativa
actaataatcaacttgcaactaataatgttagtaataattttggaaatttattttggatgttagtaatcactaataatcaacttgcaaccggaaaaatcaacataagccagagagagaaatttaaataccttcaaatggaacccgagatccacaagccgacgcttgagggggcgaattccactgcaaccttgcgctcgccgagaggatgaactagcacctgatgaatgagggagagagaggggacatgagggaataggggagaacaaactgggaggtttgaggagcaatttgcgcagtgaaaaattgcccaatctccacctccctggcacaaaaaacgcatggaaaaacagccccatcactccacctgttcggctcaaaaaaaccgcaacgaaacagccgcatcacgccgcaacttaccgaaaaaaatggccgccggatttggtggagagaaaaccacctccgccgcagcctacgcttcccaccgcaactgccggcgcgatgagaggaaaccgtcggctccacgcctccaccgtcggctacgccgacgccagcgcgacaggaggaaacagcagcaactccccaccccaccccccattcgccacggatttcgccggagattcacgccgcctccacctctctctcactctccgcctctctctctctctctcgtcgagcgccacccaaaacatttgaacagtaaaccctcgcgtgagctcgctcggtcggccggtcgggacgcgcggcgtgcgccgaatggacgccacgttgccaatcgcggatcgacggctgccacgcgcgtcgcgcgatagcactatacgaaaaaaccgaagattcggtgcggttcggctcggttctgtgcggcctacagttttcggtgattttctgcccagcctcgctgccgcaaagagacttttgtccagttggttgcaagggagtgcaatgtgtttgatggtattttgttatatgcaaggaaaatttacagtggccatagcaaggaaacaatgtgatatactatgtgaggttagctagcttgtcattttgtgcgtgcatgggccatgcaaatatatgaatgtatatgccgtatatatacacaagctagagaatcaaaggctagcatttgctaattggccagtggggcaattatgtacgtacatgcatgctccatatgcatgcttatcgtattaagcgtgattaacggtgaagtaattatcgtattttacgcgtcgccggctggataaactgatcaaggcccatcaaaaaccaacagagaagccacccaaatatttgttcatgcacggaggagataaaatccaacgaaccaagagataatgagcataacaaaccagatgacggcggcggcgcacattgtcgaaacatgatttcggcaataataaaaggggtagcacacgagacctaaaagtggatggatgcagagacaaaggatttagacaggttcaggccctctcaatgagaggtaataccctactcctgtttggggat

SEQ ID NO: 8605 - DNA, 1501 bp, Oryza sativa
cagcacatcatgacatcccacctcaaaatttttacaccctatcacatcggacgtttgaacacctgtataaaaaatattaaataaaggctaaaaaaataactaattgcacagattgcgactaatttgcgagacgaatcttttaagcctaattgctccatgatttgacaaaatggtgctacatcattcaatgattgcagtttactggcggattctgtaattagtttttttattagtacccaaacacctcatacgacaccctatataatatcggatgtgatacgcgaaaactttacaccccttgatctaagcaccccttaatacatggtatttggtaagtattcccaccaactaagcacggctgatcctctttaaaaaaaagaaaagaaaagaagagcacgctgatcctacaagagtggaaataaatgggacgaggtgaagaattgcatagtttcaaaaatatctgtaaagttgtttcgatattaaaagagtagttgcagcaaatcctttctttctatatagtcacccaaagcttaactatggttaagccacgtcaccacttaatcctcagccgttcgatctaatatgaatggttgcacacgcgtgaagcccagcccacgtctctttccggagtttgttggtttctccagttgtcgtaggctctccggacctctcattatatttgaaagatgaagtgaataattcaagtcatcaaacaaaaataatgaaatatccgacgcctagagagaaaaatattggagacattgttaggcctttagcttctcagtcaacttcagcctgagatgtgcccgtcaaaccactcaaaggcagcgaccagatgtgctacacattcaggagacttgacagaatggctaaagatctacaacatctcaaatattcttaactcatactcatgtgaatctagttcccaggatgtgcgaactagattcatactttcatcttaaacatggaattacatagcaaaatacatttaagacgaaagtgatctaagatttacaactatttatagttataaggtccgaccggccaaatatagatatatcagagaacagcggaagcttgactacccaaatacaagcacaccgactaggggtttacccaagtaagttcaagtcctagaagaagcagtcgaaacccgcatcactcctgcacaaatggatatttcaacatatcaagcatcagtacattaatcaaattaatgtattgccaagcacaagataatcctacatactacatgtaaggcatatattcaaagaaaggcaatatgtagttcaatttcaacataaagcaagttttgtttcacaattcttctgtaaagggagttggtgattcagttaacaaatcatttttgcatgtccatcataaatatcattatatcatcataagcatactcttgttgtcttccttggcaacaagtcatataatcatcatcacactcacacaactcaacataattaacccatttcaatctcaagttaaacac

SEQ ID NO: 8606 - DNA, 1501 bp, Oryza sativa
aaatatttgatgacccttctcctgcgaaagaccccgaggtgcaagagaccactatccctaagaaggccactaccagttctgaggtgcctagaatgcttaggagccacgactccaagtccaaagatgagaacaaggagaagttcatggtaaccgtcttcagagggggtaaggaacgtggcaagcctagagatgatgacccccagaaggccgctgaactagccgggccaacatacttcacaaccgatgattgcccggctgagtacgaacatgggaaagcactcttgccggaatgggcactgaacgaagtaccatgggagatgaaaaggttacataccttctacatgcaggccagcaagaaaggcttgggcaatataacagctcgatcaccggcagattgtttcggcaaagaaggttacgtatggctagatttctcatatctccacgccatatatcgttgggataagatggacgtcaactacgtcggtgtttggtgcatgtgagtatgagttttaattaattatatgaaaaatatgtacaatacaaatccatgtgattgttactaacaaacttcttctgtaggatgcaatacatggatgctaagaagacaaaagaacctatcggcttcttggatccaactcggatctgccaaacacaacataccgtgaggctagcatgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcggacgtgcaaggggatacaaggatggtctgtggctatttgcataaaggcggttgtaaaacattttattgggcaaaacagtaaaactgttgagtaattaaagtaatattaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccg

SEQ ID NO: 8607 - DNA, 1501 bp, Oryza sativa
tcttagtgccgctgacgtgtggggcccgcgtgtcggcgccggccgcccctttgctgacgtcagcgaggtcctttttcctttgtaaaaataattaataattgcacaataaatcgagtttagttctagaaattcatttaaatggctcaaaacttctaaaattcatatctaattcattcgaactccgaattgagccattcaacttgcaaaattcatctaaaattgagctctacatgtttgtttactttttatgtactgtttcctgggtttttatgagagtttttcctcgttttgcgtgccagcgtgtagtttccgtcgtttcggaagttcgcggtcgcgaggaaaagagttcagaagatcaaagtgaagaagcaaggcaagtcacacattccccttgagcatgttgatcccaatttataaatgttttaccgtttacaaataaatatgcatgttttgctaattacacggggtcagggtttacctatctgctcgcttgtgccatgtttacttgatatctgtcctttgtcaaccttgggtgataaatcgactagcttgtgttacttatgtgacctagctagaactttatgcttagccatgcttaattaccactagctcagtcgatgggataattgcagtattagacattctagtatcttgttgagccgcgtgctcgagacatctggccatgtttcatggtcgtaattatccaactaaaatgcgactgaatggtgggcagtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagatttaatattactttaattactcaacagttttactgttttgcccaataaaatgttttacaaccgcctttatgcaaatagccacagaccatccttgtatccccttgcacgtccgcatcgttggtgtggcttgctgagtacggtggttgtactcagccttgctattattcccccttttcagaagtgtagtgcttctgagctgaagat

SEQ ID NO: 8608 - DNA, 1139 bp, Oryza sativa
taattgattcgcagatatttgatttacgctatttatatattattatttctttccatatcctctccaccattccccaccactttatagtccacctagacggaaagacgagcctagtatggcctatatatatatggttgacgtagattacatatatacctcaagttacactatgacaataacatcgattttttttctttattaaaacttctggctaccactttatacgtacatacattggtttatatatcttgtgcacacacacgtccgagatggcattcgttgtgtgctcgttgcagaaaagaactaactgggaccataaaaaacgagtggatgccgacattcgaaaaggagtgtaatattttacatgtggatgtcacattaaacaaaggcagctttcagctccatgcaaattggccacatgaacagtagcatgctagcttaatttagtcatcgactgaacctgctagcaagatgaatgtactctccgctaaccgtggtcgctagctagctatttgggattttcttatgcagcgtgagatttgaggttgaccgaaaaccttagtttaattatgtgtagatccatttgcatcgatccttgcatggagaaacggttgttaattattgatcgtgcgttcatttcttttgtggtttgatcagaattcagaagtaggccgtgactcgtgactcgcgaggctcctggctccggatctattttgcggacaaatacatatagtgaactttgtgcgcaatggtacactaatagttctttggttacacagaagaaatgctaatttagttatatagtactgaattttcattgataaaaatgaaaatttcatttcctcaaaattgttgtgtaagacctgattaattggattggaatatctcacatgcatattaatgtttttgtgtaacaaaattttattcatattttagtgccaacttaagacatctgttccatttctgagggtatatttaaaatgctccatattactattattctcatgtttaatttggactgcgaccaatatttctaagatttgttggttgtgtacccatgggcagagaccggagatgtatttgttagggttacgaataaggtataccctctacccttggatgtacgctatacggcaata

SEQ ID NO: 8609 - DNA, 1430 bp, Oryza sativa
aaatcagttttcactctaaaattctcctagctccctccttgaataatcatgatatagtatgttatatgaacggtatttatattttttacttaattcagcgtgaaaagtagccataaaaatttacctcgaccatgagaggtgcataattcatcattgtagaatcactaacccattgtaatatttgatgatgaatatatggtattgatctttttggaatttactatatcaaaacaaataaacaattattttaatggtttccaaggctggttggtaaaggaatatgtattatattaatagtacatatgattcatccaaattcttacaatgaggaaagcattgtaggttgtagttatactaggattctaatggtgagagacaaatgcacaaaattgaaagacatcattgcaagaaagcacatgtagtgagtttgatcatcacactgccatgacatcaaacttcaatttcatatatattcttagatgtgcatagagcttggggttagtgttactttttgtgaaagcataacattaatttagttaagattcaagtaaaattcaaatgatgtgtttccatgattacacaatattcaagtacaatgttctatcacctggcttttgcacataaattgtggcttaaactgtacaaataggacactctacaatgaattctttttactcaaaagtctctctacagctagcatatcctgaactaggagtacctatctaaatctccttttaggcaacaattttgcataacctcaatcagtattcatagcaccaatttaacaagctagataaagcaaacatatcaaaaatcggttcaaataagtaaaacattaatacgattagtgtactctaacttatgaagaactaatttaggattatatatggtttccaaaaacggaaaatgaacttaagtaaaacagaaattttgtagtaacaagtatagatacaacagcagggacaaccattggtcgtgtgctatctattactatatattatccaaagatctactctctagaagtttataagttttgtgggcctaaaaattgccactttaatcaaagatgtaaaatagagaaagttatttgcctttaatcatggtcaatctagattataactatagattgactgatggttgtatagagaacatgtcgtcggttggatatctatctttcgtacatggcccaccaaagtttagatttctaaatttgaagtagtttttcaacaatataatttagtaatcttagcaatatatactatacgagatcttctttaatgcttgaaattaattaggacccttgatcagcaatgatctaatggatagagagagaaggtacatggaaaaaggtattaaaagggtatgccaggtatggaaggtggaagggtaaaatggtaattgtttttcattaaattatttttcggtaaagg

SEQ ID NO: 8610 - DNA, 296 bp, Oryza sativa
cggtgtatgaataaacttaggaaaaaaaaactttgtacatataaagacctttgcggaataatatcatcaaaaatgcaacccaagcatttaacatggacatgatactgattactatacaacacaaaactctcggttgtacttgggattcaagtcggacataccacaggtataaactctaatggtgtgtttggatggtgggttttgggtggataagacatgacggtccctttttttgggtgtttggttggtgggtggaggtgggataggacgacccggaggggaatattcctcccaga

SEQ ID NO: 8611 - DNA, 1501 bp, Oryza sativa
aacgtgcggctacccccgctacgtcgtcgcggtggcaagcggccaatccagggctctagcgtgccacctccaccgccgccgccgccaccaccgccgcagccggagcaacagctgcagctgccgcaatggccgaatctgtccggtcctcataaccagttgcttcctgtggcgccgccgccatttgtcgctgatcagccacctccacctccaccgccagcagcaggagggtctctctggatccctgagctgcctccacctccggtggaggggtcgccatgggctggtctgcttccgctgcgaccaccacggtttgccgggatggagccatcctttcttgaatcacagcaagctccgcctccggcacaggtcagcacacagctagcaccactacctctgatacgggaggaagctccattgctgcaggagccatttctgtttgctgatcaagcaccagtacttgctcctctgccggcgccattgcagatgcctgtggcagaaactcacttgccactgcaggctccattgctgcaggagccatttctattctctgatcatgcaccgacgcttgctcctctgccatcgccattgcagatgcctgtggctgaaactcacctgccactgcaagtgcaggctccgttcatgcaagaaccatttctgttttctgatcaggcaccagtgcttgctcctccgccgacgccattgcagatgccagtggaagctcacatgccactggaggctccatggatccaagaaccatttctcatgcctgatcaagcaccggtccatgctcctccaccaacgccattgctgatgccagtgggagctgatcacttcccactcgaggctccattgttccaagaatcacttataatggctgatcagaaatctgtgcatgctcttcctccacctccattgcagatgcctttggaagctcacctgccacctgcagcacaagagtataaccaagatctggccgtgcagcagcaaccccaagagtatgaaaactatgactacatgtttgagaacgtggggctctcacaggcacagccggtggccgctggcgccggcgacgcaggctttgcagctataggcaacgacgacaacccgttcggctaccaacagttggttgcctctcctctctatgatggacagatctacttcggctccggggttgataacatgggcgttcctcctgctggtgattttggtggtgttcctgaagctgctttgccggaagtcgagcatgcgtcttcgtccggttggggaaacaacattactggtgatgctggtgcatggttctgaggaactaggaaccgactgtctgtctgtctgtctgtctgtctgtctcttcttagatagcattttggaaaatgctgatgtgtctcgataattgagcttatttagttaggcctcttggaggcaaaataatatttgtttgtcgaggcaatgagaataatatatgtgttttattgatgttgatgaattttagtatagttggcca

SEQ ID NO: 8612 - DNA, 1501 bp, Oryza sativa
ggatggccggggtcttgctcttacgtacaaaaccctctcttttatttttacatatataaatagtgagaaaaaaaacatatattcgtgggagcggtcacaattattcacttagaatattcgtttatgtcacaagaccctagcttgaaactaaaccccctattattgcacatcacagactccccttcaaatatgtcctagagtgttcgatcgagttctctaatcatcctcaaatttactcattgtttatacatgcctaaagctctgtttttttctaatttactcaaccccagattactggatctggaaccacattcactctgattaattaacctccgaaatgcagtgtctaaagtctagctaaacccatctacatttgtcgtgtcaccacatttgtcgtgtcgtactagctgttgggatgatcccatatttagcttgtatcgtacaatgccatcatgattatgcatggagatgattttctaggatcttggaaacaacacaatactttatgttggaattaatgaatgggccttagcccactcgaagattaattctttggaaaatcacaaaagcccaccttatgggatggcatgcatgtggagtttagtaccaccttgcttattctaggagagggggacctccttaaaagggaggatgccctcctagccacttgaagcatgtgtgatggagagaagaggggaaacacacgcgcgcgctggctcgcctcgcctggccgggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcggacgccctgatcaagcgacccttctctatataaaccgacttgccgtcttcacgcaacacttgcgaaatcaatctagggtttgtctcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaactggtctttccgtcacctcggtacgtgttcaatatgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttacta

SEQ ID NO: 8613 - DNA, 1501 bp, Oryza sativa
gttaatgttttgagctccatcctcacatgcacaattagtgaacgagttggtactcctacatacctgcaataacctgataataatatagacaattgcatgtaagttaatgttaatatttgagctccatcctcacatgcacaattactgaacgagttgtacatgagttggtacttctacatacctacaataacctgataataatataggcaattgcatgcaagttaatgttttgagctccatcctcacatgcacaattactgaacgagttgtactcctacatacttgcaataacctcataataatatagacaattgcaagtaagttacaagttgttttgtggttcatcctcacatgtacaattactaaacgagttgttgcaagtaagttacaagatgttttgagctctatcctcacatgcacaattactaaacgagttggtactcttacagaattgtaataacctgataataaaatagacaattgcttaaaaaagatgccacaagtttttcttctataaacttttaaatgtaactacttgtagtctaactataatgtaatttgtactatagtgtaattaaactgtataactatattattatctctatataacttagtataaagtttcatactttttaattttctttggagaaacacagtacaaacagtacaaacgcagacgctcataacgcgcgcacgctcacccctatgaacatacatcctacccttacgagtgcctccgaaaaattgagacggcatatcatgagattaaattttaatacttatagttaattgtagtataattacggtaaaattatattacaatttaaaatttttccataaaaaaacttacggtatttttttaagatagtcccataaaatatttacaaaactttgtgaaatttacctttttaaaaaatccccaaaccgcaaactgacagtttcccaaaaaaaaaaactgagtccaattatcacgggggcttaggtggcttcactctgaactctctcacagcctcggtgtgagatcggatgagagggagccttgcccctgacatttcggccccattttctcctacaaccttggacaagagaggagagggagagaagggaggcgcgtgattcgatcgagagaatagggagcaaagtggagcgagggtttgggcggcaaatcagccgggcggaaggaacaagattccttcgacgacgacgatctctctatctatctggatctcctcctgctccccgagtctcccgctcctgccaccactcaccgctcgctcccacactcttcgccctatatatataccccctcctccatcgattcggtagcctgccacatccgtgcttgcatgcggctcaactcctcttgtgttcctccgagaaccacgcctccatcgatcgatcgtctgcgatccttgtcacggcttgaactgtgatcaagaaacgcctttctgatcgatgcgcggttgattgatcttggtgcggacggagggagagagagaga

SEQ ID NO: 8614 - DNA, 1501 bp, Oryza sativa
ttaattgtgcgatgtggaatacaacccatatgccatttcataaagattgtgcgaggctccacgtagttcgatggaaatatgatttgatgtctaaacataactgctcacgtgtcattgcttttaaaatgtaaaatttttgttgatatcatagattgaatatttttctataaaattatattagagttataatttatttgctccaaactgaccttttttttaataattttagctagcttgtagtgggcataaattagtgcttatcatctttccacttctaaatttgtgttacatagttaggcattttttatgttcgtgccaatttattatgtctgctacaatcatatatataattatacacttaaccctcactaagtatagttaatgttatttttctcatctctcaatttctagcacctcgatgattagtctggtcgaaagctctctctcttgtttcttctttcacaaagccataccaccttagttttgtcttatgatgttgaatctatatttgatctaaattttcaaagcacataatcttaactgtgtttatagcttttgtggatgattaactaaagatgcaaactgtacaaagtaacatataagattacgttatttagctacgaaataaatttattttgtactatgtttctgtcattatcatacatcatttatgcggtaacgttgccttatacagggttttatctaattaggttagttgtgacttatttttcttgattatcatctcatgctatgttaagccatacttcctccatgcatgatacgatcaaatttccttgttctgttcattggtcacgtcaaactttgtttgtgcttattcattgatgtttcatatcttaatttatatgcagtgaacatatacaaaaattgatttcgatggactgcaacactgcattacgattaggctggaagattttatcataagaatgatctctttctctctccctcattaacggaacacacgcgcggagtatgtgtggttgactcatggatagcgtcatcaagtgacagagcacggtgtcatcttgaattttttaaataggttaagattaagattagatctagtgattgaaaatattggccctaccaatttaaagaaaaaaatcaatggttagatgtttttctttttttttcttataatttctgtgtttttttttcataatttattagagtaccatatggtggtttaggagcgtttgtcgaattgccacgtggtgatttaggagcgtttatagaatctaaatttaatatttgtgtaatatggtgcttaaaaatctgctcttaaaacatttatattagaagcctgagctatttatatgtaaatggattcatcaattaaagttgaatagttaaattagagaaagaaggaaggaaagtgggagggatgtatgtacgtagtcaccgtgagggggaggaggtccaggaggaaagggcggtggagatgattttttatgggttttgggattttttttaaaagatagat

SEQ ID NO: 8615 - DNA, 1501 bp, Oryza sativa
aagatgcccaccatctgctcgctcaccacgcacctgaacggctgctgctgctgaccatgccgctgcgccccctcgtcgtcgtcgtcgtctcgtcttcttcttccggtagtgaacctgttcagcgcgtcgccgatgagcgagttccatttcatggcggccgagctcctcgtcgggccaagcacgttcctcgtgttcagcggcacgatctcctgcaacctgagaaagcaagcaatcgatctcacgccaagaactcgacatcgccattgccgatgtgattgcgatcaagaaaccgtcaggtttacccaagaacgtagatgtcgtaggagtcggccttggcgtccagccagtcaccgaggtccaggtcgtccggcggcgccacgccggcgacgttccacgtgccggcgaacaccctgcgtcacatcagcatcagcttcatatcaatccgccattttttctctctctcaaactcagctcaatgcaaattctgcaagaaacacacacgaacctgtacttgaccgtgtcgctctcgtgcaacgcgtcctcccgccctacgtcggcgaactcggagacgagccgccgccgccggtgcagcagctttcctggccggagaatctgaaccagaggtaggagaatttcaattcgaagctcatgtcactgatgaacaactgaacaattacagacatgaaaggcagcaaatcgatcgatgctgacctctgaaagcttcgagctaggatgcttctcgtcccccataatgcagcacctgcaagataattctcactgaacttttgaactctgaatttttcttcttcttttacagctctgaattttcgtctgaatttagtgagaaggtaaggagcaaatatgaacagcctggtgcgagatatatagcgagaggaggcagattgaagcgacaaagagaaaggcactggctgcgatgttgacaagaacacgagatactactactactacatgtcaagcatccaaccacacattcggtgagggagttgtcgagtcgcctgcatctgcaggtttataatttcactaagtgtgtgtgaccttggacctcacaaaaaaaaaaaaaccagccgcttctctttcatgaaacatgaccaaacaaagccatcgaaccagcttatggtttactcgatctccctgtcattttctcacatcattacggatttacattgtaaacggcaaagacttgaggagaagcattgtttgtgtggtggtgaagacatacgacaggagtataaatccacctacccggatttaagttctggtacacataaatatgactgcacgcatcgttagttagtgcagagatcggaagttatattttctttgtcagaaaaacaacaaaggttgtgtttagataggggtaaaaagttttggcgtgtcatattggatatactgacacacatttgaagtattaaacgtagactaataacaaaacaaattacatattccgcctataaattgcgacatgaatttattaagccta

SEQ ID NO: 8616 - DNA, 1501 bp, Oryza sativa
cattgtacgattgggccggaacggtttcgacggttgtgcggcccatcttcgatacggagaggcgaatctgtgggccggacggctcctcctcctggtttggcaccggcggctggaataagttcatcttaggtcccttacttgtcaacgaatccgattttcatccatcaacaaaaaaaaaaaaagatacaatgggtccctcaactgttaaaccagtgtaaaataagtcttaagacggtttggatgacggttttagctgatgtggcgcctacgtggctaatttgactcggtcttcatctgacgtggcacatcaagcaaaatttaacaatttaaaaaataaaacaaaatacgttggtccacatgtcagtaaaataataataataataagattaaaaaataggaggacccatatattagtggaccccacttgctccacctcatccaccctcttttctgtatcctatcctctcttactctcatgcgaagcggcgggacggcggcgggccacaacaggcggagcggcggcaatccgccgccggcaccgatctccataacagaggtgtgcgtcctcctcctcttcgaacccgtcgccatcttcgtggtcttcggcgaccgcgatggtggggaagcgggtggggaaatgggagctctcccgccactgctcatggtgacgacgccatcgaggtcggaggatggcgggaacgggggcgggggccacaatggtgaggtgcgcgtcatcctcctcctcgaacctgtcgccatcgttgtcgtcgtcatctttggcggtgacaggagaggaagcaaagggagaagttggtcggctgccgcaacacctcttgccgtcgaccttgcgggggcgggagaggagacgcgagtggcggccggtgggagaggagctacgggcagcagccagcgggagagaagcggcgcacagtggccggtggccggtggccggcgggagaagagcgacgcgcgggctccggccgacgggaggggaggagccgtgggaggcagccacttatccctctcctttccctcccagatcccacgagttctattttttttctggatcgaattgccatgtaaccaccatgttactgccacgtcagatgaagactgagtcaaattagtcacgtacgtgcaacgtcatctaaaccgtcttatgacttattttgcaccattttttctattgaaggacgaaaatcagattccttcacaagttaaggggccatagatgaacttattcccggcggctgcagccgcgtgtggcgcccgctccaaggaggagatgccgggagacgtcacgtgatgtcacgcgcggtccacgagcgaatcacccatgatggcgcccacacccgataaggaggaatccgaatccatacttgcccgccctgcccttttttcttctccctcgcgccgcgcgacaaacaccgccgtatttatgtgcgcgccgcgccgcgcgggaagcagcacagcacagcacacatctcgtccagtccatcca

SEQ ID NO: 8617 - DNA, 1501 bp, Oryza sativa
cacgaatcctgttcattgctgggccgtataggccctggatccttttgacccgtgtaccgaacaaagcccacgaatttctcgcgcacgccttcgtcgccggcgaaacagccgagtaggtcgactcgtactcctgttcatataccaattccaattccaattccattgctggagaaatcactacagatcagtggatcggccgcgcgatctgctacatcgccgccggccacaatccaaattccgtaataatggagttaccgccgccgccgccgccgccgccggcagccggccgcgactggtccgacctgctggccgacatggtagacaccgtcctctgcaagctcgagctccccgatttcatccgcaccgccgccgtctgcacgtgctggcgcgcccccgccctcgacctccgccgccgtggcgtctactcgttccctcgaaccccctgcctcctgtacatccccgccgccgccgccgccaatggcggcagcagcacgcgctccgccgagctctactgcctcgccgacgagaggccctacacggtgaccctcccggacccgccgatcgcggagcgcagcatcgtggggtcgtcgcacgggtggctggtcaccgccgacgcccgctcggagctgcacctcctgaacccggccacccgcgagcagatcgagctgccgcccatcgccacgctggagcaggtgaggcccatcctcgaagccgccggcgacggcggcgacctccgcgggtacgaagtctccttctacgacggcgacatgagggagtaccgagctcccggcatctaccggcccgacgagctctgcgacctgctcaacatcaaggccatcctgtcgtgcgacccgtcgtcgtcgtcgtcacgccgccgcggcggcggcggcggcgaaggaggagaagatggatgcggcggctgcatcgtgctgctcatctaccatgtctaccagcagccgtcgttcgcgagggtcggggacgacaagcagtggcactggatcaccacctcctcctactactggtctccctactccgacatcgcctaccgcgacggcgccttctacgccatgaacctcctaggcgggatccaccgctacgacatccaccattcccgcgccacgcgcacggtggttctcaccgacacgctggggtacacgctgcaccacgcgtacatggcctggacgccgtcgtcgggggacgtgttgcaggcagggttttaaatctctcgctataatcggtgacattgagtcactgacatgtaggactcacatatgcctggacccatgtgggtcccacacgtcagtgactcaatgtcacggggaatgtcaccggcgcaatgtcaccaaatcccaatccgcaatttagccgttatagctccatttagcccgctatagctgtttgagaagctaactgttaaatgacttaggtcgctatttaaaatattggtcattgcaggtctggaggttgacgcatttgccagaagacgaggaggaagaactgc

SEQ ID NO: 8618 - DNA, 1436 bp, Oryza sativa
cagccagtgcattaattatgctaccgctttaacacaaacctttattatcattacatatatacaactgcaaacttgtgcttttctgtttattatcatctgatatgtttgagtggttctatgctcgcagtctccaactagaattgtatgcatcttaaagcacctgaaggggtaagtaatacccatccacccttgaatcatgccttagatttggcaaatttgttccagccactagtcttctctataggacaatgctattttgtgactatttgctgcaagacaaatttcagtattccctctgttctgtaatgtaagatattttggttttgtcctgagttaaacttattcaagtttgaccaaatttatagaaaaatgtagctacatctacaacaccaaattcaaatttgaccataactaaatatatttttataatatatttgtttggtgttggaaatattgctatgtttctttataaactttggtcaagcttaaataaatttgacttcggacaaaaccaaaacatcttacaatatgaaatggagggtgtacatatgatatatcatttgttgtcactagaggagagttaattagggtggagtgaccagtgtgccctttggtgcatttcaaaaatattgctggacatgaatttgaaatatcaatcttaattcacaatcatgctaaatggtgcgcagagtagcaagcatccgagtgcctccttccctctgtttcctcgtttttcctttcttcccgtcctttactcattacatccgcttttctagttttttctgttcctcacctcctccccacatttcacattacactccagagtaaaggatttactcatccactcatctcctgtcctttcaaccatccactcatctcctgtcctttcatctttgtcctaagtaaaggatttactcattgactatctactaatctcattgtccagcttcataactaattaatcctgtgtaaagaatttacttatcgatcatctggttcataagtaattcatctttgctaaagatttacttttatttactcattgaccaataatacagctaggttcatctcccattcatcttagagttctttgctcatggactgctttccggttctcttcatagagtaaaaatattactaccgctcatattagtctcttccataatgtttaacagtcaatctactcccacatatttgttttttcccgttttgccctacttttggttttgtcctgcttttgtgagtggaaatgatatcagtagaaaacttataaaattgtatgaacataaaacaattacacaactcacacacaaagaattacacattagtcttgaacaacgaaaaaaaagaaaaaaattcagttgatgactgacgatgagacgagagcaccacggcggatggaagggctccctagagctgatgcagatgatgcatga

SEQ ID NO: 8619 - DNA, 273 bp, Oryza sativa
aatcaacgtatcaacactcaagatcttaccactgtacaacctggctccatcacgtgtgatttgttgggctcagaagcaatagcagctgttattggatggctccgcagtacaaacgcccatgcttttatccatcgccgctcgtccgagcacgtctcattaactaactcactcactcaagtgaggtcaaattacagaagctcaagtcaaatgcttatctaatctgccgatactgtcgccggatgatgccattacaccccttcactctcacgcaga

SEQ ID NO: 8620 - DNA, 1501 bp, Oryza sativa
gccactgtcatcactctctcatttacttaaaaaatgtatatggacatttcatgctataatgcatatctacttgcaggatatcgcacacttagtccagacgtagaagagggcatatgccaagttcttgctcacatgtggattgagtcagagatcattgcaggatcaggcagtaatggtgcttcaacgtcttcatcctcatcagcatccacatcatcgaaaaaggggggaagatctcagtttgagcgaaagcttggtgattttttcaagcaccaaattgagtcagatacctcaatggcctatggcgatggttttagagctggcaaccgagctgttcttcagtatggtctaaagcgcacccttgagcatatccggttaacagggactttcccattttgaaatttcatagattcgtcttttgatggaagttatacacgatcgatttgtcattaagcgtccatttacaggaaaagaaagcaattttgagatgtgcaattgtacaaacaatcttttcagttacttttggaagggctaactgacgacattgattaaattgtgatatggttagcccaaccaatcacacatgtatggcattcagaaattctaatggaaacagcggtattttttatgtgacaaaaattaataagaaatttatactaccatgtacaagtgagattctaatggaaacagtagtatgttttatggttaacctgctcattaactggtacagtaccaaacaagtcgagttacataaatactctatttgcactatcaagcacaagtgagatttgttttcctgccttttggattggcctggattctttatagatcagaaggctgttacagatttttttttacaggtaatttactgacctctaccatgtgtgcagaaaaaagcatggagcctcactccaaaccagtgtccttgtaaatctgtactgctactatattggaacagtataatgacacagttttgcttcattgcaagagattcacaataatggcccagaaatgtgcagatcccagagcactgttacacgcagcaacaacaatacagcattgcgagttggaagccaatgttactgtactgcagttaaactcgttgtctatgcatgcagttacagctactactcacaacttcataaaaaaagctttcaccaggagagttggctagcctacagatgaatactacgtactatgtactcgtactactactaccatgtcatttaaaatccaagcacagcatcttcacccaggcaggggacaggggactaattaaaaagcctatagcccaaaatgtacacaacttaattccgcaaccctcagtcacagtgaaatccatggatgatggatgcgattcagaaacaaacagcaaagagaaaggtaaacttttccaatcatggaaacaaaagcttggcaggcaatttgaaaaacttgtaatgtaggcatacaatggtagtacccttggctactgtaccatctaaatcatacaacattgatgcac

SEQ ID NO: 8621 - DNA, 1501 bp, Oryza sativa
gttttgccattactgatatggacatagaaaactgcaaactgttggttttgatgggaaatgtggttcccgtgtttagatggtgtacccactagagtccacatttggtcaactcgacttgctattgttggctactgatctccgtcaacttgtcattgacgatgtagattgttgtaagttgaggcaacaggcccaaccagtcttgcacctcatgtactcacaattgcaactcttgcaaacttctcatgctcatcagcatggtgtatgtacgccacttacagtgtaaaatgtaactatatcttgacgctcttgtacaaaacaagaaattttttaccctggttagggagaacaattctgtgtgttttatgtcttcctttgtatgcagagcataacgctattaccagttctgttggtgtaaatctgtactattctaatctccgaatttggaggtgcacaaatgcaatttcccctgctgaaaaatacatcatcgcttcacattgctatcttgcttagtaggtcatataaacataatttttcttatctgtaatactgttatgtggttttgttggttgagtttcaggtgatttggtgattggtcaatgtgaattaagtattaacaaaaactataccactgattttttgtgcatatgcctctaggttcaggatgacacaaattgcttccaaatataatgagcttatatgccattgtagtagtatctgttatttagtgcttaaaaagaatgggaatctacatcttttgactatgtagctgatctattttcaaattcaatttaggatgtcccgtcagaatttgacaatgaagatatcgctcgtgctatatcactctctctattagaggaggaacaaagaaaggcaaaggcaataggttagtatggtaactaatactagtacttctgctgtttgagtacttactgtccaaaaaggctgacatttgtccgcttctttacttccagcagctgttccttcatatcatttttattcgatgacatctgtcaaagtgcttagcgttttaacttttaagagagccccttgtgcttatttccacacctatcagaaaatttttggagctagttcattgccgatgatacagtatgttcatatggagtccatgtttaggataagtttcttcacactctctgtttctgaacttggttgatctttttttagtttcacatttatacaaggactaggccaacattatttttcttttgagtcacaatatagaatagtatgttaatactcaacggcaaagcataaacagatccattgtgagaaaaagaaatttatatatgtgttattctttcatgagaaatatacatgttgaattgtggctattttttgttatgtgttggtgaaatgtttggtgcgagttctctggttctagatgtaaaaatcgaaaatcatagtgtggacattttgtatatacttctgtaccaaatgtttggattagaactgtacccaagtaataaaagtgcatctggaa

SEQ ID NO: 8622 - DNA, 1501 bp, Oryza sativa
caaccaataatgtatctgagtgacttcatctggattctggagcaatatcctgcgctgtcgtgcacgaaattaggtacttcaactcattaagttttctaaggcagcaaagccaatcaatgaggataatgtatgccacaacattagtaaaaccttgaccatggaccaggctcttggttatggaagactttctccctaatgcaaagagccaaagactatgaataaaaatgttgaatgtctttgcgattggacgatacttttgtcgatcatgtacttggtcaagagcttcagaacagccatttgcccatatctaacagcccgctcatcagagtgttgtatgcagagttgcagaccctcgctaacaagcacaaggcatatgaaaccctcagtcatggagaaggcaattcggaagaacactcgatgtaaaagccgagggatccaatcctttcacttagcataacatccaactgatcaagtacttcctttgcactacctttcttgcagaggccattaaggtatatgtattgtaggcgagcatactgtgcttccaaccgctggttctactactgttgaaacctgctctgaacagagttgtaggtgataacattgggaggacaactagcccgatccgtcacggccatggcggcaatatgcatttaacactggacgtgcaagtgtacatcacttattcagcattcagtctgaggatgccccatgcctcggcgaccttcactgcatgcgccacagccggcaaaccccgtgatgagcattgagttcatggcaatgccggcctccaacccgtgctccccccccccccccgatctccaggatgagcttgcaggcgaggcgaggcgaggtcgaactgcaacatccacccgtacgtgcagcttgaccatgaccatgaagttgtccgacgcgagcatttcgtcgaacgcctcgtgcgcatcccccgcccgcgcacgcgagctcatcgaggagcatgctgtgggaggagcacgtcgcgcgtcgcgccggaccaccgccgtcggtgccgtccacgtcgtagtctcgctccacctgccgccgcagcggaggaggtgagtcgggtggcgctttgggcgtcgtcagagtgttcgggggagggggaggagagcggcggtagaggcggaagaaaccatgcgcgaggggtggtcgccaatggaagtgaccgacggcggccacggccgcggcggaggcgccggcggctagaggagagtggtaagcgacggtgaagggtgggggaatcaaacgccgccgtccttaaaatttgaggtctctttggatttgatgaattttgcagaaattatagggaaattgaacaacggctaaaaagaaactcttgttaaggtgtgctggtttctactgaagattgattgatcgaagttagggcaaaaaaaatatataaaaaaaggacattagcccatgattaattgagttttaattattattgatttgaaaaatggattcgtatgatattcttaagcaa

SEQ ID NO: 8623 - DNA, 1501 bp, Oryza sativa
tcctcggagagactatggattcggcaccccatatttttaaaaaatcaggtgcaattctacccacccgatgcttggtgcatagagtactctccctctctctttccttactgtataaccacctttttttatcaaacttttctctcttaatcttaaattatttatatgatttgtaatccgatcacacggttatatttgttatgattaaatctttaaaacaagatctttattatcacacatgaaacacgtgatacattcagtcgtaactagttgtaactattcaaacatcgcaaaaataaaacgtgcaacttttgcaaatgatctagtgtaacattagaaaataaaaatattctctgcaacttccaaataataccatatgtaaatatgtaatattagtaaaaaccattgcaaaaataaaaataaaaatatgaaacatggtcaacttttagttgaaacattatcttctcacctttgaaacataaaaaaatcaatttgtcaaaacctatacatttttttcgtcaaaatataatcatgcgagctattgttgtaagatttagttgtaataaatacaacgatgtaatcggatattagatcatataaatattttaaaagaaaaaatggtttgaaattcaaatttaaggagcccatttgaatcgcgggaatgaaaaaacgaaggaataaaaaacacaggattctaaccgtaatggaagtgtaaaacagagaattgcaaaatacaggaatgacggtttgattggactatagaaaaaaaaacaggaattggatgaaagagatagactaaaaaaaattcgaagagctttgagctgttgctaagtttccttcaaaaatctctatagtattatccatttcataggaatatcaaaggattagatatgatgcaatcctttaatttaaaggcactcataagaattttttctatagaaataaaatcctctaaattccctgtatttttccttcaaatcaaatggccctaaaatatattatatcttacatgcaattgtacccctctcaccatattacgtcagtggtttttttttttttttggtcttgctgtcttgcgtgtatgcagtactgttgctagagccgatcttgttgctgtcttgcatgtaagccgtattttctccccattttcccgcggaatcctgggcctcacaacgcggcgtcgtggcgaagtcgcgacacgtgcggcggtcgagcgccggtgcgtgcgcgcaggcggaggcgccccgcgaagctcgctcggtcgcccatggcggaaaccggaaaagaccctataagacgccccgcgcgaccgccattgcctcgccgtcttccgccccgccccgcccctcccctccacccacgcggagaaggagaggaggagaggagaggagagagggaggcagcagctcgcccgccgccgcccctccctccgtgcccgcgccgcccaccccgccgccgggcaccggccaccatcgtcttcatcatcttcccaataaacccccca

SEQ ID NO: 8624 - DNA, 349 bp, Oryza sativa
aaaccttgcgtattttttaattaggtatatagattttgttatgagttgttttatcactcatagtattttaagtgtgatttatatcttatacatttgcataaaatttttgaataagacgaatggtcaaacatgtgagaaaaagtcaacggcgtcatctattaaaaaacagagggagtatatctacacaatttgcaaatttcaactgaacacttgtatatagggtatatatagacatgcacaaatatacacagttgacaagatatatgtactgaaaaactgaacagatgaaatatgtatataccagcagatggactgaattttttttgttttttttgtttttctcacaagc

SEQ ID NO: 8625 - DNA, 334 bp, Oryza sativa
ggtgcatgagtatctaaaaacatcagtagtattctatattcttaagtcttaaccccgtcgaaatcaacgtatcaacactcaagatcttaccactgtacaacctggctccatcacgtgtgatttgttgggctcagaagcaatagcagctgttattggatggctccgcagtacaaacgcccatgcttttatccatcgccgctcgtccgagcacgtctcattaactaactcactcactcaagtgaggtcaaattacagaagctcaagtcaaatgcttatctaatctgccgatactgtcgccggatgatgccattacaccccttcactctcacgcaga

SEQ ID NO: 8626 - DNA, 1501 bp, Oryza sativa
atatttattagggtgatccaaactatgaggtgataataactactctctctgtcccagaatatagggatttttagggccggatacgggtattaagaaagtaggcagaattaaatgggagaaggttgtgattggttgagaagtggaggtaggtgagaaaattgaatggtgaagggttgtgattgattgagaagagaacgttggtgaagaagttattatgttttggggcaaaacttgaatgctagaagtcgttatattttgggatagaaggagtatttcttggcctttatgggttaagtgtggttgcgccttatattttggaatgtagggagtaccataaagtaagacatcatttattacttattcacagctttaatagtacattgtggatatccttagagcgggtacaataagctgactaggcgggctccaaaattatgcactacagcatattcctacgtggagggaagagaactgatgggagagaaggaaatggatgacaaatttgtcgccgggcgatatctctcttctcaacgtgactgcagtccaactcgactattaaaaacacgcttggtaggtcccacacaccacaaccaatccccttccccaccgagcgagatcgatctctctttccccctccaccccagccgagcccgctcgatctccgcccgcccctcccgtgcgatcttgtgcgctcgactcccacgcgtgatttccgcctctccctcgcgcgcacaatctacctcctctctacttactacttcatccacgagcgtgaaaataaatttacatcttcctattttgccggccccaaaaatccggtggattgacgatgccgcctccactatccgccttccctcttctacctcgcttaatcgctcaccgaaaaccctagttctttaccaccaaggcactaacaaccttgtctcgccagaggaagagagaggttgcgccacctccatgtaccatcgcgagcttttcttaaactcccggtgtttcaaaaattgtgatatatgtgcccatatgcaataagtaccttgttttttttaggatatcaatggtatttgagttatgatgtaatagtgccttgtaatttttgtactacagagaatttggtcctggcagaaatggttacaagagtgcaatttactcttgatcatacacacggatatgtacatgttataattaattatttgattataagatataataagtaaataaacaatctattatattagtagtgggctttaacaatgagctattagtgagcaactggctatactattagctttgctagcctatagcccaacaaagcagtttccacgtaagcacatagtgacacgtcatagccacggcagcgacctcgctggctgaactcaactacttgaaaaataccgagctggttcaggttccctccacaactgctccccccctccacctcctcctccgccgccgccgcctccgccgccgccgccgccgcttccgccgccgccgcgccgcccga

SEQ ID NO: 8627 - DNA, 237 bp, Oryza sativa
cgccgcgaatcccgccgcccccgtccgcccagcgtgcaatcaataggggggaattattccccgggatcccctccctctttccccccatttttccctccctctctccctcggattcgtttggaaacccctcccctaacctcgccggcgccattaatggcggccgggtcttccgcgcccgtttccccctcctccggccgccctctctcacccccaaccctatataaaccctccccgagc

SEQ ID NO: 8628 - DNA, 1263 bp, Oryza sativa
ccagcttacaggagaagccagcttacggcgtaagccggcttacgacacaagccagaaggtccaaggcttacgacgtaagcctccaccctcctccgcctataaatagggcccagaaggtccaaggcgaggacaaccgatcttcggtctcctgcttctcctcttgtagcttgtactcaaatccagaagaaataaagcttccactcactcatactttctgtgttccacaactctgtgtttggtttgcttgtgtgctgataagtagaatcgactggtttctcaacatgtcatcagcacgagactcttccgagctaaaaaggtaaacaggtgagaaatcagtttctactgatcatcttgctctttatatgcaaatcattcttctactatagttgaaataagcagaagaacatggtacctgaagtaccatcctccgatatcctctcagcaatacacgataacatgatggcggctctcccgccgttatcgtccaattgctagagttgatacatcctctcagcaacgctcggtaacatgatggcggctctgccgccgttaccgtccaaaggcttgagatggtacataatcttagcactattcgataacacaatggcggctctgccgccgttatcgcccaaattctagaggtgatgtaggtgcctgaagcaccggcatggcaacttaatggacggctctgccgccgttgccgccaaatatcggaggcaaacgaaccttctgcacaaccctgaagtgtcgttatggatgccctttgttttatggacaccacccatatgggcccttgatgccactaaggtcggctctatcgccatgaagcgtgggctcatagtggggaaagtactatatggtttatcttactttttacagtctgcacaatatacatgaagtgcccatgtatgctcttcattttgttttacatgcttactttgctgtttgcatgactttcataacattttttttgttatgaaattgattttctagcatgattgataatatttaatcaagcaatctgtaatcctgaagattacttaagttaatttgctaggaaagattctatgggaaactgtgtgataatcctgaagattacacacgatagtaatcctgaagattacgcatgaccaatttatgtcgaccccgcacatcgtatttacctgtcgtaaatactaatgatgttgcagaacatgtcggacatagcaaagaaggaattcaccgagcttgccttggatggtagtaactacctcacttgggcat

SEQ ID NO: 8629 - DNA, 1483 bp, Oryza sativa
cttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcaaggagtgggggtgaaacctgaggtgtggtgtgcttggttagagggggttatgcgaatggtcctgtcacagcctctttccgggatgtcgtggtggcatgtcggcgcacggaaacgtgtcgtggggctgtgtcttgtgggtacagttgtacacctctgatcagagtaaagctattcgaatagccgcgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaaccgttttcgtattcaattcctgtttataaatgccagtatttatgcaaatgaaccactctagctcttctttgttaattccctgcatcatacccctattccgggatgacttgctgagtacagtgggtagtactcagtcttgctctccttttcccaaccccagaggatgagtttatgtcagatgaaggtttccccgagaagtaggcttcgtccgtgccgtctaggatgcctgtgcagtggtgttcccgctgcagtttagtcaaggcttagctccagtttcttttgttttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcgtgacaaaaaccaacttaaatccgtctctagtcagacgggagccactaacaagattcctgtcgatagaagggacatgctgcacgttcttcagctgcacgatctttcccgaagtaaacttcagatctaccatgccaacaccatgaacagaagcatgtgacccattcctcattaggacggtggaaccccgtgcgacctaataagaagaaaacaatgagatatcagcacaaacatgtacattggccccagtatcaacccaccaattagtagactgattaactgaaaaaacagtaggtaaattaccatacccgcttccatctccagtgttgccaatggtcacattagcagacttagaaatctgccctgcaggtgccttcatccccttgcgctgtggacacttcctagccagatgaccaggttgaccacacacaaagcaagtcctctcatcctgattaggattattgttgttcttcttctgcttcttgaagttggtggtctgctgagctttgtatttccccttgctcttgttctgggccttgtgcaca

SEQ ID NO: 8630 - DNA, 1501 bp, Oryza sativa
gaacttcctgccagccttctctgttcggtctggacccatttgaaaaaatggctctcaaaaatattttatcactaggaacccactaagagcacttttttatatctcagaacaacacttggaaccccctcttaatagtacggtttttactaaaactcgattttaaaaattaaactatcctattgaccttcgagcttcaaatccgcttgaatgagtgttgttgggggtctccaagcatctcttgatcacctaagttaactatgggactaattaccttaaagtctcaataaacacattagtcccttaaccttattcatcattaatcaccaaaacacattaggggataaatgcaacttcaattatatgtgcacatacatgagtacaccttgtaacacagtggggattgtctgtagtattgctgatgcagtagcagacaccgatgcgtgggtccggaggccatcgctgaatcccttccctcgtattaaaatgcacatcgacgtgtactccatgaactcgctgaaatccgatcaaaattgacgcacccgctttgtaatcactggccagactaacacctgtttaaaacatacttgtgtatacgtaatattaattagcaacataatttaaaccttagcgattagtgcatgccccaacacttctactactacgcaattcagttcttttccaaattagtgcatactcatacaactacgcgtacacgaactcacaaagtaagccttatgatacagatgttggaattaatgaatgggccttagcccactcaaagattaattctttgaaaaatcacaaaagcccacctcatgggatggcatgcatgtggagtttagtaccaccttgcttattctaggaaagggagacctccttaaaagggaggatgccctcctagccacttgaagcatgtgtggtggagagaagagggggaacacacacgcgcgctcgctcgcctggctgttttgttttgctgcctctatataaaccgagccgccgccttcacgcaacacacgcgaaatcaatctagggtttgcctcctactctgtgctgcgccgtcgctcgtaggttactccatcctgctcgccggtgtgcacctgcgatcgggagagcaggtctccggaacctctgccttcgatgtcctgcaccgggagaaggcggcaataaggtttttgggaagcgctttgcgcgactgctccctgttcgtccacgacggctcgtcttcctcttcgctcgcgcgttgcgtgccttcgtagacacctgcgaaaagtttcgaccgagtagccggtctttccgccacctcggtacgtgttcaatatgttgcgcatgtttgatctgttcatgttatactgtgtagtttacatatatagatctaatgatgcgttcatgctagttttcatctgtaatgtcatgatttatttatggaatatattaaatcattatatgcctataatctcaacaatccaaaaaccttattataggcactgtgattttacta

SEQ ID NO: 8631 - DNA, 1501 bp, Oryza sativa
tagtttacatatatagatctaatgatgcgttcatgctagttttcatctgtaatgtcatgatttatttatggaatatattaaatcattatatgcctataatctcaacaatccaaaaaccttattataggcactgtgattttactatggctggttttgccgatgcactgaggccggataaattcaccggtgcattttaagagatggcagatcagagtcactctgtggctgacagctatgaaatgcttctgggtgagtactggcaaacctgaaggagttcttactgctgaacagcagaagcaattcgaggaagccactactctctttgtgggatgcattcttagcgttcttggcgatcatctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctatagtcgaacaggctcatgatatacaaaccatggctaaggaactcgaactccttaagtgtgtcttacccgacaaatttgtggtcgggtgtattattgcgaaactacctccatcttggagaagtttcggtactgcactcaaacacaagagacaggaatactccgttgaggggttgatagcgtctcttgatgttgaggagaaagctcgggaaaaagatgctgcgtctaagggcgatggtggccagtccagtgccaatgttgtgcacaaggcccagaacaagagcaaggggaaatacaaagctcagcagaccaccaacttcaagaagcagaagaagaacaacaataatcctaatcaggatgagaggacttgctttgtgtgtggtcaacctggtcatctggctaggaagtgtccacagcgcaaggggatgaaggcacctgcagggcagatttctaagtctgctaatgtgaccattggcaacactggagatggaagcgggtatggtaatttacctactgttttttcagttaatcagtctactaattggtgggttgatactggggccaatgtacatgtttgtgctgatatctcattgttttcttcttattaggtcgcacggggttccaccgtcctaatgaggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactgcagcgggaacaccactgcacagg

SEQ ID NO: 8632 - DNA, 1501 bp, Oryza sativa
cacagtccacagtcttaggtcccagtttgcgcttcttcgttactggtacattgactttcgccaagcacccccatgtgcgcaaataagaaagtgatggttttctcccaatccatatctcatatggggtttcgtccttatttctgttaggaactctgtttaacacatgattcgagatcaacaatgcctcccctcaccacgccttaggtagtcccgcagtgtccaacatggcattcaccaagtcagtcagtgtgcggttcttcctttcagcaatcccattagactcgggagaatagggaggcgtcctctcatgtatgaagccatgttcttcacagaataagtcaaactcgtttgagaaaaactctccaccacgatcggacctaagtctttttatctttctgtcaagttgattttcaacttctgccttataaattttaaaatagtctagagcctcgtctttcgttttcaacaagtacacatagcaaaatctagtagcatcatcaatcaaagtcatgaaatatcgttttccaccctttgtcaacacccatttcatttcacaaagatctgaatgtaggagttctagtggtgccaagtttctttcctcggcagctttgtgaggcttgcgaggttgcttcgattgcacacaactatggcacttagaacctttgacaatggaaaacttaggaattaaacacatgctggaaagccgaaacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaactgtcacaccccgaagttttcctcccaagccaaaatcgtaatttacaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataatttcaaccaattaaaattgagcaagcaatattttattccagagaaaatcctttttcctttttctttttctttttcctctctttttcctcctttttgtcaaatgggccgtcggcccatttctccttttcctccccctcctctctgttgggccggccgcaggccgaggcccagccggcagccaggccgccccgctgcctcctctctcggggtcgccgacaggtggggcccacctgtcggacccgtctccctcctcccgccgattccggcgcgccgccgcgcccgcaaccgtcgccgcgcccacgtctccgccttcctcgggccacgtcgaccacgcccgcgcgtgcgccgcgtctcccgcgcccattcccctctctctcccgctcgcgcccgcgcccgaga

SEQ ID NO: 8633 - DNA, 1501 bp, Oryza sativa
tttctgttcccagattgatgctttaaggatacagctccagttattcagattttgtgaacccacatgctataatctctaggtgaaaacctaaactcttgattgctatacctaactctaaaatcagacaacacctactatcttacacatgtcagttgttcacggttatttaatttaaggttacttacatgttctcttatggtctttagtattgtcatgcatattctgctgcagcagaacttttctcttaatagacatgtatatataaaatataggcatacatagggatgcaacatcatctattttaacactgaaagtttctgaaaaatataagataggtaagtctgaaaatttactgtcacaacatgggaataataggaagatctacggctctcaattgcctctgttctatacctctagatgattcatttctcagttagttttagatatcaccaccaaacctctatatgattcatttctcagttagttttatataccaccaccaaatttatatacacatggtatataatctgtgagatgacattttatatagtatagtctcaccatcaatttcttttgtagtggatctgaacatgtcaataaagggtatttataatgacttgtttgttttctgcattttagtttcaacttgtggttccagctgaagcaattggagatttattaaatctaaggctacatgctaggctgctatgaggtaatctgaggaattcaaatttatatatctggcagtacaatatcatgttcatactgctttgttctggaaaaatatctgacagtttagcacctcaagagatgacatttgtaatgtattactcctgcatttcctttttcctctagtcaggagtactcacatgagttctccccgtgctaacgctatgattaaatttgacaatacatttcaaaaatcaaaatgcatccgagttcaggaggattcacatgagttctgaatttctgttgtagtcactgaatttgtgttcaacccttgagaattgtcaaacatgctaggatcaagtatatatgtcagccattaggaaatgtgagtttctattttttgctaccagcagctccatgtgaattcaggtgcatgtagatgattttatttaagttttaaaacctactgatgcaagttttgtccatatttagtcaatatagtttagcacataactcggtctcggagttcacggtcgctccctcagcatccagagttcaatggcgacggtttctgctgcttctggtggtggtggcgctgctcatggtggcttctgctggtggcaaataattcaggggcggagctactatgtaatagggggtgcccaggaacccggtcaagaaaattttttagctatacctcacctattttcaccatgcatgcacccccctcaatacaaacttaggcacccgcatcagcttaaactcgatctaaagtagagtaaattaagcaaatggcaccaccctccatttcgctctagctctgccctggcga

SEQ ID NO: 8634 - DNA, 1501 bp, Oryza sativa
tcaatcatccatcgcaaatagaaccacccgactagatctaaacctaggtgatccaatagacaacctaacaatggtatcagagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcagcgaaggggagtgggacggcgccgccgtgtcgccatgccgccgccggcgctgtgctagggtttcggcgacggcgacgccgctccgtgcaaccgcaagagaaagaagagaagaggagctagggtttcggcgccggcgggcgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacaggagattttaattttaggaacattaattatgtgctatgatgttgtaatttttctgaccaatgttgataattgcaatgttatagttatggctttatgtgttatgtctattttctgcccaacggtgatgtagacttaatacataataattttaatgttaattttgttctcacaatacatgattatcttaggtggctact

SEQ ID NO: 8635 - DNA, 1501 bp, Oryza sativa
tcttagaaaaaacttcttggaggatgaatcgcaaaaagtagatccgaaggttgaaaatttaccagattttgctcatatatttccgtcgaatttgatggcttagcaattccaacaaagaaaatgaggagtgtggtcgcacacggcacgtactagctaagctagctgggatccatatgcatcgatcgggcgtgctttgcataattggctcgatctagctgtagatgaacacatgacaccctttttgtccctccattttgttcttgtctaattaagaacaggtagcttagccacaaccaacatgcaattggcggcagattttgctagctgatcatgtgatctgacgaccgatccccgcgcgcgcgcgacaaaggctgagcgcgcacgtaacgctcttttgcatgcatgcgccttgcgtgcatttgatgcgtgtgagagcaaaacagtggtaagcatgcagttcagcaacagaagtttaacgtcgaggatgtggatcctctggttttaagtcactttgattttttttttatcattggtctcactaacaagtgggtccatggtgatcatgaagtaacctgatttaaatagtaggatttagttgtttattttaatagtgaatattaaactcggtgtttactccaactgaaactgcaatattttattataaattatattttttggctcaaagcctaatagaaataaataaagatagatgaaaagacgacatggcctgacggccatatcaaccaaagaaaaatagtagcttattcaaagttcaatttattactaaatctctatttaaagttagcaaaaactacatgattattgattaaaatctagcatgcaacatatatgatttccgtgtctttttcactcctttgaagttggccccagaactaaagccagtaaattgctctgaataataaattcatataagatctaattggttgacgggactcttctcaaataagagaaaaatatgcaaaaagtagagtttttaatagaaaaaatataactgcaaatgtatatatataaactgaccacgctcgccatataaacacataggaatacactttaccccttcaagaaatagaaaccatgtcagcactgattatccatactagattaaaaagagttagtggtggtggccactggccaccagcaccaccaacctaacagtgagcctctttagtcagttcccactctctacaatatatatatgtatatgtatgtatgtatatatgtatatgtatgtatgtatgtatatatgtatatgtatgtatgtatgtatatgtatgtatgtatgtatgtatgtatgtatgtatgtatgtatgtatgtatgtatgtatgtatgtatgtatgtatgtatgtatgtatgtatgtatgtatgtatgtatgtatgtatatgtatatgtatgtatgtatgtatgtatgtatatgtatatgtatatgtatatgtatacacacacacacacatatatatatatatgtatatatgtatgta

SEQ ID NO: 8636 - DNA, 1501 bp, Oryza sativa
ataattataaagccaatcgcatgcttgcgaagggaatttaagtaatttaaaattcaaatattgacaactgacatgattaaaaagggaatattttattctaaccttggtatttgttaaacaaactaaaaatcatgatattttggaacggagacaaaaagtataacatatatcccttttcaagtttactaaccttttggtcaaaacacggtagaacaacgttgtcatgtactcatgtaggttaaaaaccctagcgtgtgataaagattgcatcacattacttatggaggtgctataagcaatagaactataagtaacaaactaccattgtcggtaatatgggaccgggagtatcatgaccagaggcttgaggcagacgcaatcgcccacgtggcctggcaccttcgggggcgtcgggcccgagggtgaggtgtccgccctcctcctgatttcccccgagggggggtcgggttgtgcttgccccggccccgagggccgaggcaccccgaccccttaaagaaatctgcgccacatatatggggcaagtgagcacagctgtgctcacctagcagcatttattgcagtctggtcaagcgcgtcacgctgcatgcagcgcagtacggcgcgttcttttatccggtctgtgatcagtcacagaccggtcagatcacgggttaggtggcgactggcggtctgacgcacgccttgccccatcccgtcaagacgaaagcctctaggcgctcgtctcaagccggagttaagcgtgttatctcttagagatgacacgttagccccagtcgatatatgccaggcttcatcctaaccattacaggcaagatgttgtgtgaagaagggcaaacatgcacattgccaagattacacgcggtagacaagaatgaccgatttgtgaccggtctgacactgatcatatcgtcagcgcacagccatgttcccacgacgcgctcacccccggcggaagtggaggtaggtgtgggctgtcccatcggagcgtcattcggacggcaaccgtgctgatctccgcccattcaagagaaaaagaacagtccagtttggaaagagaagggtgcatgtggtatccccttgaaatataaaaggaggaccttgcccatgaagggggggggttggttggttctttcccagatggtgagcttagaacgggggagaagtcagctcacacttgtagctcattcatacacagatccaccaaaacacaggagtagggtattacgcttctcagcggcccgaacctgtatacatcgtccgagtctcgcgttttcttgctaacagacgatctttccacataccgagagagcttgagatctcaccctaagcccccggccgaaccggcaaaggggggcctgcgcggtctcccggtgaggagccacgagctccgtcatctggcgcgccaggtagggggctcagcgtgtgctttcagggctctcagactcttccgtgtgccccaagtttttcttgttcagcctaa

SEQ ID NO: 8637 - DNA, 1501 bp, Oryza sativa
gccacatcatcaggtaatattaattagttattggattcactagaagataaaagaggatgaattaatcttgaatggattagatggatggtataaaatttgaattaatcttgaatagattagatggatggtataaaatttattaaggtttccggagatttacgaagctattggaaaggattagctagatggatggtaaaattcaagactttcgaatatgcatgaagttattgaaagaaagaaaagaaaagaaaaaagataaagaataagcacaagaagagatcatgtggtgcatataattttaggatctacacgtacagtaaaaactgttttacaaataaaccctcgtcacattccttccaaagaaacaggcagccataatcgcctaattttttagaatgatttcgtaatgatttttttataggtttattaatttcacatgaatttaaaatacaaataacctattttcttacaaaacccaaaaaatatatgtgcatgatctataaaagcatatgcaccaacagaaaataagaggatggtgagaaggcaaacgataatatagtgactcgtacaaatataaagtttgcactgcatattaagccatttataataccatcataatatcatttatcctagccaacgttctcttccgatcaacgagagaagtccaatatagaaagattgccacttccacgtaaacaagatgtttatagtcgtgccattgcgcgatattataggctagtaattttgaattttaaaaacatgattttaaatttatttaaggttttctttcaatatagcttacttttatgcatttgcttttggaccccgaataatgtagatgcaaaaaaaatacatgtaaactatttttatttggttcattcatatctttgcagattatcattataactcaaccaatcaaaaatagattcatgtatttcaaagaaaatataaaaacaataaccatggtaacaaatatggacatgttcagtaaatgggttataaaaggtgggattgtgatagggtaatgaacagagggttgggatgaaattaagcatgaaaaatgaatggccagtacttaaatatacccttcagtgggtgtgatattatttcctaaacctctttgccaaccaaacactatgccccaattacaccgacaccaggctcagattgaaacagactattcagcaggttatctatttaattatagggttaaattaaagattttttaaactaaacttcataaataacttagaacaatgattcaaacaatgtcataaaagaaatatttttttgagatgatatatttttagaggcataaaccaatgattcactaatgatctaatgaagtagtcggaaaaaatcaggaccctttaaaataaaaaaaaagattgttgtggtacgagcaaacgcatcaagtgcagctcagggatgcgtcgacatcaaacgatagtggaattgacatgtgacgtatctcccaaagcaaagattagctaaaggtcca

SEQ ID NO: 8638 - DNA, 479 bp, Oryza sativa
aagacgagtggtcaaacagtgcaagcaaaatgtcaaaatcccttaaagctactatagtagaagatttttaaagtacctctgtaatttgaatttgaattttaaagttactatattgccagttgatgtaacagcttgctcgattttcagtcatatcgaatccccaaaaattttaaaattaaactacacgaaattaggttaggtttggttatagttcggtcaaatcggtgagccgaacacacccgaaaatcactgttaggttcaggttcggtccagttcggtatgtgggccccaccggtcagcctcagacaagaaactccccaaccccatcccgtcctccatcacttcgccttcgccttcgccgccgtctcccctcctcgccgcggccgccaccccgccctcgcgcctcgcgaaccctagcagccacgccaatcgccgcgcgcgcgcgtgggagggcggcgccgcacccgggagacggacga

SEQ ID NO: 8639 - DNA, 1501 bp, Oryza sativa
atgtacgagtatgttaccagtagaccaaataaatgggtaacttaaggataaaccaatttaattagcttataagtagattcacgtgccgatccacttatatcctcttaaatataaaatagtgcaccgaaaaccttttgccgacaaatatcttgtcaaaagattcctcgcttttgttgatagatttgtcggcaatctagcgtcgcagtgcagtgaccatccctttctatgcatagtcaaatgatgttttatacagtactcccttcgttccaaaatatgcgcattttagaatagtaccaagtcaaatatcttttaattttgaacattagtaacaaaaaaaaatttaaaacatcaatcatgtaaaatttatgttaatagatttatcattcaacaaactatcataatatgcaactcctttttatttaaaatgttttactattttagatactgttggtcaaattagcatctcggaaactgtgtcgaagtctataaatgtttatagtttgagacggagggaatatttaggtacctttctttatacatgtacgaaacatacatataccataagataataaattagataaacggaacataaataaggctgcattcgtttcaggctgttcccaacctctctcccttgttttccgtgcgcacgcttttcaaactcataaacggtaagttttttgcaaaaacttcctatacaaaagttgctttaaaaaataaaaatccatttttgaaaaaaattagctaatactccctccgtattttaatgtatgacgtcgttgaatttttttactaacatttgaccatttgttttattcaaagtttttgtataaatacgaaaatattatttcatgcttaaataacatttgatgatgaattaagtcacaataaaataaatgatagttatataaattttttgaataagatgaatggtcaaatgttagacaaaaagtcaacggcatcatacattaaaatatggaggtagtacttaattaatcacgcgctaatagaccgctctgttttccgtgcagaggagatggttcccaaccctagctaacgaacacagctaagttgagaacaaaacgaacaccagtcattatcgtagcgggcgcgggattaccctgatgggcctaaactcgaaaattaatgggcctaacttgcttctcctaatgggccaagtggcccaatctccccacgatacatggaaaggtagtactagcgaccaatgtgcgcccaagattgatctgccaccgtccgtgaaccaatctgacggccaaaactgcgaaccggattatatccagttctttttccactggacggagtgcgtttcgtatccccttttctccagtgacctgcggtagtagtactcactactacacacggctagggtttgagcgctctgtgacactgacagtgggccccacccccgcctcctcttctctcacgccgcctccgcttcgtctcctcgccggagttgagccgcgggatccgtcggagatgg

SEQ ID NO: 8640 - DNA, 1328 bp, Oryza sativa
actcttgagcccactagatggttgtaataattacttaaccagatatcaatttattaactaaaagaacaccatcctataaatacagagtgagggtgcatgggggaagagcaaacggggtaaatatgtgctaagtactaactactaacagggagtcagggatgtaagcgaggggcagggagtaaaacagagcagtagagggaggattatagtagatgagatgtagaggagagggaggaaaaccacaacatagcagcaaatgagggagcagagtagaggatgtagaagaggggggaggaaacaccaaaacaagcagcagaggaaggataagaacagggtagaggaaggagcaaagcaggatcatgtagagcagagaaagaaacagaggaaagaagagggtggaggaaagaggagaaagaagagcgtgcctgcttagtttttgtgtcaatggtgaggaccaggatgatggcgcaggtgcagaggaccaggacgatggcgcaggtgcagaggaccaggacaatggtgcaggcacaggatagccgcaggcaacaacttggatcgccgccagggatggagatgtcgcgagggatggatcgccacagcctcagactccagcgaccctctttctgttgttttctccttgatttggtgggatatggtgcgtggggaccttttcaccccaaaaattggcgcttctgttagttctgtttcacgcccagggcccatggcgccaattttttcgggctcttcaaccaatcgcggcaaaaaccacgccctcgacttcctgtggcgttgcctttagccattgtagcgcctaaggacgcaatatcgacgccgtagcggcgccttgggcataaggcggacgccataagcaatatggtaaggcgggccagacgccctgactcctggcagcgccttaccgctatagcgacgctatggcgatgccttgacaaccagcagaacattgaataaggtatcaaatatccaattgttgcaattatgctgttatgggcctcatcgcaggcagttaagagtatactagcaaatacgcagatccaattagtacttgtttgatttgatgactagctttgctctcgaatgtcataattgatgactagtataagtttacttgcatcaagatataaaggactttacagatatgcagtatatctgaagcttatttaatgcttcatacaatttatgtaaatacttaaaaagatcgacttcttttgctacttgtgtggaagcacttatgtaccttagaatagcatgatattgttgtatctccatttgttttactttcctaacattttccttttatcatgtacagt

SEQ ID NO: 8641 - DNA, 1501 bp, Oryza sativa
cccacccactttttttttcttctcgaatttgtattaaccctagcttctgttctagaaatttgcgttagactcagtactaataacagtttctttgctcccaaaatttttcgtgggttcgactgaacccccatgtggccatgtccgttgttagatccgccactgcgttatatcctcgtgtttttgattgggtggcttatcaaataataggtttctgaatgtattatacaaatatcttgtgcaacctacccttttatggttgttattgcctttatttaggtctttgctttgatactcttttagtagaaaaggcttgcgctaacctcgaatcagtattctgttactaatgcttttaggtctttgctttggtactcttttagtagaaaagggcttgcactaacctcgaatgaaaattcggttactaatgagtcggggcatcgcgacaaaacactaaacactgaaatgtaaaattagctctgtcctattctggtgtaaattagttaatcaaaatacacttctgttgtcatcctaaaccaactattcttaattctcagccatgacttcaatttcatgtttctcttgtgattggttggggctaaaatttgttcaatacagtttgttgctcaagggatgaatgccaacaatttactgtcactcattgatgtaggttccgttaacacacttttactatgtctaatggatgagactgcattaagtaatcgatataccctctaaatatgctatcctttcaatgtaattcgcacccgactacattaacctgctgacagtcacatgcaattgtctcttgctgagtgcatgtactgcatttgagtcccagtgactatttatgtgcttagagattaataaacttcttattatatggagcactaaagcatggcacatattttctagtaggtttattttatatccatccttatggcatgtctttttgtacccataggtactgttttaccaaggaaatatggacagatttgtataacattgcctaagctttgaatctactttgaaaccatggcccgaaaaggaagtcaaagtaaaagtgttctgaatcatgcttcacctaaccgacaaaatgcagctaattgtgaggtactaaatacaccagaaagtgatgtgatggatggtgaaaatcgaagttcacatgttcaaggtggttcaaatgtttctggagtaaactatggccagaaaacaaaaggtatcaagaagaataacagaagcaatggcatttcatcctctggcaaatcagatgacagagcctcaaaaaagcagtcagtggacaccaattatgatataggtaattcaggagaaaatgacaatgagttatcatccagcacttccaaagcaagaagagatagcaagagatcatcacggcgtggatgtggtaaaaactcatcgatagaacaaaccccaatgccagtttttgcagaaaaagttttggagaagaccaggtgcatagcttgcatggctgcatccatttttaggg

SEQ ID NO: 8642 - DNA, 1501 bp, Oryza sativa
agcaacacgtcgacgtcgacgccgctgcagcatccgagccggatcagggcggctacctgagcactgaccagctggacagcgtcgcggcgttcgtgcaagaacacgaggcgttcgtgcaagaacacgagggggacgaggagttctgcaagagcctcgggttcgacgagcgctcggatccgcaatgctggaccaacttcttcttgtcggcgttggaggagttcgggccggcgccagaaaccgacgccgccgccgtcgccgtcgccgccgttgagcctggcccttgcccggagtacgaggaacacgatgacactgccactactgctgcgtccagccatgcttacgacagtgccacggctgagctggtgaacctctcggacaaggagttctatgacatcatcttctccggtgaccaacaaggcggcgccgctgtggctggatgagcctctgagaattcctccgacgagctgtccaacactaacttcatgggacttgttagatgtttattcgtacttactccgtttcataatgtaagtcattctagcatttcccacattttacattgtgaaacggagggagtagctagctacctagctttggtcctcgagatgtaaagattcccattgcgatgaacagaagtacagaactctcgtaattactgtcactaatcctcgatgtgttgtttagtcagacagattgattatttctgtgcgtctaattgaattcactagatcagaataaaaaggattgctcaatagtagtaggaaattttgtaagtcccattaagattcaggtatgccgcccggatgcagagttatgagacgaactcgctagctgctcaatgacttttggatattccatttatcagataaaaaagagattgcgttactccttttcctctcagcaatgtctctagtagtgctaaaaattcatggactttcctctaatcactctgaccaaacacacacacaaaggaagaaatggcaacttcctgatgttggagttaatttatttctagaacataccagcctactctctaaccctctctactactcgtgaaactaaagtcaaggttgaagtccttgctctataaattttctagaacagtgtagtgtgtagacatgcatgatgtgattttacagtagtactagtaccagtgaagtttgacaatgtagtagtactacaagtctctagctaggtcctgaagcttcctacatatcagtttatcaagcctataaatagaaagccagtgcatgtgtatagactgatgatggtgtgctgcccaacgtacaagcaagtgtactgttcagtcctcaagcaagcaagtaaagaaaccagttaaaactagcacaagcttctctgctcctcttctctgatcccctgcttaggaaatatttagcaccaacaactggtatcagagcgcccaggttcgagtagggcgtgacagagtagcacggcgtatcggtattgtcaattgaagctacaagtatggcttcaagttcgg

SEQ ID NO: 8643 - DNA, 1501 bp, Oryza sativa
agtttacaatcgccagtgcctctgaagacggtaaggttgtcatctggaccaaggggaaagagggcgacaaatgggaagggaaggtgatgcatgacttcgaggctccggcatggagggtgtcctggtcactgaccggaaacatactgtccgtggcggccggctccggcgatatcacactgtggaaggaggcatcagatggtcagtgggagaaggtgaccaaggtggagccataggaagcctcggctgtggcctgcagtttgcatctcatatcagattcagtcagatacatgtttctagtagcaatggaatccacgagtgtactgatagatactcaaattctcacttgttatcatcatcatctttggatggatgttgttcttacctgaacagagttgtgctgtgtctgtttagacctgtaatttactggtgcaatggtggtttcttagtactgtcaaatgagacatcagacatctatgagacgattatagtctagtttcttccttgcgctttgacatagttgaataaagcaatttcttatcccatggtgcctcactcttgaaatatgagaaggatttctctaatattttgaggtctcttcagaaaaaaaaaaacgccaacctcaacagcagtcgtccgattctgatccaacggaattcacatgagcacataggatcccgattatttttgggcctaaatgctactctgagaaaggtctgagaagcccactaacacttgcacagcccataaaggcccaaagctcatgcccagtttagtctctaacgctttgcaaaagaaaaacagaaaaaaaggaaaaaaggaaagggaaaaaaaaagtagggttccggcgaccgggctaccggcggcgagaaggcgcagctccgcacccaccggccaccgtgaggcctgagccccccgccccctaacgccgacggcctacacccagaggcgactcggcaagcgggctgtggcgctaggcggcagcgggggcggcggccgcgaccacgaccagcaaggaggaagggctctcctctaatcctctccgtctctccaagaatccaaccaggttagttttttgttatcacatttttactcgggtaactacctctaatcctctccctgatggatagattgaaatcgaagtcagtgagggttcagagatcaggcttgtttttgtgatttgtaggcctagatcaagttgatttcacaattcaaagatgcagtgcatgttttctatgattcgaatgctcagatcagcttgatttcacaacctaggcacactcgtcgtcgtgattccctgggtccgcttcgcctagttatttagggggagagattttttttctgttattatacctgtttctcattgctgcttctgcttgtgcttcttaggtagcagctgcttggcagtgggcagagcaacatgtctagcaatgtaagttacttatatatgcttcaaagagactcataaaataaggcagtgtggtgcatttgagctgaccttttg

SEQ ID NO: 8644 - DNA, 1501 bp, Oryza sativa
gtattttatttcctcataggtattattattggtcaaagattgcattgatatcttaaaatgcttatctttgtggatggatagagagtaacgaactattaggaaaatgtgtcttcatatttttcttcctcttacattatgaacatagaattatgcatgcaatgttgaacagaaaacacgcatgtgaacgaccccgtattgatgcgtccatgcatgcactaccaccagtatttcgttaaaaaggtatgacagtgcacctgtcctggcactggagacaaccaacatggtgacagggaagtgcatggatgtatatatgtctgtctatgtatacgaattgaaaatcaacaagaaaattattttttaaattactagttttattgttcaaatcaaacagtactgctttacaaagagagcattgcgatcacaattaatattttcccaaccttattagccttttgattcttctgtcaattaaaacctcatatatttactgaaactatgcactcgtagacaaataacatgccaatacgtgtctagctagccagtatattagtcatgactttgattatttatcttattaaaaaaatagaacacatacgaaaaaatatactccctccgtcccattttaagtgcagttgtgaatttctgtgtccaacgtttgattgtccgtcttattaaaaattcttttgtgattagtatttttattattattggatgataaaatatgaatagtactttatgtgtgatttttttaattttttcataaaattttcaaataagacgaacgatcatgttgtacacgaaaacccacaactacacctaaaatgagacgggagagtatataccacggtcaaagtgcctttaatcataaaataattcaaaagaataaataatatttacatagtttttttaataacataaatgattaagctttttggacaaagtcaaccgtgcatcaaatagttatgaccggagggagtagcttgtgtagtggaggcttgccattcaatcacagaggatattttggtttgactcaatgttcagatatataccagctaggcgataatgatccaccattttgggattaataaaacaatataaatatgctatttcatcgaaatttcagatgtaattatatttaaaatggtactataatgagagaaaatatgatatagataaatgagtttataatacaacatggcttaagaatttataattcatgcttggaacaatttatatcaattccggtcaatatactagccagaattcgactggaacaacttgaattaaaaggtacagtatttggctcgccggaaccccctattttccctgtcattctatccaatagcagaatggaattgataagcttgtggagagagtttaatgaagtcctatagctagcttaccatgaatgttgtcccattattctttggtgattaaatagctgcccactcaaattaatcattgcttcaatttgatttcttcctcttattgccactgcaga

SEQ ID NO: 8645 - DNA, 1501 bp, Oryza sativa
aaaagttttattcagctcagtttaagaatacttgcatgtatatatatcacaaacacatgcaatctcagggatacacatgaattttcttcttcttcttcttcttcttcttctttgtatgtggcaagggttaaggacaaatcactactggggtaaccgtttttactcccggttgggaactaggagtaaagattcccatctttaatcccgggtgaaataaccggagtaaagttgaatctcctcttttcttttttttttcattgtttctttgctactccctccgtttcatattataagactttctagcattgcccacattcatatatatgttaatgaatctatacatatatatatatatgtgtctaaattcattaacaacaatataaatataggcaatgctagaaagtcttataatatgttaatccctgtattttctcctaaatcaagtgccatgcatatcctcaaatcaaaccctaaatccccaaatcaaagtatcatcccaaatcattcacattacaaatcctaagttacttatacacacaaatcaaatacatcacaaatcctaaaaaaattatacacaaatcaaatacatctcagatccatgcaatgaatcataagttctaaaaaaacaaattatacatctcaggaaatcacaaattatatataaaaaaaagaacggacgctgccacctgccactgctactgtcaccgcgcgcggccccgcctactgccgctcgccacgcccgtgcgcggccccgcctgccgtcgctcgccacacccgtgcgcgcccccgccgggcgtggccccgctggccaccgccgactgctggacgggaggggaggagggggaggagaggggaggaggggggaggagaagaaaggggatctgaggggttaggaggagaggggatgtgatcgatccaatcttatctaaatatctcagtgaggaggaaagtttcgtctaggacttaaccgatcagagatgggagagaaatatttactcccgtgaagattgattggtaaatggtatttacttattaccaaccggtactggtcatctttagtcccggttggtagtatcaacgggactaaagatgcttggccccctaacaggcctctgataggggatgaactgtgactaattatgatctttatagtcccggttggtagtatcaaccgggactagcaacaatctttagtcccgattcttattaaaaccgggactattgtggaaatcacccgacccagcaaggatcatttttctagtagtgaatggagaaattatctccaaactccaacggcaaacatctattgggtctatttagtttgactagtttatttataggagagaagtcagagaactgtcaggatgctagctagcttgatttctgctccgatccgtgcaaggaaaaggaaatcgacgacacatactcgttttgtgccagcactcgatcacatctcatctccattcagcaattttgtttgatactccgtacgtacattagc

SEQ ID NO: 8646 - DNA, 1501 bp, Oryza sativa
tggcattattaggaccttgtccaccttgacttagacaaactgcgaattaggtggtgtgacatgtgttgatattttcttttccaatcctctgatgcttacaacccggttgtgcttgtgacgtgcccctacctttgtttgacttcaatgtgtagtataacatggttgtcctgggcaagctcattacgtattccccatgagctatttagttgattgggcgatgtggtagttgcatactagtcgtcctttcttcccttgtcacctttggcggcctcggcttgcttaaaaggatacatatgcttttgtaactagaacatttgttgttgaatttggattatttgatcccatggcgaattctcgggctagccgtttcaaggtatttctttatcttgccttggattcctcagttgtgatctttctttggttgtcatcagtttgatgtgttcttactcctttcttgaagtatttctgttcttgctgttcagttctgtgattttgtctgaaaactttatctttgtgcttatcatctgcctgctgtttaatttaatccttgaccttcttgagtcctttcaatgcttgtactgagttttttgttaatataccgtagaaaaacatatggaagcttagagatcaatgttgagcgagttatttttatgaatcatgcttttcttgtgtgtctgtaaagttgaaacagggacatcttttttgctaaatatagcttaaagagggatggtatgacatgtgactagagttccatgatttctttttctgtatcttctcagtgttgtaaactcatattagaatgaacatcatttgacgagcacactttgttctgtgtggtaaattagcatcttacatctcacatattgtggatcaggccatataacttatttattttttgcaatatgtatgaattgaaagtgcttttttttttcttcttgcatacttgattctagctaatctagagagtttgatcactcagtattggatatgtctacagctatatttagctggtgttcagagcactattatgttgatgtacattttagctttctgctaacaatttttgtactatttctagtccaaagtagagatctttttaataagccaagtctatataactgtgtgagtggagctaaaatgatgagtatggtgtagtatgaagctttgattgggatgtgaaaatccatgggtggaatcaggtgcatggggtctatcaagaaattagataattattgttagtaaacattttttaagtgttcctctgctttgtccagtaccatggtatattgtcacattgctattaactctaagagcaagataagggctaaagatcaaataggttccagcaatgccaaatatttcaccatgttacaaacaccaagatcgattaaagtttctaagtattttggtttgttccatttgttttttggcagcttcagtatggtttttgtgaggtaactttttattgaatttttttctttacattgccagatgtctaatc

SEQ ID NO: 8647 - DNA, 1501 bp, Oryza sativa
cttcctcatcgaggtgtcatggatggcgccaacgctaatgttgatagactcttcggcatgctggagagggacgaatggagagagaagacaagttcatacacaaagtagagatgaacgaaagaaggaagagatggtgcaataaagtcattctcatctcaagttgctgagttggtagttaaaagtgacaaaatagaaagaatctagtgagtacagatgacaaataatttaagtatattataatgatggtatttgagaatacgtatccgggagaatggcataaagtcaaaaacccatagcgaggtacgtaaccacaactgcaaccctgaccccattagattggccttagctttaagccaaactcgagttttatgccaagcttcaagcaatactccatttaaaagaatacgatccctttctcgtttctcctacaccctatgtgagcagcactcacaggttgttttggaattctatttttctttacttttaggaaaatgtagagcccacatatgtgcatttcccaaacacttgcaaatctagagaaacttctgcacgccacttgggctccaccttaagactgtgttaactccacctccctgatggggcggaggtagagtatggaaggggtgcccaagaatccggtcaaaaaaaaatttttagttataactcaccgattttcaccatgtgtgcaccctccttaatacaaacttaggcatacacatatcagcttaaaacttgatctaaattagagtaaattaagcaagaggaaccctcctccatttcgttctagctccgcccctgcctctctacatgaaaaacgatattacacattagtgcatgattaattaagtattaatctaaaaaacttgaaaaataaattaatatgatttttaaagtaactttcgtatagattttttttaaaaaaacatattgtttagtagtttgaaaaacttggcgtgaaaaacaagtgagataggttgggaaaatgaaaaagaaattcagcgtaagatcacttcaaacaacatggcagggagcattgagattcactttgtcacgatggtaatatacgaagttttcaaattttgggtggatttgattttttttaaaaaatttgaattgaaaattttcaaatataagttgaaattaccaagtagaaattcccaaaacaacctttaaatacaagttgcgaacctaataaacatgatcttaaaaaagatcactcaataaaaacagacttaacaaactattcggcctataaggcccactaggcccactaggcccgacctcgtgcgggccggcagcagcagcaccaatcagcccagcccacgcaaagtatctctctctctccgtctccgtctccgtctcctactctttcctcctcttacaagaaagaaggaaagagaagagattgctctttgttgttcgcctccgctcgccgcgcctgcagatccccctctcgcctcctctcctctcctccccaaaccctagcgagcgaccaactcct

SEQ ID NO: 8648 - DNA, 1037 bp, Oryza sativa
aagtttttcaaaaagaccaaaatgtgaaaaatcggggtggggcctacctgggggtagggggacaggaggatcgggagaggcggatacggcggggccgacgcgtcgctgtctcggcgcgggaaaaaaagcggtggctctgctctctctgcccgcgcgggctccggcgtgattggaccgacggtcaggatcgtggggggagaagaaatgggcggccggaaacggttttactgggcgccgcggtcgccgtctccacgtcggtctgatcgcgacactggctaaggccgatcaggtgatctcattgctccgtgaaaaggaagtgaaccactccctccatctcattatagatgcaactataatttccccgtgtctaattttgatcgtctgttttatttattttttataatgagtatttttattgttataagatgttaaaacatgaataatattttatacgtgacttatgttctcatttttttttcaaatttttttaaataaaacggacggttaaaattacgcacggaaaattatggctgcacttataataggacggaggaagtagtattgatactcgactactcgttattttaaaaaataaaccactacagcctactggtactcggtgttattttctctccttttccaatttgtatcacttctcacactccccaaactatgagacgatgtgtttttttaaaaaaatattataagaaagttgctctacaaatttatattaatatattttaagtttttaatgcttaatgaatcatgcgtttatccgctactctgttttacatgtgtagttctcaacttacataaaaaaaacatagccttaattgttgaattttggggtgtgttaagcgagactttttaaccgaggaattttattgatattctgatgcatgaaaataccataaagttattgtgtttaaaagaaggcccaaaaccatttattctagtactcaaatgtgcttttccagttgcaaatataattggatgggtctaatgcgcacacgttcgagtgtctagcaatacgtgaa

SEQ ID NO: 8649 - DNA, 584 bp, Oryza sativa
cgccctccgccttgtacggtacggcccggcccgtggggcccacctcgtcgcagcggccggtgcgcggcggccctgtggcgagtcgacacgcggcggcgaggctccgcccctcctccatgtgggcaagttgggccgaccggccacttgccggtggggtgtgggcccccacgcgtgcgtggcgcgaacgtgtcgcggtcggcgcgccggcgcacacgtggcgggcgggagggggtagacggtgtacggtgtaccctcgggggaggcgcggagtggggcccacgtgtcggtgtggaggggtgggtgtggatcgggtgagaagaggtggaggggtagtacgtactacctgaaaaagggtgggggccactgtgcaagttgggtgacgcggggtgcacctgacgacgtagtagtagcaaggactgcaggaggtgggaggtggtggtcttttttctgatctcggctcggctcggctcccctctatttcaattttcaaggcacgtgtcggctacggcgatggtcggcttgagccgtgagcccgagctgcggtgtttgtcccgccgcggcctggtcggcttcggctctcggct

SEQ ID NO: 8650 - DNA, 1017 bp, Oryza sativa
tccgggagtgacacttacccactagacatgtggaagtacggtagtgctttgcaacagaggcccaaagaccggtccttatgtggccgaggtgctactatcaaaaccatgcaccccgagcccagcctaaaaccattttgagggttttgaatagagggggaggtgtgtgtgtccaattccacaataattcaaccattccatagtgtccaagtgatatgaatattcccaaagtctagagttacaaaaccacctaatgttgtctaattgatcagcgaagcatctacctaaattcatactagtggaaccatgaatagagtactcactagttggggtttgtttattctagggtgaacaagataataataacaataacaataataataaggtcataacaagggtaaataggcatggctaaataaaacagtgataacgcgggaatttaaataaagcgataatgcattaatttaaatcaaaataatttcataaactgggattcaatatgttcaaagatgatgtgacttgccttgctcgctttcccaaacgtcggcttcaacctccacgtagagcggatcttcgaagctgcagcgtctacacgaccaacggaaaggaaaaatgcttttactctaataaactccatataacaagcaggaacaaagtacaaaaatgggttcttgacttcttaaggaaaacttagagacttgaacggtccaattccgagttcaaatggccaagttatggccatttgaagtttatatgctctttaagtgaataattgtgaatttcttcatttaaattttaatttaaaaaagatttattgcgtcagccaaggggagggggggtgcggaccgggtccacgggagtggggcccacgcggcagcctcacggtccacggtggaccgggcgcacccgggctcacaccggccggcgccgtaggccccacgcatcagccgcacccgagggcacgggcggctaacggccgggccccacgcgacggccacacggcgcgcccggaggcggcca

SEQ ID NO: 8651 - DNA, 1501 bp, Oryza sativa; identical to SEQ ID NO: 6688

SEQ ID NO: 8652 - DNA, 165 bp, Oryza sativa
ctggtggcggcggcagaggcagaccgggtggcgggtgacggtagcggaggtggacagggcggccggttgcgaaggtgcggctcgcccgggtagcgagcgactggggcagaggcggggctccactgcccgagctccgcctctacccatcgccgtcgcgcctcgagc

SEQ ID NO: 8653 - DNA, 1501 bp, Oryza sativa
taaaagcgatgtaatttctcagagaatattcagatattatttatttcgactggaggaagatcaatcaagcacactacatgcatatataagggcagagttttccgtagtgcaagttcattatatgggctgatcggaactgctagttgatgcagccgctatggttgtgactgtttttcagctgctagctgtcgctacagccattttttttgctcttgcagcctcagcagcgagcactgccgattacatccatagttgtgtctgattcgagctctagttaagatcttcgactcaaacaattagtacaactagacaggagtattaccttatttatttttttctaacttttcaacaaaatccatgtataacgtatactcccatttgcatactgtgcatatatcttatcgtatttatagtgacaattaatgttcctctacacattattttttctatattacatcaagtctaatttattattttttacatataccagggacaaaaatagtaacaagattacacataaggatggcacggcaaatacacgatattcaaatggcacaaagccaaatatcattgcatgcaggccggggcagatcgatatataccgtccaatgactctacccaatgaccatctgaactaataatagattcataataaaatttaaatggttttcaacgaaataaaatacaacttttacacaaaacactcgatataataagatttattaaagctctaaaactttttggacttgccattgatcgcatgcattgagacttttcaaaaggaaggtgacacgtactacgcgtagctacatggctttacctacctagctacttactcatcgatgatcagtcatcaccagctaccactgcaagacgtcgtggtgtggtcagcacttaaattttagcagccaagtcgtcaggtccatgaagcatgcaacattttagttcggtcttctagaaggtagacaaacatgtggttgttgttctagtgaccttttgtgatccttttcgactttagtagtaactgatttttttccagtctctgtcccaaaaccttttgcaacaaaaatggttattaactgacttggagagatttggattcatctgattaattaatttgtgcaattgctgcttattctttctttgttgttttttcaaaagttatttggccctttggaatggtcatgcatggaaaatttcttgtggaagatgatccacatatatcaatatatcatatccatatctatcagtacatatcaagaaaattacatgtagaggagtgttaattctatgatctcatcctacaacaagttgtataaccatcattcactgaagggtaagtagcatatggtcagccaccattgaatcatctcataatttatgcaaaccacttgggggagacacaactgcttaataaaacagttcctctatcaaatatttgtccattatttgaccacttcgctttgaaaaatatagaaattaatatattcatgtaaaaccg

SEQ ID NO: 8654 - DNA, 1501 bp, Oryza sativa; identical to SEQ ID NO: 7566

SEQ ID NO: 8655 - DNA, 1216 bp, Oryza sativa
cctaggcataggttccatgttattgtaaatgattctagctacattatgatattttatattatataatagaaatataaaatatgttttgatagttaattagaatttgactatgggtcgttttagtttccaggatcttttgttatattaaattgcaggtatatatatttttgggtaaaaaacactaatgagaactagatgataaattcctacaattaataacactgaaatcttgtgatatccagtttcttttctttcataattatgataagaagaaagatgaacacactaccagaaactagattacttaaattatgacggccaaaaaccgtcaggataaaaaaaacacgtcaggaaagttgtacatgacgtgtcaatgtcagaaaaataaattccgccaggactagcttgtcagagaaaaattccgtcaggatagaaaaaacccaatatagttttttttaacctttaactggaaaggaccaaggaggcatatacatctcaataattaatgggaatggaatgggagaaaaccatttttttatttccctatgctgttcttttgtcattgcttgcagactggatgtgcattgcatcggaaaattaaagaagaacattctcatttattttaaagcctctaaaaccgtgtaagatcaagtttaataagaatggtactccctccatccaagaaaaactcaagttaggaggggttataggttagttttttttggacggatggagtagttgctatctgtaattttgttcattttgctagtcattaattaagagtctagatatgcgacaccctacactatccctaatacacttattccaatactaagaatttattttacttgttttctctccttttctcttggagctcgatcatgtgcaagctgcctcttctatgaggggcatcatatatacccggtctctctcctctctttcgtcttgacactattatgtacttgctctaatcatcaagccctttttcatcattttctacatatggcgccactgaatttctgcatatagtgcctttctaaataacaggtgaacttataggcctcacactgttttttgtaaaaaaaattgctacgtgacacttaaaatatatgatctttgctgctagacatctgaaaaaactaatacggctcgtggacacattagaaactgataatttgttaagggacactgttgtgattattttattattttcaga

SEQ ID NO: 8656 - DNA, 1501 bp, Oryza sativa; identical to SEQ ID NO: 7565

SEQ ID NO: 8657 - DNA, 1501 bp, Oryza sativa
tgaacgtcgagcggctagggcattgtcgggtatttatgtgttgagggaaagaaacctcagttgtttttttttttaatttctttttggctcaccctaatgcgcaagcgcaaggccaaggatgggggaattgtgtggttttgcctggttggtggccaaacccacctaccatcctcagacactacaggatgtacagcatttggaggcattttgtcgacggccgaccgtcgcccgctgcggcattgcccatcgatgcgccgtagcgccgcccggtgacctagctcgtgggagagactcgccgccgtcgagcgccctgcggcccgcccgccttctgcccatcgcggtgccaccatcgacatctgcactgaacactgtgacatctgcaggttcattcctctccatttacatcgtttaaatttacttcagttttttgcgcacttaaggtgtttgcagtattgcctaagcgaatttctgcatttgttcgtatattttggcactggtttgggtgcagattatttgtatatgagctacagacaacctaccatgttagtttagaattatatgaactccccaaatgccacagttacgaaagttgattcccactaaaatcctgctcccttcactctactggatctgcatctgctgttactgtgcgtcaatttgctactcagccctgcccctttcatgcaaatccaataggtgagcacatgaactaaaagttgtggctggaattaatttgtgatgtgtaatgtgacttttcatgagatggtcaatatggtttgagttatgagctgtagattacaaaatgttttattatttgcgtcaaaaaaaacaaaatgttttattggagaatgtccatgtatatgactaagtataccatattgaagcaagcattattgtttgcagggattgcagatttttttacccttaaggttaatctttaaagatactattaatttttagtctaagtttgctttagagtgtgaatcaccattcgatctctttaaattgaattgaacttgctagttgttctgttatgaatgatgaagctgcgtaggaactatattgagttccggtggttgtagggaaaaaatgtagtttgcgaagtgatgtgaaaatcattttgtttcttatacgattgtacctttcagcaatttgcaatttttaagtcagcttgtggtatggctgcaaaacagtgattcatgcacgaatcaaaacatttatttaaaaaaatcgagtactatgtgaatgcactgatatacttaaaaaattagcgcgccaagaggcgctcattatagcccgtgtctactttctaattggttttcaaaattcaggtctacaaaaggttggcaaatgaaatattcgatggtgttattaaccgatgcaacaagtttagctaaattagctcctatggcactcctgctaaaaatagtaactagtacccttcaagaacaaccatcaaaaactggatagaaccataactaaatatttttacatgaattca

SEQ ID NO: 8658 - DNA, 1501 bp, Oryza sativa
ctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtggtttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatctt

SEQ ID NO: 8659 - DNA, 1501 bp, Oryza sativa
cctaatataatgtcatttatattacatcctctttccataattttttataaaatcaaactagaagtgagaagctgaaaaatctattttttttaattctcatcagctgagcatccatcatttgtttatcagaatctcgagcttcccaaacaaaacgtagatgcacacaaattaattgctcatgcaacaatgttctcaacctggcttagcagtggatcgagcgttattacatattgtgtaatggatcgaatcgccccggccgatcacgctgtcaattgttcagttgtcacgttgatctagcgctggcctcgctctcctcgtggcaagttggcttcagtgcttgcgccttgggccatgaccaaacaaacattaaaaagaaccaatcctacttcttctattttaaaataaaccaatcccatcctagaatatgacatatcataatacaataaatatccatattcatggtactagtacgaggttgacttattttaggatggagagagtacgtacatacgtccgatatttggtacggcattggacactacaatccgtcgtactctgaagtctgaaccctgaaacggattgctgatcgagctgtagaggcactagagctggcaactaacccaatttggggtctatttggagagtttctagccgctgtagtttttttcagaatcaaaagttgtcccaaacggctcagattgtcatatagattatgagaatatgtagctatagaattcaaaaaataaattagaagctaaaagcttgaatttagaaacatcttctttaaattcttaattagaagctggcaaccaactagcagattcttatattattaagcttcctaaatagagccttggtttccattcgtggtccccattgtaacagtttgacatactcgaatgctcaactcatggccagcacaaggtcaaacctccgaagaacatacctctcgagtactatcacacatgcatatggtctggactagggacgaccataccagcattattgtttcaggacagatggagtacttcgtgtaatcccatgataccatccttattgtttcaggaggaactgacttgattgtttgctgcagtatccgtggtaagttaatgcacaataatgtcagctactgtggtccgagaacggatctacagccactgcttaagttataatcacattgccaactgtcctagtttaatactactaccttcgtttttttaaatagatgacattgttgattttttattatatgtttgacataattttatcactgatttgcaaatttttttaataagacaaatagtcgttcaaaattcaacggtgttatctattaaaaaacggagggactatcatggctcagttggagaggcgggagccggagctagcaattacccgaagcatgctattacctaggtaatagcggcatccaggggcgcgccataccgtcgcataaatgggcgcagcccccgcccctgtctcccttgattttacccatggctca

SEQ ID NO: 8660 - DNA, 1501 bp, Oryza sativa
acagcatgcagcatgtaccctaggagacgagagtctgaatcccacaaagacatgcatgtatccctgaattttgcataatatatagttcggattttataagtgtttaactcggatgacggacacaaatttagatgagtatgaaatcatcttcaacttttataatatataaagatttctatttttttaaactctagatcaatagatttatggcgagaaaatttatggttggttatttgtgttttgatttcgttgctgggagtatctatttattgctatgggatgaatcatgtacaatttggaaacgtataaacaaataccgacatggatgctaagtccatgcatgaatctaattatgattggtttgttatatctttacactgcttaggtgtttcacatggtttcgttgctgagaactattatctgtttcctacactatgaccatgcatggatatttatttctatatcacgtttccaaaaagtatcatgtccgtttgttttttcctttaatttttcatccgattgagaatccgggtcgccagtagattttttttcccggtccgatccgtgttttatacgtgtttaactcggatgacggatgaaaattaaggtgagtatggaatcatcttcaattttataataggtaaagacttgttatatgaacaaacgttgctacacaatgaatatcgtgtgttttcatttgtagaggtacttgtttgggtgaaggaaaagagatcgactgtaaggaacgcatggatgatcaaaaaagttgattgggtaccaaaccaagaccttctccaagtctactcctacctcaccatgtcacttttggtccatagaaggcaatagataaacttctatacattttggattcggattcggacctcctaatagcattgacttcaaacagacctagccgctaatctagaaggaatctcggggcccatgagtacttgctggaaagcttatgttgtctactttcagatggttttggtcccacgttaaaatttccaccaagctgtcgggaatctgtaaaacaagccacgtactttatcctatccgaatctgatttgggtcttaggctttgtaattgtattgtgggctaagcccaagggggtgtgcgccctagggcaaccctaggacgtccctaatcatgtatattcagtagttgttattgtttagagtcgggttttgcttagattatttctgccattgcagttttgccgctagatcggtttgtggaaccccaaattcgagtgcttaatcatttatatgcaattgtgttgcaatctatcttgttcttgcttgtatttgtcgattcgcatgcagggattagcctccttggcgaggtcaactgggcagtgcacgtttgataaccagaggagacgtggtgctgcaattgtagggttcggatcgtgtgtgtgaaatttccaccaaatcgagagttatcaataccttttggaagatcgggacctattttcctcatcatcgggccggtgcaagg

SEQ ID NO: 8661 - DNA, 1501 bp, Oryza sativa
gtgagaggtattgctacatctccaagattccaactgtgccttgtgaatgaaactgtgcccgcaattttctcgtgtatatttaatagatttggtagtacatagcacataacataacaatagaatctaatacggggctctggtcaggttgtggggccccggaggggtcagggacgagcgttgtttttgacccgcatccatgatcagggcaggagtgaagttgggggtcggggtctggagcgttccagcccaacccggtccgccccgccccgttgccatccatacctatgcctatctaacaccctagaattcaattccccttttctttattgtttgaaaaaactaattttcctcggtgcagctgcaaggcatctgaccattgtctcgacacatacccatagtcaaggccttgccttggaatgtggacccttaatcagaacatgaaaatacatattttttctatataaatgctactctcgtatagtaaatttatttttcacccatctcattcgttattactctatcaaatctcttgcctactttaattacttctaatacatttattactttcataaatattgatgtaatgattctttaaaagaaacttattttataataaatgaaagaagttaaaaataaacttgcttttaacaaaggaagtagccctgtctcaaaataaatttatttttaatctttataattcgtcataaacaaattttattttttaatacttcttaccaagtataagatgcattttgatcataatcacaggagcacaggttcaaggcagcgttcctggcccgggaacgtccaccacgtccggagaacgaaagaacattttcatccagactttttaaaaacttcacgcaaaaaagcatacaacgtttctcaaccccgttccttgatgagaaacctcgttccttgatctcatcagaaaccatagtttttcaatcatcttaatttgggcttcaatagctaaagataaattatttcaggaaagatactacacaatattatttgtcttatcaatcatctttcatttaattcttttcatcttaatccaaacgactctctcacattaaccatctcacatttaatatgaggtatcaaggtctttttttttgctctattaaagaatctaaaagtgtttatgttttgtaacgaagagagtagtaaataggtttattaatagcaatacatagtatattctcctttagataggttaaagtacaacatataaaaaaagagagtagaagcagtaatttttcaaaaaaaggccgttcgtgtgccaaaatctttttaagtatacggatacacatttgaagtattaaacgtagactaataacaaaataaattacagattccgcctgtaaactgcaatacgaatttattaagtctaattaatctgtcattagcaaatatttaatgtagcgtctcattgtcaaatcatgatgtaattaagcttaaaagattcgtctcgtaatttacatgcaaactgtacaat

SEQ ID NO: 8662 - DNA, 1501 bp, Oryza sativa
atgcacatcatctgtatctacactacttaaaggctgtagtgcccctatgtatcacatatttctattttattcctgtagaagcattggggattgtttgacttagagttttatatcacttctttcattggatatagctagtctacacatatttgctatgttgactagtgaggttcctagccctagagaccctgaacttgttgagcgtcttattcttgatttgctagatccagaactcaaacgacatgctccttccgagctacgcaaggtaatttatatcttttctgggaattgtctattacatcattccttttatttgaagaagtggtatgggctccaagttgcgtaaaacttgatttactaaaatactaatgagttgttttccaccaaatacaagtgatatgaataaatgacagttgaaaagagatgatgcacctttttgcatttcattatttattattgcagatttgtgcatgaaaggaattatctaatgatgctatatgagatatattctccaacatatataactattagtttctccctcaatttttaaataaatatgtataaaataaaataaaatttgtcgataatatgcaatatttaagtaaatttttggacaatatgtgacatggcatgcattgatgtgacaatattactgcaaatgccaattaacctaaccaatacaatagtaaggcccctttgctaggtttggatatttttcataaagattattagactactacatagtgtcaggcattctaactacaagaattgtggttgagacaataaattgcctaagggaacaggaggagtgtgtgggagagggggggagggtggagggaggaggagggtgagtgttcgaagttcacatgattcatgtttccactggccgctataaataaaacagggagaggggtaggagttgggaattactctagtagcttctacatacatgcagaggtggaatggcttttggaaaaccgaccaaaagttgtttttcttgggttttggcatttgcacgtgtaaaagatgctaggttgagaaaaagtgtacacaactcagaagatctacgtagaatagacttaactgcagtatagacaattatgtaaagtaaaccaaaatacatccaaaatcttattggaacagactttattcacattgcaaagtcccttgttcttacataaagacaaagctatctatgataaaaaggcatgtgcattacatacatacttctaaaaggtacaaactaaacaaaagaaaagcataaggaaaggggaactttcccatggaagtgccaaaagagaatgaaccatactaaggaggatctcagtatcaaactagtagagaagaaataagcaaataggttgattccaacatgacatagagattgaatgttgagggtgtgcacgcacatctcccaccaagcgtgctaagcttcatgccttcccttaaagagcaagactataaggaagtaatgttacatgttaccaatgaagctaagacc

SEQ ID NO: 8663 - DNA, 1501 bp, Oryza sativa
tcttcttcctcttctgacatggcatctttgtacaggttggatccttcatcatgtccacgcatatcaaaaccaacctaaatctactttagagggtagtgtttggtattgatagttgtggggcaaggggtgttatagctggttttgtaattaggggtgtgttttagataaagacaagaagggtaaaatagacttatttatcccaaaatatatatggaatcataggtatgatatgtataggtattacttttattttgcgaggtatagtaatattacataataatgagtgacatcattgaggttgggaggaagataattaacaaattaccccatcaacatatttcagtttagacatatccatgatctttaccttgtaagaaatgggtcctagtctccgaatgtgaagcaatacactgcgcaatgcaaataaattaaataaaatatgattatcatagtatttggtagatgagaaaaggtagcaatataagtgtacctgaagaagtgctagtgcattgcaaactcggtttgaagcacctaatgacaaagttgggggtgaaagtgcagggtagactactataatctcctgtttgtttgtcagtaataagaaaaagtgatgagtgtttgttataccacacataaataaaagtaagctcagacatcaacaagttgaattagcacagttattgatatgatcatcaactcaacttgtgctaatgttgaattactaagagtggctgacatcaaaaccacctttttggagaagacctcaacaaaaaaaaagatcacgtaaatagtacaacacaacaaaaattactaattacttgtgggatcaagcatgatcatacctggagcagtgaagcaactatgccaaaagaattccacaacagcagagccaggttttgaaacatctctcttttctgaaaaatagtttcaagaagctgcattattcttaggtttttctttccatgatgctgtaatgtgtcaattgcataatatgcaatttaccattacttattcaattaagaacaattacaaaaataatcaacctggcaaatagaaattaattaatatctcaaggtaagaagatctatcaaccctttgagacctcaaggtgtgctttctcacatagattagtattagaaaggttgaggacaagtttctctgctaatgcgatgtgtactgatccttcgctcactaccaggtgacacccaatgtcagagcaagaaagatttttgagccaggcaaacatcactactactatcatttgctacggaggaaaataaagtgtttttttttctgtttcatatagatgtatgcttttataaatatctaggtcttagcttcattggtaacatgtaacattacttccttatagtcttgctctttaagggaaggcatgaagcttagcacgcttggtgggagatgtgcgtgcacaccctcaacattcaatctctatgtcatgttggaatcaacctatttgcttatttcttctctactagtttga

SEQ ID NO: 8664 - DNA, 1501 bp, Oryza sativa
gaaaatttttaaatctgtgttcaaatctagacttgagagttttcaaatcttagttgaaaagtttccaaatctgaaataaatctgagttgaaagtttgtttcagtcaactaaacaaaataaaaaacagatggtggcaaatctatctatctatgtattatattattaaaacagctttgaaaggaggcaccacgttcgctgtgggggctagaaattcctatattaattggtgaaaaagaaaaggagagtccaagtagaaatacacttcaaaaatagctgaaattcggaattaaaaataagcaatattaaaagaagtgtccatgtaagaacccaatacgggattaatcgaaattcaaaataaaaataaaataaaatccgaaattagaaaataaaaggagagtccaagtagtaatataatttaaaaattaccgaaatttgtaattaaaaataaggaatattgagagaagagtccatataagaacccaatatgagattagttaatattcggaataaaaataaaaataagatctgaaattagcaaaaagaaacgaagagttcaagtaggaatataatttaaaatcaactgaaattcgggatttaaaataagcaatattgaaagtccatataagaacccaatatataagaacccaatacgacattaattaaaattcataataaaaaataaaataatatccaaaattggaaaaactaaaagagatttcaaataggaatacaattttgaaacaactggacttcaaaaaataaaaaataaaaatattaaaagaacactatacggtattaattaaaatttgaaaaaaaataaattctgaaattaaaaaagaaaaaaaatacttcaattaggaataaaatttataaataacaaaaaatgatgataaaaataaagactattgaaaaaaagaccatctaaaatccatgacgagataaattaagtaacatgcctataaaagagtagagtggcggaggttgatacgacatataaaaactgttagtaaagcaccaaatcgaatcctaatgatgattaaaagaagggacggtaggcagatcgtgaagcaaatgggtaaagcagttgccaggacttctgaaagtaaaaaaaaataaaccccattgataatcatattcgatttttaaaattttaatgacaataaaaatgagaaacagcgtgcgacgtgtataggagtacagttgcagagccgccgacggttggtgggacttctagaaaataaaaaatgaattccaatgattgttatgttcgatttttagaatcccaatgacaatgaaaaataggcggtagatgggctgtagagaagtatagtggcatcgtttgacgggacttctaaaaattataaaaaatgaaacccaacgagacaataaactctaaaaactacaaggtcactctaaaaactacaaggtccaacctttaaaggttcggaacttctaaaaagtaaaaaaccaatgataatcatgttcgattttaaaatctcaa

SEQ ID NO: 8665 - DNA, 1501 bp, Oryza sativa
aattttgctagcgccgccgctaaagcctctcctccgcatgcgcgccgcctggatcagcgccctcctctccggctagccacctcctttctcgccgcattcttccctggctggcgacttcctcccctgccggccacctccccacccggtggcctcctccctggcgccctcctgaactactggccacctccctgcagggcagcctcctccctggcggctggcgccctccctctcggctgccagcccgcccgacgccctcctccccagtaaaccacctccacgtccggcacccttctcctcggccggcaatagtcgatggtagtttttttttctttttgcaatggatttgtcgatgcaattagataaggcttgttctttgtggagatttagcttgtcggggagataaattggatgtatgtatttagaaatatttggttggagccaattttttggtctttccaaagataagcatgtgaacatttctattcagttcagatattagtagggaaattatataagataggtggttaattgtgcccgaactgatcgtgtgaatgaattggtgagaaagaatctggtggtgggcactttgttgtattttagtgatcataataaaaatcgataatatcacaactcagcagagaatcagtactataactgaaattggcaggggtgatgcttggatcgagctaatatggttttgggcaaagctcctcccctttctattactgaaaaaaatggatagttcttgatgtagatgtactctgtaaatgaatagttcttgatgtactctgtaaattttggctgcgaatcgatgcttttatcactcttttatcgctactaaaattttacatttccatgtatcggctgcttgcagaatgacaagatgaaacccatgacagtgccatactaattgatatcatctgcattgtcaaactttttaacttttttagcatggtgtaactgcctatttgtgtgcattgaaatctctagactacttacattgcaccttttctgcaacagtgcatatgcatgactttaagatactgtgtcagctgaaatcttgtgatcgtattctagaggatatgggtgtattgctgtttaatttcctgagctacacaattttatttgtaccgatgttagttatatgcaggttcttcgagcagactgttacaaaaagtaaaaaaataagctgctttggggtgctatatggttttctttttaatgcaactttgtagagctctagcataacctgttctaaattctaatgattggaaaattttgctaccattatgcattctaccaacatatattagctagtatctaccatttttcctaagattgattggagaagttgtcaatttatctacttattgcagtgactagattgtgatggcaagtgaaagtgattcctttgtgcgcatgatgtctgaagagacccatgttgaagcatattccttgccaatgcaaaatgaagaccttcatacttcaacaaatggtgcaa

SEQ ID NO: 8666 - DNA, 1501 bp, Oryza sativa
taaattaatctagaatatataaagctagaagttctcacaacattttacgatttttaaaatttcctcgttaattggagggggaaaaaatctttaccatccaaatctactagacagcagagtcgcgcgttcgtatgagtataacctctcgtatctaataaatgttataacatgttattatatattgtaaataggttcttgaggaacagatttggtaggaagtgtagtaacattcttttatttatcatgatgacaaataattaacatgccaagcgtattaaatttattgtaaatataatattagaaggttctcagctatgtactcctattagcatgtattatatttgaagtatcagtccaaataacttttgaacacttaaataagtattaatttctgaatatttggataaccttgttttgaattatatacttttgttttagtcattcgtaactcaatcccccctttctcttgttcgttcatctttgatttctccatctgcacccgcgcttcctcctccatcccaactcaaacccgcgctatcatctcttcctccctaacaacggtggtgtggtaggtggacatgaaaaataatttattacctatttgaaaaatgagatgggagacataaaatcttatacatagagaagagagagtaatcacatggaaaaaagtgactaaaattaaaagaatatagtgtcataattcttgcaaacccctttttttccagcttaactctgaaatttttatcgatgatattccttttctggttaaagttatccatgacttgtttttttattcccacatgccttctcgagatcttctaagggcatccacaatgtataaaaaaccaggtaataaacatgaaaaagacccctactacctagtaagaagcattgtggaagtgataaacaacaacaacaaccaggtcatagtgctattgccggtaataagaaataaactataattttgatacagtactatagggtcacatgtgttagatttaattgggtaattgatccatttaaatcaattaaatcaaataaattctaaggctcattatgctaggaattcatgtgtattcattcttttatgggatatcaatgggatgaatagttttgagaattaatccatttgattagggaattagggaattggtaacttatatcaattagtcctaattgatggatggttgatggttgtgtagtggaggatggttcatggctagttgatgacaattagttgctctattactcttcctattctgttggtaacttacatcaattactcctaattgattgttggttgatggttgtgtagtggaggatggttgatggctaattgatgagaattagttactctattcctcttcctattccatgactcttactcttcatcttccattcctcttataaaatgataatggatttgatctcccgcgagagaagagagacacactttcatccattttccaatgctattgctgctacggtaatcccatcccaa

SEQ ID NO: 8667 - DNA, 1501 bp, Oryza sativa
aaataagtgcagttttagcattgttcatgtctaacgtttgaccgttcgtcttatttgaaaaaaaattatgattagtatttttattgttattagatgataaaacatgaatagtattttatgtgtgactattttttaaatattttttataatttttttaaataagatggatgattaaaacgctcagcacgtatatttatggctgcacttattttaggacaggatagtacatacaaatctgcgttcagccccaggaactttcctaatcctaaccttctaaccaaccagaagattaccgctagtcaaacagacatcttcccccaagtattcctctctctctctctccttttcttttcttctttttaattttcattcaggggcaaaccaaaccaaaccaagcgagagagacaacagcacaggacagcgcagggtggactcgaggtggaccccacctgccagtgaccgccgacctccctctctcctctcgactctttcaagctgcgagacgagaggagagcagatcgcttacttagccagagagagagagaggagagagagggaggagaggttctcgcggcggcgaatgattggggcgcatgtgtgggacaaccagatcctagctgctcatcgcgatacaaatcccatccccgtctcccccccaattccatcgctgtcctccaatctctcctctctcccaatcatcgtctcatctgcgcgccgtctctccccccgattcggcttcgtccccgccgccgtactgcgccgccgccggtgccgacctgctgctgctgcgggggagatctgtccgggtgtgcggctgattcgctttccgtcggtacgatttctcaagcttttgtttggggggggggggggggtggggcggttcgatttgctgtgtgcgcgtaggtagaggctgcgacgacgcggtcaatttcaaatctagctcgcgggaccgcgtccaatttcgtgcgggggcggctgctgggttgcggtagattagtgatttagtggtcgcgtttcgcgttcccgagaatggtcggcgattgtcgacttggggggagagattcatcggtccgcatctcgaatgagcttgttgtagcgggttgtctactagtaacgattagttcaaattttagggagctgtttctattgtgtttgaattttgaaccaacttatgctatttgggaagcactgatttgttgttatcttgcttcgttgtgactgtggtttgtgaatcgacagctgcagctctacaggtttcttcggcagcaactgtagtagaaaagaaagaggggaagattcgcagttcatatggcaaaacctgctaatagcattggccgtaggtaggtttgatactgcagctactgtttattcttaactgtttcttttccgtttctagcgctgattgataatttatctgttgcccacttgtctagtaacaccaaccaagtgttctttttctttctacggtgctcatggttgcacattgtaatttaattgtgaa

SEQ ID NO: 8668 - DNA, 922 bp, Oryza sativa
tttaatatatttttataatgccgattttctggaaattgtatttctatatagactctatgctcttgtgccaatattatttatttttatttttgaattttattattctaattgaatttcaacgtgggctctactcatctttcaatattctttaatttttaatttcgaatttcagttacttctaaattgtattcctatattgactttaaactcttattcccatgtttttcttaattttgaattttagttatttgtaaatgatatttttatacggactctaaactctacttttaattttattatgtttattccaaattttagttagttttaaattccaatatggactctatactctacttccaatattccttattttttaatttcgaattttttttcttaattgtatttctatatggaatctataatctacttcaaatattccttatttttaattttaaatttctattatttcctaattgtatttatatatggactctatactctacttctaatatcccttatttttaatttcaaatttcagttattttctaattgtatttctatatggactatatactctacttctagtattccttttttttaattccgaatttcaactatttctaaattgtatttctatatggactctagtctcctcttctaatattccttattttttaattacgaatttcaactatttctaaattgtatttctatatgcactctgccttttctttttctccgattaatgtgagaatttctaggccatgagagcgaacgtggaggctcttttttctatttctttaataatataatagattcttcatgtcagcgaaaaccgaacacaatactgttttaggacctaaggaccctaaggtgctttggttttgcaagtcgaggaacacgtatctagtattgcgattca

SEQ ID NO: 8669 - DNA, 1501 bp, Oryza sativa
gtgactaatttttttaatattttttataaatttttcaaataagacggatagtaaaaacgctaaatacggatatttatagatacacttattttagaacggaagtaagtactaaaattgcacgtatcgaattcaaaccgaacctctgatcgcatcgaagcttccattgccacgttgtgtctttggactgcagagacgtgctcctacgcggctcttggggctggaacccgcgccgccggtttcgagcgtcgtcgggcgggcgttcgctcaccgcggctccgtcgccaccggcggcgcgcggcactcgcgcgcgtttgcccaactgaatcaactgaagtgatgagttttctattccaaaatactatatgacgtggtagattttcctacagcgtttaattatttatcttattaaatattatttattttgttatcacttgtagcacaatattattttatgattttgaaatgaaggtacgtacggcatcgagtagtttcttcaaatttccttgtcgaggctgatggataggtttgctgcctgccaagatttaaacaagcaagcaggaatcccgttttctaacaaaaaaagcgagattggtagtatttctatattttactaccagttggcgcaccacgcaggatgaaaatatttgtaaaaggcgacggcccgctccagcggtccagccatgatagcaactcctctactgcacagtagtgcgatgaaactgatgatgatttgtgtgtactaattccactgaaactttcaaggctagcagtaacaacaactgtaaaaccaatcagcaacccaatccaaccttcctccgtccgaccagggcatgtaaaattctgtcacgaactgtgtaccggatgccacgtcacacagttgtctctgactctgtgactcacgcgccgccatctagaaggataacaggagcacgagagtgagtggtgggcgcgcgcgcgcacacaggtctttctcaattctcccctttcctacgcagttttcgcccaccgccgccgacgcccctcccgtcccgtctcctcttctcttcttccgcacccaccgttgttttgaccctgttttcacaaaacaaaaattttttcactcatcacattaaatgtttagacatatacatagaatattaaatgtgaaaaaaaatcaattacataatttacgtgtaaattacgaaacgaatcttttaagcttaattgcgtcatgatttgacaatgtgacgttacaataaacatttgctaataacatattaattaggtttaataaattcatctcgcagttacctggcagaatctatgatttattttgttattaaactacgtttaatattttaaatgtgtatccgtatatccgatgtaacacaaaatccaaattttttccccatccataaacaaggccattgtataagaggcagccctaccctccaccggtgagagctccacgtctccaaccaaattccatcgtcttcaacccaacccaacccaaacaccacca

SEQ ID NO: 8670 - DNA, 1501 bp, Oryza sativa
ctaacgcatgcgagagcttctagagctgcttattcgagaacaaaagaacctagtggggctatattctgccaaaaagacgggctttccataaacacgggaaaattggcataaaggcatccaagctgtgaacaatactaaaagctgcaactcgtctgctattccgatcttcctctgattcaagtgctaccagttccttcttcaactccaggccaggcaagagccgagaagctatccgtcaaagaaaaagaatatgttcaacccaacaagcaacggattgagccactagcgcaggctgtagtttgatagcgagttcaccttcctagtaacgtttactcatttcattcattctcattcaaatctacttctaaggcatgtgaagtaccagttgtagacagattccttggcttgcgtagagaaatgtgaaattcatttctaaaagcaagagtttcttttctttaattagattataaatctgcgtaggataggtgagatgaatgaaaaggtcctcttgtccgtcgatccgaagaactcactcgattccccatgatgatatgcgtcaacgtaaggaagttgttaaactacacgtgccttcaacacccatctcgggccgggtgagaaagaagcaccaatagcttaatgcaattgctatcatgcttggagcatagatagaagaggtatgggtataggtaaaatgcacacttctaccaggtatgtgagactctttctaagtaagagagagctcgttctagctttgtcaatcgtggaatgagcagctccatccttactgtcctggtgaattaattgggtaattaatgagcacactgactcacaaagtctatagctagtctctacgaatatctcgatgcaactattaccaatagttggaggaaacttcgtgcttgaatgtattagtggaagttagtagcttgaagaatggaaagagtcttttcgtccctctcaaagagggaggggagtagttcacagctactgtctcaaataatctagtagggaatggagtgaacagcagggagtttagtgggttgttttgctataatgagtgcgtacttccagagtgaaggaatgaacaacaagcacaaccccagctactgatttcttataagcatcccccgacccagcgagtgatttgtaaagtgctttttcccctgtctcctaggatacccggctggcttgatttggttggtggaattgtttcaggcaaaggaaggattctatatgtacagggaagcgcggtaccatacttaagtgggtgaccttgcttgggaattgcactcagaggaattctgcccgctagttcgctttcattgaacgaaatcaagtctaaatgcactcagaggtatcgaaattattcattgaataatgaattaactaattcatttccttttgacttttgttggatttttggatatttttttggtgttgatttggcattattcaacaagaataaaagaaaaatttctataaattcctttttttttaatta

SEQ ID NO: 8671 - DNA, 893 bp, Oryza sativa
gtagacatctggtgctaattctcgacaaacttcacaccagtctgcataaaattcaactacagtgggcttgccatttgagagagcctgcatatatattatcaggttacattcataggcatgtaaagaaaatgtcttcacaggaaatgcagcaaatccttttttgggaatacccaaggagcgcatcattgtattaagaagaagtaaaatttatgtacaaagcggaccaaacaaaggaaatgcagcaaatccagataccaatttgaagcaaaaacatggaaggtttatttgtcattcaagctattcaccttagcacaggaagaaaatataaatattgcttaaccaattgacaagtcatacaagtgaaagttttcacatgtaaaggcatcggacctattgattggaaatgaatgcatcatcaatctgtgacaactgcccaaagaaagacagcatcttgcgaccaatggaaaaatataatacatttacagaagaaaacatatttcagattaatatccaaaacaacatcttgtctgaaatgattggatgtttcatttagcttgcctagtggcagaacatcgtcttgacgcacataaaaaaatgtcaactcgcatattcatcttccttcgtgaacgtaaaaggttctgatcagtctgcccccaaaaaaggtactataatgggtgatgcttagagatttttaagtacataagagattttgctccccttttcttgttggtggattgcggttagcatttagaaattccacgttgtttgcttctgtttttccagtaatgggtaagtgtataagtctcataggagaaaggctgcaaacctcttcatacggtgtagcatttgctgcaagatctttgagagaaacgcctccaaagtcgagtctttga

SEQ ID NO: 8672 - DNA, 1501 bp, Oryza sativa
aaaaaagctaaccttttcctagttttgcaagctgcagaatacaaagaagccgggagggattaaaattttcagacctgtggatgcaaaaaaggtacagtgattagtgtatactactactactccatttatccagcaaagaaccaagggaaaagttgtgcgtggcattttcacgagatgtcacagtcaacggcctttttgcaggcgccctaaacactagtgtgcgtcactggttgtggctgtgctgtatataacgcagagtgcggggtttctgcagagctggagtggagaaaggagagacctttccattccctctctgaaaaaacaacaatttagtttttgacctgaagggtggtagtagtgggctagttggcggtagatggcattgacactggttgccaagcacagtgcaggttttgttggagcctagtgtggcttcagagctcagaagcagccacatttctgcattcttggatcatttggagctctccttgtttgttgttgggtctcttctctttcctgcttccgagttctgtgaaccagccaactaatctctgtaagttctactatcttgttcttatttctcctgctcctttgcccccaaggatatggctactactgcttgatgtcctgttgcttagagtgttcttggctggttgctttcagttcttgattggttcataccttggtgccaagaaatggaggtggaggcgatggagaagaagggacacagagcctttgctaaggcaattaagtctttcggttcttcagaaaggcacaagcgttctaagaggtttgtgtctttggatttcttatgcaaagttctctgtttctgttgttacgaatgctaataacgagatctagatgtttttctatggcagtgatcttgaggatatgtgtgctaaagatgcgctgtatgcttcagataaaacatgcgttcagcctaagccagtgagtttattttctgttctctgttctctgttctgtcttccacgtttttctactgtattctgcagtaaatgcataatagttctgcatagtttcagtaattttgagcattctgtgttctggtttactcaggatgctgtaaaagttaaggtaaaaagtgatatcaacgctgaagtgcaacctgggagaggagcgcagagcttcttgagaaaagaggtaatgagtgtaaaattctatttttcttcattgattttatcgccaacctgccctttctggacttaaaaatcttttttagtaggaaaagaaaagaatcacatttcaattacagacaggaggttgcatttcctttttgtatctccatgcttgccaaatgacactttttttttaaattttcgtttttggccgaacaatgcaaatccttaaacagaccaggtttttttttgtttgttttacaaacaaagcatgattttcccagtgaaaaataatcctggtaaaaatttctctgcaaatggtctaggataatgtcacttttctgctgaattcaacatagtttaga

SEQ ID NO: 8673 - DNA, 1501 bp, Oryza sativa
atatctatatcatcaaattagttaaataaaaattaaatatatattttggcattatatattttttaaagtattataatttttctataaacttagttaaaattaatgaagtttaatatagaaaaatatcaaaacgttttactccataatataaaactagatgaggaggagtctgtccgctccatgtcacattagtgcgttagtgggtaaccacagcctcttcgagaaaaccagaaacgaaacaaacaacccgccgaaccaatattaaccaagaacaaaaataaattgagatgtttagttgacaccaaaattaaaagtttggttgaaattgaaacgatgtgacggaaaagttaaaaatttatttatgtaggaaagttttaatgtgatgaaaaagttaaaagtttgaagaattattttggaactaaacacgggcgtgaatcacatccaccaacaaaaaaatcagaagaaaaattgtaaataagcatactttactaggaaaaaaaaactaaagcataataaagcatagagtggaataagattatgttgtaacacaccgacagctagcaatcttctctgcaacggggataaacaacctttttctttccttgatgtgtacacctaaatttacaaagttcacccccttgctaagagttataaatcttatcgataacttactcataactaaatgtccctatgataacatctcccacaaaaatctacaagactaaaatacaaacacagaaagaattaagaaaaaaggagcagcctagcaatgtcagtgggcatatggacaagcacagcagccatcaatgaaaacaggcagcggaactttcatcacagttgagcgtaacatccctgaatgtctcactctttctagcacttcatacaggctaactgttttgctgaattaacagatttagctggcagatcttgaccgatttgttatctccataaaggccaatttggcggcagaatagtcgccactcgcccaccgtcaaattcttgacttatttggaacagtgtgaagaaaagaaaagaatcattcaaggttggtttggtttgtggcctaaataggccttaccaatcattcaaggttggtttggtttgtggcctaaataggccttaccaatcattcaaggttggtttggtttgtggcctaaataggccttaccaaattttgtcagtgccaaattttggcaagttttggtatgactaattttggtaaggtaaagttgtgtttggattgaagccaaaatagcctaagttcactattgaaatggccaattttcttaggcatgccaaaatttggcttcaaaccaaatagacactatacactattaaaattgccaaatattggtaagcctaatttaggcctcaaaccaaaccagccctcaatccatctgtagaaactataccttttgagataaaatccattgtacttccaaaatctgatttcaagccaaacagattctatagtaccacatgcactgtatgtatttagata

SEQ ID NO: 8674 - DNA, 1501 bp, Oryza sativa
gtctatgttacatgtggatgacaagtcaagaaatcgtagggatccaaattgtcctggaacgtttggaaactggccatagagtttggtcgacccaaggttaaggtacttgagtccttgtgcattccagaaccaacaggatgcaattggatggttgaaatagttgacagagagatcaagctcctcaagattggtcaggttaaagtgtgaaaaagattgatccgcataaacaaggttgcagtaagcaagatgaaggaccttgagagaaggaatgttgttcatcacatcggcccaatcatgtaccatgctgaggctcgtatggctcatgtcgaggtgcgttagagaatgcaggcgcgctaaccattggatatccgtgaagttgatgcctgtatctgacaggccaagatagtgtagatttgtgaggttacccagctggggaggcacctcaccggaaaatggtatgccggagaggttaagatatctcaagttttgcagagagcccaagaactccggaacacggccggtctgtccctggagctggttcttgctgagatcgatgtgctccagatacgtcaagttgagcagagagggacttatctcgccggccaggtcgtacccggaggtgatgaagtcgtagtcgttgctctggtcggcatacacgttgcggaggtgaagcccgacgacatggccgccggcgccgcaccggacgcctcgccaccggcagcaatcggcctcctcctccgcctgcccaggcccagcgccgtcgtacttccatgagtcgaggagacccattatatcttcggtgatgcctgccttgaacgtcagcagcgcgtcccgctcccgcggcgagcagccggccgccgtcgccacgttgccgtgggcgggcgccggacggcgtgtggcgccgcgtggcagcgcggccaccgccgcctccacttcatggttggtcgtggccaaggcggcgacggcgaggacgctgaggatcaggagagcggcggtggtagtgggacgcatggtggattggtggactagtaagaaccgggggggtctgtatctgagtgtgcgagtgtatcgtatacgtatcgttgttgtttttactgtagtcgacgggtgcgtgtgtgccgtgccgtgccgtggccgccgggacgcgcgtgggcgtggccatgtatacgctgcaaacaacagtagcgacgggccgtacagggacagcttccgttggcccattgtagtgagggcagaacgtcactgcctggatcgtgcggcccattagtatggcctaccagaatctggatctccaccaattagaaccagccacggaagtcgcgcattcgcggaattttttttatttttaattttttttattaaaagttttacaaaaataatttttcatttttgaaaattgacagaagtggtcgcctaccgccctctgggagggtgatttttaaaaatcgccatcccagagggcggcgaaagtgacgtggcagatggccgttcgctctcaggc

SEQ ID NO: 8675 - DNA, 1501 bp, Oryza sativa
cgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaacttaataacattactatttttacagggcaatccaaggatgtgtggatttactcgatggatcgacaatgtcactccatcatatcatggacagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaaatttgtacggtaacattccaaataggccctaaaaaataataaaattatattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggtcgcctgcaaatttcgttgacggccgtcgcctgagagcgaacggccatctgccacgtcactttcgccgccctctgggatggcgatttttaaaaatcaccctcccagagggcggtaggcgaccacttctgtcaattttcaaaaatgaaaaattatttttgtaaaacttttaataaaaaaaattaaaaataaaaaaaattccgcgaatgcgcgacttccgtggctggttctaattggtggagatccagattctggtaggccatactaatgggccgcacgatccaggcagtgacgttctgccctcactacaatgggccaacggaagctgtccctgtacggcccgtcgctactgttgtttgcagcgtatacatggccacgcccacgcgcgtcccggcggccacggcacggcacggcacacacgcacccgtcgactacagtaaaaacaacaacgatacgtatacgatacactcgcacactcagatacagacccccccggttcttactagtccaccaatccacca

SEQ ID NO: 8676 - DNA, 1501 bp, Oryza sativa
cgcgtagctccaccatcttcttggcgatggaggagatgaagaggaggtcggaggagcgagggatggcgacggcgggggaaggcctcgagtgggggatgctcatcgcctttggccccggactcaccttggagaccatgctgctccgtgcagtgccacgtaacagctagctatacatacgccaacatgtgatatcgatcgaccggtaacacgaataaattaagcagggcaatctacaagttatattttccagtgcgtacatgttatattttccagtgtgtgacaccagtaaaaataagtctacatgttatatttttccagtataagtgcgaatattatgttaattgcttcttgattgttactccacggttaatttagttggtttcggaaccagctgagtatggaataatgttatacgtgatcaattataagctcttactcgatcatctggtcggacgacaaacatttctagcatgatccatattatgattggttcgtccctagttggaaaatgtggttctgttaataatgttctgaagctttgttttttattatccatattcggtacatcactagaaaaagaataataactgaaaatgaagtaagattactccactggtggagaaaccatctttcgtcggtcggccgatttccacaatagtcccggatgcaataaaaaccggggctaaaaatgatctttagtcccggttcaaaagggtagcgggcatatttgatctttagtcccggtttgtgttaccaaccgggactaaagatcatctttagtcccggttcgaatgctgtcagggcctgtcaggcccccccgggatctttagtcccggtttgtaacaccaaccgggactaaagatcgtaactttagtcccggttggtattaggactaaagatcccggtgatctttagccccggttggtgctaccaactgggactaaagtcccacccctatatatgtgtcttcttcctcctccagctgcccgagcaagcttcaaaatttctttaaaaaagaggggaggtcatgccaaaatttctattgaatttattttggtgattacatacaaatcggaggtgcttaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaagacacattaaaattagtttaaaactttacaaatagtttttaagaattatttggtgtaatattttatgatttttgtatgaataaagatatcttataattattatatgactgtcattattgtaagaataattatttgtgtacggttttttttactcatgtaga

SEQ ID NO: 8677 - DNA, 1501 bp, Oryza sativa
cccaatcaacatcaccaatctgacaaatctacaggacctggatctatcacaaaataagttccatggaagactgccaaattggattggagacctcccaaaagtacaacgtatattcctaaacaataattcattctctgggcatatcccaatcaacatcagcaatcttataaaacttactcagttgaatctagcatacaataatatttcaggcattttgccttgacagttcacattttaagaggcgacgaaggttaagcatcatgctatatataccctagataccccatgaaagattaatacagtttgtcggccagcattatcatttagctatacctgtctgctacgttaagtgcatagaaaagttagattactatactgcctacttcctccgtcccaaaaaaaatgaatatagcattagatgtgacatagtctagtacaacgaatttagacagatgtataattaaattcataatattaggatatgtcatatccagtactagattgattttttattggacggagggagtatggacttgggtttgtgctagcatttgcttttgtcctttatattgttcttttttgtgagtctagatatgccgtttcctctgtaaactaataagtgtttcttaattaattattgtattgcatctacaacttctgttttcacctatcatggaagctaaattaagactattactcttgggcacctggcagggggcaccgtattttatccctctttcacggcaccaacaactgattaaaccaaaaagattatttttccaacttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcatgtgctaatggactgcttcgttttccgtaccggagggatgggttcccaactcaaccaaaagaacagagccttaaacaaatgaacataccaaagcagtcaattgtggaggactcgttattcatgtcgagagatttttctggctctggctgaattcgctctgttcgcacggtccagctcttcacggagctgcccggtctctgaccgaattaatgtgctagtcaactcaacccaacggcatcgacatagtaccattcaattcggtgcatgcatacatgcatcatttcgtgctagacgccgttgctgtcggtacgtcactcacacggttgggccagaaaattaaattaaaccccattaattacagcattaagggcgaaatgcaggtagttatactccacagtccactagtcgtacgcaagaacgggtcttttaaaatgagcttaatttaaggccggtttgccgtgcgcgcacacacacacaatccatacgtgctcactgctctcctccaatcactcaaacacacatagtaagcctgtgcaccccatg

SEQ ID NO: 8678 - DNA, 748 bp, Oryza sativa
ggggggggcaaacattattctttctgctatgcacaagagacaatccaacatcttttctttgagtgtcatgtcgctcagtttgtttggagatgtgtgttttttgcttttaatatcccctaccccgtaacgccaaaaacattttcggtaattggcttagagaggtatctaggtccattaagaagatgattctaattggagctagtgttgtatgttggtcaatttggcgttgtcgtaatgataaagtttttaatggtaaacaattatctaaccctatgcaggttatcttcatgtctttctactggctccacttttggttacgatgctactacaggaggagcaggaaattatgtgcaatggtgctatactcttgtaatcggtagccaaagggtctcttattccactatgggtggcgtagttccattataattgctagctaaaaattggtttaactctagtcaataataaagggaagttgggtatttgtcccatcaccttatttctcattttgatttaatcttacctttatctttttattactattaaacttatggctatgtgtcttatgacagaagccggagatgtaatccatttccattatctaaaaaaagttatttgagggctaagttccctacttcataggctaatataagttcctaatttaaaaaagactatatatatcctgttggatcgatgtaaaggccgtcctgtagaagatacttacccttctaaaaaaacaagaattgtgata

SEQ ID NO: 8679 - DNA, 1501 bp, Oryza sativa
atccaaatccttccaaatcaatttctccgcaaaagtctattttgcctcccccagggtcgatgggccaaatttctctcggcccatctccccccttcctgccggctatctctctctctctctccctctccccctccccctccgctccgcccgcgcaccgcgcgcgcgtgcgcgtgagccgccgagccgagccctcctcttcgctccctcgctgctgctccccgcgcgtcgttcgcacgcgcgcccgcgtggtcgtcgcccgcgtcgcgcctgcgccgtctgcgccgcccggccccgctgctctgccgcgcctgcagccgctcggccccgcagccagcgcgcgtgcccgagccgcgccgctcaatccaccgcgcctcccgttgccccccgcgcgcgcgtgccgtggtggccgaccgcttggtcgccgcagccgtcaccctgtgccgcgcctgtcgctcgtgtcgccgctccgctccaaaccgtcccgccgtcatcgctgtcgtcatcgcctcggccccgccactccgcgcgcaagccaccaagggacggaggcagagcccctcctccctctgccgcgacgccccgctcccctcctccttttcccaaagcggcaaggaggcaaacccctttctctccctccttttcccctttttctcccgctggcgtcatcctccctccgtcctgtcgccgatttggccgcgagcgccgagcgccagctcgcgccttgaccgcccaaagtcggtttccaaaccgacattgccgcccttaaaagccccaggcgccctcccttcctcttcccccccccttcctccccgtttctcatctgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctcagcgtagctccgcccaatccgacgctagcatcggattcccgtagccgcgtagatgctctcgccgccgggaattggcccctcgtgacctcgtcgtcgtttcccccttttccctccgccgggcgccgccgccacaatccgccgccgacggactccctccggcgaatccgagctattggctcgtctcccctcgtcttgtgcaactacccggtgtgctcgctttcgcctgtatcgccatggttcgctccgccgctcgccgctgtcgtccgccgtccgttccagccggcgtcgtcgtctacctcccgccggcccgcgtggcagctacgtaggcgccacgtcggcgccagtcagccaaagacctggtcgagccgaccccggtcagtccatccccgtgcgcgcgttccaccgcgagccgtgaggctacgcgtgggcccgccgcatccgcgtcctccgtgaaccgcg

SEQ ID NO: 8680 - DNA, 1501 bp, Oryza sativa
acggtggagctcgacgctcggcggtggatctgggggcggcggtggcagcgacggtctcgggcggtggcggcggcggtctcagcggctggcgatggcgacggcgatggcgatgacgagagcagaagcggcggctgtgacgatctcgcgtgggcggtggcgctaggttttttttcgtttttttatttttggaaatttttttcgcgattttttctctttgcatgcggtcggcttaagcgcccacatgcgaaaatccgattttcgcatgcgggtgccctggccgcatgcaaagatttgcatttttgcagacgatttggcgcatgcagttggcgcaactgcatgtgaaaatcgctccggcccgtttgcgaaaacggtttctgtagtagttattgagcaatcaaatttcatgtaaaaccctaggtattatagtttttgttgcaaaaaatcatagaaattttagcatgtgatagataaccacatgcaggtatagtttcacaaaatcatgctattaatcatttgttctttgattcatgatacttctgaaatcaaaaatcaaatctcaaatttatggtttattcgatccatcacataagttttagcctctaaggtatgctttttttatttttctacaataacaaattaaatttgattaacatttttgtttttcaaactataaaatcatgatactcgggatttatgcgtcacttgtggctttgctaacttgtaccataatacgcgcgtaggtttatgaaatacgtaccctttgatggatggttgacctagggtttttgttagatgacagattgacagtccttgtttttaaatactatacataattgtttgtagcatttagatagtttatctaagtacatacagaccgcaaaaaggctattagacgagagcgagactaatccgctagccatgacacagacagtgtcagctgtttttgaaacttactaaagttgagctatagtgcgttgggtaaaaaaaaaaaagcatttgtgcctccagctttattctatacgtatacgacgactgtgtgtgtattattattaaagttgacctactacggggggtgtttagattcagtggtgtaaagttttaacgtgtcacatcggatattatatatggtgtcgctgaggtgttcgtgtactaaaacaaaaactaattatagattccgtcagtaaaccgcaagacaaatttattaaacctaattaatccgtcattagcaaatgtttactgtacgtagcaccatattatcaaatcatggagcaattaggcttaaaagattcgtctcgcaaaataattatttttaggctatatttaatactttatacatgtgttcaaacatttcatgtgacagggtgaaaaaattttggttggaatctaaacagggcctacatacctaaacaaaaacttgagccaacagttttttttcaagaataatcatttttacctctatatatattgtgactttcatgatccaagctagcctacccagtat

SEQ ID NO: 8681 - DNA, 1501 bp, Oryza sativa
gaatttcaatttcaaagggattttgctgctacatctttttgccctacaacttatatacagataccaaaatttgaatcttaaaacttaattttagagttggtttttgatttttttttctttgtaatagtttcttttttaacatggcgttcaagtcatgaaaaaacacatgtaaaattttaaccataaattatatttttgtcgctaatacgccatttgacgtataattggacgtattatcagtaattggtcaacatatagcagcctggccttgtactgttttcttgtgaacttccgttctcccatgagtttcgtgctagaggatttgcaacctcctatatggatagctttgcatggaggatgtacaaaagaattgcttacaaaatgcaattggattaagttaaatttcaaaaacatgccatggtgaagcagaaaagtgtggagcatatggcaaacaccagaacagatgggcatccaaagatgaacaaatcatgttgcaacctgcacaaaatcttaccaaagttctcacctagaatacctgcacaaaacctgcagttatgaccgaagttatcaactagcatagccagatagcattcaattgtacatggaacggattccacggttccacagaagaatagtagtatacttcacacacagatagaaagagagaccgaaatcagttgacatctagcaaagagcaacctaactttcataatctctaggaaaaaccagtatgcaagcttgacattttgcttcactggccagcaggaccaacaagaacaccctgagcagacccttccttcttgctgccttcttcctcatcagcgttgctgtccgccttccggatcctgatcttgtacttcagctcaaactcggtgatctccttctttttcttctccagtgcttcatgcatgcgagcgattacctcttcaaggccctccttgttgcgatgcaccgcaggcaagacttccctgatggtcctttcaaccaggacgccaccaaccattctgtagcagcgccttgagtgatccagtggctcgattgcgccaatcacaagagagtgttcactgacttccatctctaattctgtaatcttggtgtaaagttgagtcatttcagaccgcatgttcccataagtgtttgcaattatttgctcattgatggcttctttgccgtcaccacctgctttgcttgccattttccttaacagaaggatgccaacaagactaaaacctgcagaatgaaaaactgcatatttttagcatattcgtcaacatataaaaaaacatgcaagagtaatgatatggcataaacagtacaaacttttacactaactgccagttattatgatttaataacaattaacattattttctctaattccacaatattctaaaatattacggaatcacgggaacacacgactctcggtggattagttcctcgagggaaagcagggtagtagctaccatctgtcaattcaatcaaagcaagggcaatatgg

SEQ ID NO: 8682 - DNA, 1501 bp, Oryza sativa
acctcgccgtcccactcccacccacgccgccgccaccgccgccgccgccgccgcttcactcgccggagcgccatctctagccgccgccgccgtcctccccctgagaaagcgtcgattccgtccgggggtgggcagcggtgggactcgtatccggacggccgcagattcgttgagcgacccgcgctgctggttagtccaaaacctttttacctgagcccctaggtttgatggttcttgatctggagaagtttaggggagaaatatggctgcgatcaaggattgcagcctccgcatttgctctcgcaagaaggtggggagtagtagggcggattttaggggcgattttgcaacacgtgtgagattgatttttttcccctgttaccgacggaactgtgactgtttcatttgaagttattgcattatctcgagtgaaaattcttgttccagtgcaggaatttagatgaactgcacaagctggccacgttagccatgtgatggtgatattggtttgatctttgtggacttgcttagtccaatcaggatctgactgtgttcataaatgtagtgttggtgaattgtattctccattatgtctggaggcgaattacttagtctgtacatgcaactggcaggaattgattcgttaatagttaccaaaaacctggatagattggatgggcattggttaccagagctcataatgaccaaattggcttcctcagataactttgtacgaacactgcccgtacctgttcctgatggcatttcattatcaataaattccatccttcttgtatgttgaccaaaaagatgtaaggccgctatcttgatttgtgtagtcatggttttttcagttgggcggtcatcccgaccgattaaattgttccaaattagtagctggttgtttctttgatttgtaagccatgttggttctttctgaattaatagttggttttcccgcaaaaaaaaagaattaatagttggttatttctttgatttgtaatccaggtttgttctttatttagaaagcgttaaacctctattaggagagtgtagtatatgcaaggcatataaaattctttacgtttctattgccgtttctggaaatgttacggtagctctattccgcatatgcttcctaaccattggtcatactattgtgtgctacagtattttgtttgccacatgttgggtgttgcccttgtatttatatgacatccatattgcccttgctttgattgaattgacagatggtagctactaccctgctttccctcgaggaactaatccaccgagagtcgtgtgttcccgtgattccgtaatattttagaatattgtggaattagagaaaataatgttaattgttattaaatcataataactggcagttagtgtaaaagtttgtactgtttatgccatatcattactcttgcatgtttttttatatgttgacgaatatgctaaaaatatgcagtttttcattctgcaggttttagtcttg

SEQ ID NO: 8683 - DNA, 1501 bp, Oryza sativa
ttagccctagtctccatctatccctgtgtatctagctagctactagtagagagtagatactccattggatgtgccgatattttaacgattataagcaaaactttcatatgttttctgaagttttgtcaagttcatttgacttggtgcttcgatgacaattctatcaagcattttgataagaaattgaaagaagctgctacattgaaaatatggtcagctgccagtcactgttaaagaccaaatttgctggcatcatatcttccttccaattgatcaatccagagttgcgatgaaccattctatgaaccatctgaatcggttggcacagtttcttctccatttccgtttctcatttgcattttcttccactttgaagaggaggcaatcacttatcggaatcgattgcttctcttattgatcgcgacttccactttaccaagatgttactcgtcggcccgtcgatctgtccaccaacctaattggtggtgtcatggaacattagaaacagcaaccatgtaactttccctaactttagcttaatcaattagatggcatattctttcaggaaagcataggcatatacagatataggtacgtacactactaccaccttagttgttgggtggatgaaaatgattctgtccatggacaatgatttagtgcccactaatggacaggcacaaaagaactaaaaattggaaactagctaatataatacagaaaataaaatattatggcagaaattaacatcggtgaaacaggaacttaatttaagtccttgtgttcactttgcaagcctagagaagcaaattaaacacttgattatggtattaatatatagtaatactcatatatatatatatatatatatatatatatatatatatatatatatatatatatatatatatatatatatatatgcatggggaattattagctctataaatagctctctaataaccaattaaataaggaacacgcagagtcactctcaatattggagagaactgtgtctaggtgggattccgtggtaacagttgcaattggatgatttttcttcaggttcagtagctatcagggaaaaagaatgacagtgcatgcagaatgcagaatggagagatctgtttgagttggacactgttttgttcagcattcacttaaagttaatgacctttgtgtgcttataggaaacagcatgcgctaggctatcaggaaaactgtggtttactaacagtatagccttttaagtcctacgtattgctgttttatacagcctacctttgtacttctggtaccacaaataatttataggtagaacttttatgtataagttctgctaatgctgaaaaacaaattgtaatgagaaaaaaaacccctcaaaatcaactctaagattaactttcaaaaatcaaatttcctcctcgattgataaggcaacaagcaaacgatgtgagggaataacctctatagtaattattatcaccttctgaacacttga

SEQ ID NO: 8684 - DNA, 604 bp, Oryza sativa
ctttgaatagttgaggatgtaagatatatggtatttgagttcaaggggtaattcggacgaccacaaatccgcaattgttaggggagattcagacaaccacaatagtttaggggtaattcatacttttatttaatttgaactagattacaaacaaaactatataagttcctatgggcaaatgcactagttttttcaaagatatatatctctactacttaaaagagggagtcctccacatccacctaaatctctttccacccataaaaaccgcccaaaaaaatttaaactgatttatcaaaaaaccaaccattgtaaaaaaaaatcccacttagtctaaatcctcccactaaactaaataaagaaatcgttacaacacgtgggcctatatataactagtacctctaaaaatggcagcgagttctcacttttaattaagaagtaaagaactaaccttgattatggagaaaatcgggtccaaaaattttacaactgtatggttcatcgaggaaaaaaaaaccatgtgaagagaaaaaaaaacaaaaggttgtgacggcacaaataccgagatccatcataagccattggttctaatcttatcactagg

SEQ ID NO: 8685 - DNA, 1501 bp, Oryza sativa
ctcggctgattcctggacgaggattttatgcacaaataagttcggaaattactagtgaatttccgggcgtgacagtctctctctctttcgccgacgaacgccgacgacgccgacaccgacgtacgccgccgggccgcaacgttacgccgccgccgcggcacgccgccgccgcgcccccacgccaccgggcccccatgccgccgccgtggcccgccgccgcgcccccacgccgtcgggcccccacgccgccgcgagacgccgccgccgcgagacgccgccacgcccccacgccgccgggccggcccacggcgccgcaccgcgcccccaccgccgcgagacgccgccgccgcgaacgaacgcttaacgaacgtgaccaaacgcgaacgaacgcgaacgaacgtgaacgaacgcgaacgaacgcttaacgaacgcgaacgaacgcgaacgaacgcgaacgaacgtgactgaaacatgaatgaacgtgagtgttagtgaacgaacacgaacgaacgtgaatgaaacgtgaacgaacgtgattgaaacgttaacgaacgtgaatgcacttgaactaaaagtgtgagaacgaacgcgagcgaaatgtgtacgaacgagataattaaactattgttgaacttaccatatatatatgattatatatacttgaaaacatgaaatacattatatgttcctttgcatttagactaatacattttttttgcatgttgcagagaagacgtcgtcgttgtcgtccctcaagccgaagtggtagctagccctcgaaggaattcacgcaggcaagtgatgtaaagatgtgattgttagagatataatataagattgttagatttctaatataagattattagattattagagttagcatatgtgagtgttaaagattattagattattagacttagcatatttgagtgttagagatagttagagatttaatataagattcttagaggtttaatatacgaaacttaattagacttagcatatgtcagtgttagatatttaatataagattattagagatataatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatatttcaaacttaattagacttagcatatatgattatctaccgtacaaatacacgatacttagacttagcataaatgattatttgagttttaatacaagattagtagagtgttaatattacgcttagcaaatatttcttctatgaacaga

SEQ ID NO: 8686 - DNA, 1501 bp, Oryza sativa
gtgcggcgccgtgggccggcccggcggcgtgggggcgtggcggcgtctcgcggcggcggcgtctcgcggcggcgtgggggcccgacggcgtgggggcgcggcggcgggccacggcggcggcatgggggcccggtggcgtgggggcgcggcggcggcgtgccgcggcggcggcgtaacgttgcggcccggcggcgtacgtcggtgtcggcgtcgtcggcgttcgtcggcgaaagagagagagactgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaata

SEQ ID NO: 8687 - DNA, 1140 bp, Oryza sativa
ggcgtggcgttggcaggcggcggcggcgttgcgcggcggccaaggcggcggcatggcgcgtcgtagtcgtggcgcgtcgtcgtcgtggcacggcgtctcgtggcgggcggcgcgacggagagagatcgagatcggagagatcgagatgcaggaagggagatctggcggctgcggctctcaccccagagatgcggcggcagcggaggaggcggaggcggcggcgaggacgacgagctcgagacgacggcgagatacggcggcgtcggtgcggggatttgccctaggcagtggcggcaaaggagagaggccgagagagatcgatcggccgaaaacgtctaagtgttggtgaagaagacgagggcgcaccgggaatatatatacccccgaatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaagaaattaagtggataaatcgtaataagcaaatatatgacttataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgagtagtcatatataagtagcatatgaaagatagtaaattaaattgtgaaaaactctaatatatgaatgatagttttaagaatatattaaatttaatactttttaaaattctccagtcaattataattagcatatgaatgatagtaaattaaatgttaaaaactctaattaacatatgaaattgccacttgcgtgatttaaaacttttaaaaat

SEQ ID NO: 8688 - DNA, 1501 bp, Oryza sativa
aaccctagagttctttggagattggcttccggaaaagaagttgcaacttgttgatatgagtattctattaatcctattaagctctagaccgggatgttacacaaagggctagcatcaaccctttaaacagaccaggttgccaatcatgtaagactgtgtattacgcacaccatagcctcagcaaaagaaaaggcttctcacggagtggattctaatctctcgagaggatatcctctcatgtatctttttctttcaaatttgatacaaatagttgtgaaaaattctaaaaaaatatttggcaatgtagagtatagtgatatctactaatccaaaaaaatcaaattcaaattcgatttacacattgagaaaccaaaagaaaaggcttctatcatcactgtcagtcaagtaacttaaccagaataaaacagagggaaatatgaatttgtcagctatttctgtcactgcagctctcaccattcaaatctagaggtttgaccatatgatctatcatggccaccaatagataaagtgaggtcttacaaactaattaaaaaatgcagtacatcactacatccacaaccagttgccctaatagtccaatggagggcctcggtgacagttgacttacaagcaagcaatagtttcttttcgtagatccccatcaaccaaacaaaaaacaacaaatctgagcactgggagagctccactacccccatcatctgaaacaaaaattaatcacctatttgcactgctaaattccctagcttccagacctagctaactgatacctaccagtggggaccacctgcaattccaagaatcaaactgtcatgggcgcaactagtggtggtgatttgtctgaggggagccgggggttggattaacgcgcgtcaaccgcctaaatccaagggggtgcaacatgattaccgacgcttctcgatccaatgaccctaggtaatcacgcgacctccccggccgtaatcccatgtgctccaggcagccgagtctcgtgacctcacgtgacgcttccgcctctagctctcgatcgatcgatcccaccactaattatccactcccaaatgattgtttagtggcccgtatcataagaccggccacgtcgtgcagctagtgtgacttgggagagacagtgtaccggccatttgccagatttgcttcctcagaaaaatagcagagtcggccgggtttgcagacttgcagagatcggaagaatctttctctttcgaaatgttgaggatttttggaaggaaaacaaaagggaaatggagatataggaatcgtggcatttaaggcggcacggtgcagcgtcgtctgtgggttgcaacatgcatcggcatgtgagtctgcctcgggaggcgcgcgctcgtcgatctcgtggccgccgcacttcctatttaagcaccgccgcgggtgacaccgtcccctcctcctcagtactcagatacattacccgcaccgcctaattaagcgctcgcatctgaag

SEQ ID NO: 8689 - DNA, 660 bp, Oryza sativa
gatggtttgtgttagagggcgcggtcccagcctgaaggttatattatactggctttaccataggtctaatcgtagttataacttttggtaatacacctatacaactaaaaaaaatagtctaatggatgaggatcaactctatctttaagtcgtgcccctggtaacaattactatgtaggacttaggggctgtttggttgctagtcaaaatttgcctcaatttaccacaagtatggcaaataggtttgaccaagttagtatagtgtttggttctagccacaagttagtcatgccaaactttcctttaacttgaccccacatttcatagatacaataatgtgtggtaaggaggctaagatgtggcttcaattttcttggccacaactttggcaacttagccacaaatgtttggctggcttaggtagtgttacacaaccaatcaaacagcccctaaacccaacagtttcattcttcaaatcaaacagcatgaacgttcctttgtcagactttcgatgagtttgaatcttatacaacaatgctgatttcatgtatgaaaaaagagcgacggcccgctcttcttcccccaactatatacatagccaacatggagaggtcatgcgtcatggccggtcgcagagtgcgccatagcagtgtgtgtcga

SEQ ID NO: 8690 - DNA, 1501 bp, Oryza sativa
  unsure (1)..(1501): unsure at all n locations
cacgttcaaatcccgaatacaaatccttcccaattcaaatccctccgcaaaagtctattttgcctccctcaggttcgatgggccgaattcctctcggcccatctctctccccctcannnntntntntntntntncctncctntntaccccgctctgcccgcccgccgcgcgcgcgtgcgcgtgagcccgccgagccgagcacccttcgcccgcgctgcccgttgcttcccgcgcgcgcacgccgtggtggccgaccgcctggttgccgccgctgtcagcctctgccacgcctgccgcccgtgtcgccgctccgctccacactgcccccgccgtcatcgccgtcgtcacaacccggccccgccactccgcgcgctagcctccaagggacggaggcagagctcctcctcctccctctgccgcgtcgccccctctccctcctccttttctcaaagtggcaaggggcaagccccctttccctcctcctttttcccttttctctcccgccggcgtcatcccccccctgtcgccgttttggccgcgaccgccgagcgctagccctctcccttgaccgccctaggtcggttcccaaaccgacatcgccatcctataaagcccaggcgccctccctcccttctcctcttgtttgtcccatcgcctccactccattggcgccgcctcccgtgctctgttcgccgccgcctttcgttgccacgcgtgccggaggagccggcgcgttcgtggacgcggaaggggactccgggagctcgtcttcttcctcttccccggcccgaggccggagagatcactcccgtgccgtcggcctcttgtcacagcgccccgcctcgtctcggtagtgcatccctccgttctccctcctcgctccatctcttccccttagctttgagtagccgctcgagtagtaccccagtactagttggcgccgccccagcgccgcgccgccgctcgcagtaggctcgccgctgtcgccgcccgagctcggaagcgcctctcgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccaccgccgtcgagccccgtccgacgaatccgagccattggcttgtctctcctcgtctcgtgcaaccacccggtgtgctcgctttcgcctgtatcgccgtggttcgccccgccgttcgcagccaccgtccgccgtctgttccggccggcgccttcttcaacctcccgccggcccgcgtggcagccacgtaggcgccacgtcggagccacctcggcacgaccggatcggctgacccggtcagccgctcccttcgttccaccctcccccgtgcgcatggtccacggtgagccgcgaggctgcgcgtgggcccgccgcacccgagtcccccgcgagccgcgc

SEQ ID NO: 8691 - DNA, 1501 bp, Oryza sativa
aagtaattatgaaataatttgataagatatataatatgtgttatatcacttcacaaaaattaatctctataagtttaaaaaataacaaatttaactatagtagttaacgtatatttatagtcaagtttgtcttttaacttgtagaagttgaattctaacttacatatttgtgaagtgatatattaatctatcttgacaaatttttttaaaaaaaattcgtagatggcgtgtgaagaacaaggggacattcccttgagagtttagaattgtttcccttattactggtgtcgatcgacaaaccggtattttgtatatgtgcagaattagttactccctctgttacaaaatataagcgatctccaatattcaaaattagtactacaatataagcatttctatgacactatgacactgattctattataaggaaattcataggttttcaacaagtcaagtgtttgggagaggaatataagcgattcaaaatttaaccattatggtgacagaaagggaatattttcccttaaccttagtgtttgtaaataatctatataaatgcttatattttgtaacggagggaatcctaattacgctgtaacacatcagaacaagaaattcataaagatatgcagtattctactagttgatcatacggttctggtggttgacctaaagtactgaacaagataatgcaaattatttgactatttcttcaatgcgtcgccagtggttggaatagaaaaagagaagaagttgtggctgcaaagggtttaagggagttgagcctttagttagacacttagacagtactgaaaggacaattaattaagaagtgaaatactcctactactcgcttgtccaattaagaaatttgaaatatcccttacaaattaagaatttcatggaacgaaattaggtggccaataaatgagcataggcatattttcggtgtggattatttctgatcgatatataaaattgacatgttacagcttggtacgtcaactagcagaggatatgctagtagcaataattttattttttgagagagaagcggaggatataatttcgttagccaaacagagtaaaacaaaatgccctagtcgactggaagaatggtactccagttcagctatagcagaaacattcccgtgcatgcgtgatcttcggagcatttctgttcttccctttcacaacgatcgacttctgttcggttttaactactcgacttgaagaatgctaacatacgacttatagtttctgatgcagcaaacagtgatcatcacgcgtaagtcaatctctggacgttgcagagccatgtgcaagattcaataatgcatatgcgacaatcattcattgttatgcaatccatatccattcctctttgcaggcctcctagatcactatataagcagttaagcaccaccattgccgcagacatccttcacccccaaatccagtaatcacaacagtatttagctgcaaggaatcaagctagctg

SEQ ID NO: 8692 - DNA, 991 bp, Oryza sativa
ttcccctctcgccggcgtcacctcctgtcgtcgctttggccgctagccggagcgccagctcgccggcttgaccgcccaatgtcggttcctctctcccaaaccgaccttcccgcctccaataaacccaagcccccccccctcccttccttcctctcccattcgcctcctcgccattgccgccgctcccgtgctctgtctcgcctccgccgtccatcgccaagcgccgggagagccggtgcgttcgtggacgcggaaggggactccgggcgcgccctcttcttcctcttcctcggcccgaggccggagagatcactcccacgccgtcggcctctcgtcaccgcgcccgtcccgcacggtagtgcctccctccgttcttcctcctcgctccatctcccccccttagctttcagtagtagctcgagtagcctcctggaagatagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgttaccgcgtagatgctctcgccgccgggaattagcccctagtgacctcgtcgccgtttcccccttctcccgccgccggttgccgccgccgcaatccgccgccgtcgagcaacccccggcaaatccgagccgttggttcgtctcccctcgtcacgtgcaaccgcccggtgtgctcgcttttgcccgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagctgtgaggctgcgcgtggacccgccgcacccacgtccaccgcgaaccgcg

SEQ ID NO: 8693 - DNA, 1501 bp, Oryza sativa
gcaccttttctcatggccctatgtatcgtggagtctgtgtgatatttgttgtaagtattgggaagtggaggaccagactttgcctaagctgtgcgtcgtcaagtttcaaccaggtcaggtgtgtgcctctcgctgtagtagtctctaccattcccagcgcatgaaaccgaccgtaatgaagaaagcccacgacgcaccccaactacccaagtgacactcgtcactcgtgccgtcggtcatgtgcatgcaccacgcacgcatggaatccacggcaacagcggcgacgcacgcccaccacctctagactctagtagttgtagtacaccccaatgccacatgcaaaagcgaggggttgtttggttggcatactcacattactaaaacgtgccatactttatttagctaaagctgtttggatgctatattaagtttgccaccattcaccatactttttatgctacacttgtctaagttgtgacttacaaaaagtgagccacaccttagctagcaaaattgaattatgccacactttattgagttgatgatatgtgggacccaaatagataagaagtaatactgccacaagtgtggctataaaccaaacaatatactaacttggtcaaacttatctaacataagttgtgataacctttggcaaactttgggagcaaaccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaa

SEQ ID NO: 8694 - DNA, 1501 bp, Oryza sativa
ccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaacgagtcgcagtaaaacagcagtgcggactcggagacagtacggggaaaacgcacatcgaacggtggagagtggagtggagtcgaatgcagcgcgagtgagtccagaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagtttgtagaattttcagttgcattttgctgtttctgcttgggagttgctttggggcgataagaattctcttgttgatttgttcctcgcaggagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacgg

SEQ ID NO: 8695 - DNA, 1501 bp, Oryza sativa
actaaaccactaaacttaggacattaaatccaccggcttataaattatataagccaataagctgacttaaaaggatcggtgccgccgctgccgcccgcgcgcacgtacgcctaaaccgaacgcacacgcacgcgcgctggatcgatctgcaagggacgcgcgcgcgcctgaggcctccgcgagcgagagagcgaggaaggcgaggtggccggggacgtccctgtcgcgggctaagctagccgcaggcgggggctcgcgcgggtgccctgcgcgatacgtcgtcgtgaggccggcatgtgtggaagctggctgcctgagcgcgcccagccacacccgcgctttcccgctccattaatgccccgcgtcccgcatcgcgcttcgctggcgcgccccctgcccctccgctgcctcccccccacgtcgccctcgccacaatccacctcacacgcgtgacctccatcgctcgcttgccaaatgccttagctgcgtgtgttgccttcccatcactctgtgtctgtgtatataacggctcgtctcgtgtaaaagctactgctctaaatgtgcttgctaggaacgtgacggtgttagctaggtagtttgttcgtgttcgttcatggagtcgataatggagaagccgatgatggacacgggaggggggatgattgagcggaccaagtcggaccagctggcgccgccgccgccgccgtcgtcggcgcagtcgctgagcaggacggcgtcggcggagacggtgctgagcacggccgacgtgacgacgacgacgagcctgtcgcgcaagtccagcttcgggaagcgctcggcgtccggcggcgccggcgccggtgggaacagccacggctacagcagcagcaacaacaacaacagccacatccgcaagtcccgcagcgcgcagctgaagctcgaaatggaggacctcgtctccagcggcgccgccctcagccgcgcctccagcgccagcctcggcttctccttcaccttcaccggcttcacccctcctccccaggacaccatgtcctccgccgagctccatcccttcagcgacgacgacaacagtatgcatccaatcactcctactgatcctaactgcatgcacatatggttatcgtacctttcgtagttatatttgtcatttttattacaacttataaaaattgaatttaaatttgtattttcgtggagtgatatattttatattaatttatgttactaatttttttaatttttttatagatatttagataatatagacgaaacgagggatatccgatctccttgagagatgaaatcacttccctaatatatatattctcattctctgtgccgctgtgcgtatgcagcgatggacatcgaggccgggacgccgcgcaagaagctgatgaccgagccgacgttgccgatatatctcaaggtaaatcgaccaaacgcatcgattatcccaagctccatggacgtacgccgccggcatgcgagaggttcagtgagc

SEQ ID NO: 8696 - DNA, 1501 bp, Oryza sativa
acttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaattcaatttttataagttgtaataaaaatgacaaatataactacgaaaggtacgataaccatatgtgcatgcagttaggatcagtaggagtgattggatgcatactgttgtcgtcgtcgctgaagggatggagctcggcggaggacatggtgtcctggggaggaggggtgaagccggtgaaggtgaaggagaagccgaggctggcgctggaggcgcggctgagggcggcgccgctggagacgaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacaga
